United States Patent 10,724,096 (METHODS AND COMPOSITIONS FOR INHIBITING AND TREATING NEUROLOGICAL CONDITIONS) - sequence listing, part 105

SEQ ID NO: 1813 - DNA, 6601096 bp, Homo sapiens (residues 4,950,823-6,601,096 of 6,601,096)
  misc_feature (895456)..(945455): n is a, c, g, or t
  misc_feature (1206566)..(1256565): n is a, c, g, or t
  misc_feature (1464799)..(1514798): n is a, c, g, or t
  misc_feature (1657604)..(1707603): n is a, c, g, or t
  misc_feature (2172111)..(2222110): n is a, c, g, or t
  misc_feature (2374984)..(2424983): n is a, c, g, or t
  misc_feature (2597563)..(2647562): n is a, c, g, or t
  misc_feature (3845721)..(3895720): n is a, c, g, or t
  misc_feature (4445464)..(4495463): n is a, c, g, or t
  misc_feature (5128335)..(5178334): n is a, c, g, or t
  misc_feature (5858412)..(5908411): n is a, c, g, or t
  misc_feature (6090059)..(6140058): n is a, c, g, or t
  misc_feature (6431969)..(6481968): n is a, c, g, or t
tgatactgtattgtttaagatgatagatttcatgttgagtttcttacaataaaaataattatgccataaaatatgcataagactttttcaatgaatgtaatactcaaaatctgcaatggaaatgcttcttagcaacaagggaccaataggaggattatatcctttcattcttcagctatacttaaagtgggtatttagagttgaaaaataatcagtgtattttcactgtttttatttggagtcactacacaaacagctataaaattttgaagaaaaataggcttatgcagaagtatagagaggaaagattacatacatccacagacctgactcctagcaagcgcaacttgtaaagtatgaaacagcttatatgttacgagtgtaattataaattggcaaaatgtcctttttatcacagtccagtacatttttattgctttcagcttgctcaaggttttatattgctcaggatttttctctgaaatgtacttggaggagagagctatacattgtaaagccatacactatcttagaaacccttacctcctgaaccacttcttctggcacaggctttatccttttccttttcttgttaagtccacagaaccatctcagggcaaaatggtgaagtgggccaacgtagtcttttctagttctctgtgtggttcacccattcaccgatctgaatttcttcggaccccgtctgagtcggttgtcctcaggagtcgtgtaaactctctgggccccagcctgtgcgctccttgtttcctagcccagggagtgccggtgttctggtttaataaacatcctggacaaatgaatgaaaaaggcactaactgataagaatccccataaaaggctatttaaactttaataatgaactttaaaaggcttgtaggcccaaaacaatgagtattttgatggtgacaactcagatgtgagaaatggaggtgataccttgagagaaagtgactgcagtagtccccaaatccctggtggatgccagaaactgcaaacagtgctgaaccctatatgtactatgtttttttcttatacatacacacctgtgatgaagttgcttttataaatgaggcacagagattaacaacaagaaccactaataaaatagaaaattgtagcaatatgccagcatcactacttgtgcactttggagccgttgttgattgaaataagagtgatttgaacacaagcactgtgataccatgacaacccacctgataacccagagggctacttaagtgactgataggtgggttgcttatagggcatggatatgctggacaaagggatgattcacgtcccatgcaggacagagcagggtgacacgtgttttcatcacattactcaggatagtgagcaatttaaaacttatgaattgcttatttctgaaattttctatttaatattttcaggctgtgattaaccacaggtaattgaaactatggaaagcgagcgaaactgcagataaggggagacgactgtatttctgatgtacttcgaattatactttaaaatttgtctatagaaaattgtttgtgtttattcttacagacctgtggaaccaatttttaaatctcctaggcaggctaaaataattgcttttgctatctcattttttataaacatttatttgtgagataaatctttacttttatcttacaaataaaaaagataaagagataaagaatataataaaatatatttgcacttctaaaatttgtattattaagctttaaataaaatacaggaaaatagttctactatactaaactaaggaattttcttctaagcctcaaatctaaaaatctataaactaatctgaaagaaaagtaatgaaaatcagggccaggtacagtggctcatgcctgtaatcgcagcactttgggaggccaaggcaggtggatcatctgaacttagtagttccagaccagcctggccaacatggtgaaacccagtctctactaaaaatacaaaaattagctgggcttggtggcaggcatctataatcccagctactcgggaggctaaggcaggagaatctcttgaacccaggaggcggaggttgcagtgagctgagatcccaccactgcactccaacctgggcaaagagtgagactgtctcaaaaaaaaaaaaaaaagaataaaagaaaatatcaatatttctatataaacttgggaatcatgcatttcagacaaatttgggtgaagttgattatggttgtcatgacaatgaaatactgaccatctctgagcaaagggcttaaggaagtatgtgggaagtgctcaaaaacataagctatgatgatgatgatgatgatgatgatttgaatttgagaatataatcccattttctttgggctattcaaaaactagcaaaaagtcaattagttaaaaaaatttcatttcagaaattagtttctgtggcctagaggaaaaatacactgtgtattctcatcaatcactgatttgaatggacacttaaaatacacctccatgtgcaggtaaaaagaagttactcaatggtgagcaaccttgtggactagaaatacagtcatccctggatatctgcgggagattcattccaggagccccccacccccaaatataccaacgttcatggatgcccaagtcccttatataaaatggtgtagttttgtatgtaacctttgtacagcctcctgtatacttaaatcatctccagattactaataatacgatgcaaatgctgtaaaaatagtcgttatactatattgtttaaagaataatggcaagaaaaaaatggttgtgcatgttcaacaaagtcacagccatccattttttccccactattcttaatcacagttggattcatgagtgcagaacccatggatatggagggctgctgagtgtactatatccctagaaagttattctgaaatagagataagtaagcgtaaatcttactcatatttacagggttgcagcattgtttataagagcgaaaattgacaactctctaatatctagaggtttatctatctagaacaggaagatcattttaaatatataccatccaaaactatgcagatcttttttttatatatacttcaagttctagggtacatgtgtacaacgtagcaggtttgttacatatgtatacatgtgccatgttggtgtgctgcacccattaactcctcatttacatcaggtatatctcctaatgctatccctcctcccaccaccccacgacaggccccagtgtgtgatgttccccatcctgtgtccaagtgttctcattgttcaattcccacctatgagtgagaacatgtggtgtttgcttttctgtccttgctatagtttgctcagaatgatggtttccagcttcatccatgtccctacaaaggacatgaactcatcattttttatggctgcattgtattccatggtgtatatgtgccacattttcttaatccattctgtcattgatggacatttgggttggttccaagtctttgctattgcagatagtgtcgcaataaacacacgtgcatgtgtctttatagcagcatgatttataatcctctgggtatatacccagtaatgggatgactgggtcaaatggtatttctggttctagatccttgaggaattgccacactgtcttccacaatggttgaactagtttacagtcccaccaacagtgcaaaagtggtcctatttctccacatcctctccagcacctgttgtttcctgactttttaatgatcaccattctaactggcgtgagatggtatctcattgtggttttgatttgcatttctctgatggccagtgatgatgggcattttttcatgtgtctgttggctgcataaatgtcttcttttgagaagtgtctgttcatatcctttgcccactttctgatggggttgtttgattctttcttgtaaatttgtttaaattctttgtagattctggatattagccctttgtcagatgggtagattgcaaaaattttctcccatgttgtaggttgcctgttcactctgatggtagtttcttttactatgcagaagctctttagtttaattagatcccatttgtcaattttggctttagttgccattgcttttggtgttttagacatgaagtccttgcccacgcgtatgtcctgagtggtattgcctaggttttcttctaaggtttttatggttttaggtctaacatttaagtctttaatccatcttgcattaatttttatataagatgtaaggaagggatccagtttcagctttctacatatggctagccagttttcccagcaccatttattaaatagggaatcctttccccatttcttgtttttgtcaggtatgtcaaagatcagatggttgtagatatgcggcattattcctgagggctctgttctgttccattggtctatatctctgttttggtaccagtaccatgctgttttggttactgtagccttgtagtatagtttgaagtcaggtagcgtgatgcctccagctttgttcttttggcttagtattgtcttatcaatgagggctcttctttggttccagatgaactttaaagtagttttttccaattctgtgaagaaagtcattggtagcttgatggggatggcattgaatctataaattaccttgggcagtatggccattttcacaatattgattcttcttatccatgagcatggaatgttcttccatttgtttgtgtcctcttttatttggttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgtttatcagcttaaggagattttgggctgagacaatggggttttctaaatatacaatcatgtcatctgcaaacagggacaatttgacttcctcttttcctaactgaatactctttatttctttctcctgcctgattgccctggccagaacttccaacactatgttgaataggagtggtgagagagggcatccctgtcttatgccagttttcaaagggaatgcttccagtttttgcccatccagtatgatattggctgtgtgtttgtcataaatagctcttattattttgagataggtcccatcaatacgtaatttattgagcgttttagcatgaaggttgttgaattttgtcaaaggccttttctgcatctattgagagaatcatgaggtttttgtcattggttctgtttatatgctggattatgtttattgatttgtgtatgttgaatcagccttgcatcccagggatgaggcccacttgatcatgatgtataagctttttgatgtgttgctggatttggtttgccagtattttattgaggatatttgcagcgatgttcatcacggttattggtctaaaattctctttttttgttgtgtctctgccaggcattggtatcagaatgatgctggcctcatgaaatgagttagggaggattccctctttttctgttgattggaatagtttcagaaggaatggtatcagctcctccttatacctctggaagaatttggctgtgaatctgtctggtcctggacttgttttggttggtaggctattaattattgcctcaattttagagcctgttattagtctattcagggattcaacttcttcctggtttagtcttgggaggatgtatgtgttgaggaatttatccatttcttctagattttctagtttattggcatagaggtgtttatagtattctctgatggtagtttgtatctctgtgggattggcggtgataccccctttatcatttttattgcatctatttgattcttctctcttttcttctttattagttttgctaccggtctgtcaattttgttgatcttttccaaaaaccagttcttggattcattgattttttgaaggatttttttgtgtctccatctccttcagttctgctctgatcttagttatttcttgccttctgctagcttttgaatgtgtttgctcttgcttctctggttgtttcaattgtgatgttagggtgtcaattttagatctttcctgctttcttttgtgggcatttagtgctataaatttccctctacacactgctttaaatgtgtcccagagattctggtattttgtgtctttgttctcattggtgtcaaagaacatctttattccttcatttctcaatgtacccagtagtcattcaggagcagattgttcagtttccatgcagttgagcggttttcagtgagtttcttaatcctgagttctagtttgattgcacttttacatttgctgaggagtactttacttcaaactatctggtcagttttggaataagtgcgatgtggtgctgagaacaatatattctattgatttggggtggagagttctgtagatgtctattaggtctgcttggtgcagagctgagttcaattcctggatatcctttttaactttctgtcttgttgatctgtctaatgttgacagtggtgtgttaaagtctcccattattattgtgtgggagtctaagtctctgtaagtctctaaggacttgctttatgaatctgggtgctcctgtattgggtgcatatatgtttaggatagttagctgttcttgttgaattggtccctttaccgttatgtaatggccttctttgtctcttttgatctttgttggtttaaagtctgttttatctgagactaggattgcaacccctgctttttttttattttccattgcttggcagatcttcctccatccctttattttgagcctatgtgtgtctctgcaggtgagatgggtttcctgaatacagcacactgatgagtcttgactctttatccaatttgccagtctgtgtcttttaattggagcatttagcccatttacatttatggttaatattgttatgtgtgaatttgatcctatcattatgatgttagctggttattttgctcgttagttgatgcagtttcttcctggcatcaatggtcttaaaaatttggcatatttttgcagtggctggtaccagttgttcctttccatgtttagtgcttccttcaggagctcttgtaaggcaggtctggtggtgacaaaatctctcagcatttgcttgtctgtaaaggattttatttctccctcacttatgaagcttagtttggctggttatgaaattctgggttgaaaattcttttctttcagaatgttgaatattggcccccacctcttctggcttgtagagtttctgccaagagatccgctgttagtctgatgggcttccctttgtgggtaacccgacctttctctctgactgcccttaatattttttccttcatttcaaatttggtgaatctgacaattatgtgtcttggatttggtcttctcgaggagtatctttgtggcattctctgtatttcttgaatttgaatgttggtctgccttgctaggttggggaagttctcctggataatatcctgcagagtgttttccaccttggttcctttctccctgtcactttcaggtacaccaatcagacgtagatttggtcttttcacatagtcccatatttcttggaggctttgttcatttctttttactcttttttctctaaacttctcttcttgcttcatttcattcatttggtcttcagtcactgataccctttcttccagttgatcaaatcagctactgaagctcgtacatgcgtcatgtggttcttttgccatggtttctgctccatcaggtcatttaaggacttctctacactgtttattctagttagccattcgtgtaatcttttttgaaggtttttagcttctttgcagtgggttcgaacatcctcctttagctcagagaagtttgttattatcgatcatctgaagccttcttttttcttttttctttttttttttaattatactttaagttttagggtacatgtgcacagatcatctgaaaccttcttctctcaactcatcaaagtcattctccgtcccgctttgttccattgctgatgaggagctgcattcctttgaaggagaagaggtgctctgatttttagaattttcagcttttctgttctggtttctccccttctttgtggttttatctacctttggcctttgatgatggtgacgtacagatggggttttggtgtggatgtcctttctgtttgttagtttttcttctaacagtcaggaccctcagctgcaggtctgttggagtttgctggaggtccagtccagaccctgtttgcctgggtatcaccagcagaggctgcacaaccgcaaatattgcagaacagcaaatgttgctgcctggtcgttcctatggaagcttcgtctcagagggacaccctgccgtatgaggtgtcagtctgcccctacttggaggtgcctcccagttaggctactcgggggtcagggacccacttgtggaggcagtctgtacattctcagatctcaaattccgtgctgggagaaccactactctcttcaaagctgtcagacagggacgtttaagtctgtagaagtttctgctgccttttattcagctatgccctgcccccagaggtggagtctacagaggcaggcaggcctccttgagctgtggtgggctctacccagtttgagcttcctggctgctttgtttacctactcaagcctcagcaatggcgggcgctcctcccctagtctcgctgctgccttgcagttcgatcttaaaaagtattagtgagacccaaattcatagaaagatttccatgacatatatcatttaagtgaaaaaagaagttggagaaaacgtgcactgtgcaaaaataaaatacgtgtgaatataatgttaaagaactcaaagtgcattcactgatctggttattctagggaggagaacagattggcaaaagatgacttactcattttattccatatatttagatatttgaatttttacaaggacacattcatgtacataaatacataggctgttaggattgctcatgcctgtagtcccatgcttttagaaaccaaaatgggaagagtgcttgaggtcaggagttttcatttgttttgttttttgagacggagtctccctgtgatgcccaggctggagtgcagtggtgcgatcttggctcaccgcaacctctgcctcccaggttcaagcgattctcctgcctcagcctcccgagtagctgggactacaggcatgcgccaccatgcccagctaatttttatatttttagtagagatgtggtttcaccatattggccaggctgggctcgaactccgaggtcaggagttttagaccaaccagggcaacatagcaagacctcatctcaagaacaacaacaaaaaattaaaattagctgggcatagtggcacacacctgtagtcccagctgctcaggaggctaatgcgggaggatagcttaagcccaggagttcaaagctgcactgaggtatgattgtgttgctgcattccagcctgggtgatagaatgaaaccctgtctctaaaacaataaaaaatatgtaagtaattaaaaataatgataatgaacactttgtgtgtactatgtgtcaggcactgttcctcacaccatcactctgaaatatatactattttcataattttatggatgaggaaactgaggcactgaaggatttttgtccaaagtcccacctttagtgagtggttccagagtctttattattaacccccaagatcttctgagtgattttatcttaaaatagttaggaacctgaggttaggcagatctgggtgagaatccagctctgtcattgacaggctgctcaactctgagcaggccatattgaaaggtggcatctgatctgaaaattgaatcataggagaagtcagcctcgtggaaccttggtgagctcacttgctaatctgtaaaatggtaaagaataactgccttatgggattactgtggtgggaggagctagcccggaggagccttgggtaaagaggtcccaagtacgctttgattccaaaatcccagaattccgatttttacatctatttagaaactcaaaaatgtactccagagttataaataggaccatgtaagcattctgaggtataggggagaaatgtttagaagagtaagttctgaatcatccacacaccatctagaattccagttagatattcactgggtttactaagtaagcacatctgggagacgaaggtggaaggtagcagctacaattttacgaaccttagtttaatcatatcttataacccacaaggtaccaggcattgtgctaggcactgggggttcagagcataccgtgagagaagataatgttgagagatggtccataaacaactattcaacaattgcaacagcagttataaaaggagtcatgatgtagagtgaatggatgggggcttgaagggacagtaatcctagggggacggaacagagaaggtcaaagtgaagaagtgatactcagtctgaaaattgagtggtagaaggagccaaacagagaagatctgggggaggaacattatgacacaagagacaggaagaggaaagccttggaaacagggaccagcttgagagatttaggggaataaaaaggttcattgtgactggaaatcagcaaacacgtgggaagggtgtgggagatggaaccagagagggagtgctcggagttttgggggtcttgtaaaccaagggcagtggagactgagaactgaggaaaaggggtcaggcttgttggagtgatattggtgatcactgcaacatcagtatcagaattgtgaggaaaaaagtcaaatcgtaaaaggtttaaagttagtgagtgtgggaaaagcagaagcagtggctttatatttctctttcctggagagaggtgccgaaggcattcaggagtagaggaaagaagggttggaagttccacatggttcactctaagaaggagagttattatgtatagatgagaaatagatagatagatagatagatagatacatatatacatacatacatatagataaataggtagattatgtacacatagaaagatagacgatatatagaaatagaagaaaaaatgcaggccagctgtttatggttacgtttctaacaaataataagatcagtagaaataatcaacctgcacccttttctgacatgtgttgttagaaagtcgatatgtggtgtcacataactgagaccggcactgtagccagttctttggcatttcattaaaaacattatctctaccaggtatcattgtatattggtatttttccatgtatctataattttttaaactaccccaaagtagagccagcatcattttagaagtaaatttaaaacctctttgctaggcatgctgcttggaaaatcgaacatggtaggttagtcagccatgccgtggctgtgattcaggcagcctgatcatatttgcagtgctgctcaaacaagcagcgctctcatccttcatttcatggtgattcagactaaaattactcacaacttatgaggatcattgttaaatggctattgaagattttgatatttgaaaataatatcaactaaaagataatatttctcagaacaatttggaattcttggtgtagacttgaggatttagtaggttttttcctaattttgatgagaagtacatcatagtgtatacaaatataaaacacaattagcccctgtgaaagtcatgattggagtgaaaatacagagtcatgatagacatgtaatacatatatgtatttttctgacacatacgtaccagtaaaatacgtaggtaccactttgatcagcaagagacagtttatattacttttcaatttgtataagctaaattagcttttcacttatatttatttgcttctagtttattgctcaaagatggatgagattttatctcaaaattgccttcagtaagtcaaattgggtaagattagttttcaagaatattaaccaacaatagtgaccattattaatgggaaagtgattcttttgtaaagcctaactttagaaagtttgcactgagaaacagattttgatatttgtttttatagacacagtacttagtttttgtcttttttgatatttttctcagaaaagccattcacatggagtgctgtatggacagaattctgttcctccaaaatgtatatgttgaagccttaaccctgaatgtgactatatctgaagacagggcctttcaggaggtaattaaggttaaataaggtcataagagtagggcactaatcctgtaggacggtggtcttataggaagagagggggagagagagagagagagcactgccatgtgaggacacagtgagaaggtggtcgtccacaagccaggaagaaagccctcatctggcaccctggtcttggccttcccagcctccagagctgtgcgagaataagtgtctattatttaaacctcccagtctgcagtattttgttatgacagcctcaacagactaaggcagggtgcctgacacctagccagacaagtccactgttttccacattcttttgtgctgtattaatgattaataagcctcaacacataacttcaaaataaatatttgcagaaaatagattccttttgaaattaatccgcatatgtacccgtaaattattctctgaacaaaatttgctacgttatctgtataaacgattcacccaaatgcttctctttgtctaccattatcccctccatgtgaggccatttgtttctaaacagtaatatttcatgtacctcagccattatcatggggagctacattctctctgtggattttaagtgaagatggaacagaatgcaatcattagcttttagaaggagccagtgtaggctgtgggtttcagtcttagacctgcgagttcaaagcttaagatactgaaataacatatattttggataagtgatacaaataattattttaaagctatagtgttaaatggcagaaaggtaactgtgaaggccataaaatccctttggaaaggtatgtaagggggaataaatctactaagagatttgtaaccagaaaaaaaggcgtcatgcaggcggggctcctgggagatactaataaaggcggagcatttgggcaggccccgttcgcacaaactcaccatccatccgacacgacctcctccgcctgctctcagacaagcttcagatccacctgcagcttcaagacatgattctattgctttacctaaaatggcaaaggaaaatttttcttcaaattgtatttgagttcagtgacattatagctccaagtcccattttctgaaaataatcttcatccagccagacttggaatggaaagagaattcacacagaaaaggagaaaaaagagaggaaacgtatcgagtaaatgtttacatgtgaagcgctgtctgaaatgttttacatttatcacattttattttcatgaagacatatgggaaaatggaggcgtagcaggcaacgtgtgtaaacgtcactgtttactcatactgacatgggctaaatgaagatagaattaatgcctctgagagttatttatgtatatataagagctaattacgtattttatcccaaacatagagcagccagccacacattttggactctgtggaagccacaattttaaaaattcagcgctgtcttgttccatattttcatcttatcatcaaaccctctgtctcaaatttagaacagtaagtttggacacagctcctggccaaaccttcttttggcatctgtgaatgaaagtgcagttatacagcaaagatcaccgtcagtgggagatccagaattaatgtggattgaagctgagtcgagacgcagtggctttaattcagaactgctgttaatccagtgtccacggacactctcgtagagaaaagaatgcaaagtacggggtgcaggagatgatattaaacagtctccgaatgtaggtaagtgcaagaaaagaaggtggaggcagtttatagaggtgatttaaaagttttcatatagtagaagcacatcctgaaccaatcaggaagagttggtttaaaaaaaatcatgaaaaggatattttggtgattctgtactgaaaggggagaagacgagagaaaaatcaatcagaagattcaaacctagagataaagagactcaaacctggagagaattacttcattttgctagagatgtctagcaaaacgaagtaattttgcaaatgaaagattgaaggtagagtgaagaagtgtcttctgagagatccttgggccttgaaagaggctgagaaccctatgtggtccccttggtcagtcctaatacagaccctaaatcatagcacacatctctctctctctctctctctctctctctctctcctctctctctctctctctctcgcacacatctctctctctctctctctctctctctctctctctgtatctctttctcactcccttctccgggcaggagagacagctgcaggtgggggaagggtggtgtccagtgaggggcccaggccagctttctcaggggtcgcactgggctggtgaggatctttgcagcctgagggcaccaacactggatgggataagggcagaccagatggaaggaacctggcacaagccatttaattaaatgcccctgcccctcacccttaagttagagagaaccagtctgcaagcttcagattccagagtaggaacccaggtaaggagggaggaagtgccaggagcacacacagacccagagccaaaggggaaggtctgtacaaagctgcccccatcctcggcatcgctggtgtgcctgagtgtcatgggagacagcgaccacacaacacccttggggaaatgggtgagagagcaacacagcgtggctaaagatgagcactattctaaaagaaaatacggactaagaaaagatgatcacaattttcatcttttcttcaagagtggttacttttggggttcagtgaaagagtggctatcattttttagcttaacttttatttcagtcttctttttttttctttttctttttttttttgagacagagtctcgctctgtcgcccaggctggagtgcagtggcgcaatcttagctcactgcaagctccgcctcccgggttcatgccattctcctgtctcagcctccccagaagctgggactacaggcgcccaccaccacacccggctgattttttgtatttttttagtagagacggggtttcactgtgttagccaggatggtcttgatctcctgacctcgtgatccacccacctcagcctcccaaagtgctgggattacaggcgtgagccactgcacccggccttatttcaattttctaaccaagaatgtttatgtgcctggcgcggtggctcacacctgtaatcccagcactttgggaggccaaggtgggcagatcacgaggtcaggagttcaagaccagcctggccaacatggtgaaactgtgtctctaccaaaaatacaacaattagctgggcatagtggcatgtgcctgtagtcctagctactcaggaggctgaggcaggagaatctcctgaacccaggaggcagaggttgtggtgagccgagactgcaccactgcactccagcctgggcgacagagcaagactccatctgaaaaaaaaaaaaaaaagaatgtatatgtgatcatactttgttggtttattaatacatttattttgtatgtcaacaagggttatctgactggtaagactgtgaaccatattttgttttttctttgttattctctgctaaaaacaaacaataaaaggaaataaacagaaggtcctcaaaatgtggacttgtaattgtgcactgatggaaacaaatgaaaaagcaacacatttatcgcagtataataaaacacaaactgacatattaaaaatgggaacttttttgtttaattactccatcaggtacattttatttctatccctttgggagtcagctgagcatctttcagggaattgacctcctgcagaaaattagtcaccctggggtctcagctttctggattcctgaggatgtgccctacacctgacagggcagaaacaaggacagaatgcctcatgcttacttcagtttgcttttcagataaatatttatttttcttttctctccagctcaacatttaacttttcatgcatagtaagcattcatcttgaatttattgttaattacatagctctcgtcattttggtttagcaatattgccgactcatttaaatgccaaaaaaattttaatttatttatgaaagcttctaaaaaagcttgaaaacacaatttggtggaggttagccatttgatttcaacaaatttcagatgtatatggctggattctatttaaatcaattttttttctgaatgcaaaattgatatttcttataaatgctaagcattattttatataaaaatgccaaacttctgtgataatcaacatatttcccttattaacgtagtctaaaatatatttaaaaattctaatttgatgagaaaattttgaatggggatggttatcattcactctttctggattgtttctcaacattgaaatggacagtcatcctcttaggaaaaacccaaactgaagttctcaaaactaggtttggggagaattataactgatttgagatttggttgataaatgcatcattcctgattgggaaatgattaaattttcagcaattggcatttgggccaatttaaagtgattcgagatagattgtaactgcagtaatattactggggaaatggagtatttgctcaagacaggtcttgttcttttaaccaattttccttttttcttgtgatctgaacttatttcaaattagttagatgagacatggcatatgctattcaaccaaaatgtaatggtcaatgaagatgttaacacatgtcctcgttcacattttaagcacatattaatattctcaatctcaaaaacatttacagtcatctccctgcaagggattggttccaggaccccctcgggtaccagaatctgctcatacttaagtcccacagtcagccttgtagagacttctgatacagaaggccaaccatatttattgaaaaaaaggtgacacattgattataatgcaaaagtgtaaatatgaaggaaaccatcttcctttagtacagaaggcatatttgtgccaggtgaaatgactgaatataagaacaatatttaaaataagctctgtagaactcgcatattacctaaccttgttaaatatggcttatttgcctctggtgtttctattttttagtccaaggtgttttccctttttttctctctgattacttatctttcttctttgtcatcaatattcacagtattgaagcatccctttaatttcttagtctatttgatttcctctaaaatgtcattagcatactctttacatactcagacacacagtactaattgattaaataaattccaagaaagacataaaattaagcacattattacattcagaacgaatgagagacatttaaagtcaaaaacccccaccaaactttaaattttcagcaaatagaagctctgtatgaatatgattttaattaacagtcacttcattttaaataatcacatcacttacagaggtatgatgttaagaggcttggttttcgcataatcgctgtgggaaggtgagcgctcacataaaaagcacacccagctgaacctggaggattcatgcagtggggaaactgaacttgcgttcaatgtagccttgctgaggaatattgaaagacgtgaccaatcataggtactaatgccctattgggacaaccatagatcctgataaagaattctgaggaacttaacaccagagcaagcctgatacagaagtatgtaaaacagaacatcagagtaagctcactgtaattactggtgcaaattgaacatctgctgactattttctaaagataggatgatgtgtaacaactgcaacattaatttcatataaatggagctgaatattcattacagctttgtagccacttgctgcctgtccacatacattcaggttatttgttttgcccaataataaaatcaactaattctgtatttgtgaattggcatgtttctttgggtattgattttccccccaacaatttggtgatgaggatgggatttcttgagtgagtgcttctattggttaatttgtgggaagatttgtgtccaccttcttaaaaagtcattttattgtgataaaacacacttaacataaaatgtggcctcttggattaggtaagagaccccgactgtttgcttaaaagtctcccattatctactttggctcagcaggattgggttcctggggaaaatttcaaaaccttactacaaatttggagttattattgagcaaaatgtgtaatacaggctcacaggtcctatatgattcaggataggttttaacggcagaaaaatatgggaagtccagaatgttgctggcaggtctttctcttagaagggttatttcactctattatgtttagaatgggtaaacttctgaaaattctgctttgcaatggccagagaaaggcttttttttttttttttccctgagacggaggctcactctgtcgcccgggctggagtgccgtgccgtggagccatctgggctcgctgcaagctccgcctcccagcttcatgtcattctcctgcctcggcctcctgagtagctgggactgcaggcgcctgccaccatgccctgctaatttttatgtacttttagtagagacagggtttcaccgtgttagccaggatggtctcgatcgtgatctgcccgcctctgcctcccaaagtgctgggattgcaggcatgagccaccgtgcccggccgagaaagactcttttgaggtagacaaattagtgtatgcacggagattttaaggaaaaaaaatcccaaataaacggataatttatattcctgagatgaagtagtcagtaataaaacaaaaaccaaaaagagtgaattaagaaattggaagaatagagtaagaatctgaaagctctttttcttcctccagcttctcatttcttctctgctgtcattccttttgtttcctcagcttctcttcacccttctttgctcaatctgggatctcagaggagggaggtaatggtctcttggatgaattggaaacctgggatgaattccctttagaaggagcaaattgtttagctttattagaatatcctgatattggatgccctagttctgatcccatctctgtgattccctctaaactgaatatgcaaaacacaactaaacatctataaattactcagaagaaagatcaaagagtcagtgagaatttgggtaagagattgtatcctagaataaaggttttgggttgctgaatggttgattgccttaagaacttagaagaaatggagggagtcaaattactatggcataacagggactgaaactacagtgccatacaaaccaacttatttttcatttcatgatgaaaatcagccctatccctttgcaactgcagtgacacaaatgccagaatccatattgccttcccccaagttgatatacttctcttaagagatttttttctattgctctgggaagattcacacaaatttgcagaagtgctctgcagcattttttcaacatataactacacacgtgaggatataaactggctgctgtgtgatgtgttgcctctggctgacttgctcaactagtggaacaggtgtgatagaggccaaattataaccccctcatcagggagtgccatggcctcaggaaaccagccgtccacctctttccataactcagtgtgagggatggctgatggcagtccttggagcctctctgcatatggtgacctctagcagtgctacaataacgcactcaagaggcaggtgtgtccctgttgcttttcatcagcagtgcactgaagcagtttataaatttttggggcccaatccaagggaagatcagaatatatccttggtcctctaccttttaagcaggctttttgccaggaatttccctgccagcaattgtcaggagaaaaaatagtttgatggcaagggcggacagttggtgccagcaatccattttgggaaaatgtggggaagaacttaagactgcagtgttagctgcccagttagaattattcacagatgggacagactttattgtgagccaacaacaaataaaaaggaatgctctaatggaaagttgatatatcactgttgtaagaaaccaggatattcagaaaggggatgctgaagaaattaagacgcaaaggattcaacctgagtctgaagctttattagcttctctaggagatttttctcctgagaaactggatgagaaataattggcaaacggtgcaaactagtgtgcaaaattgacataatgaggaaacctttgagttgggaagcagacagctttatatgtctgtttcttttcctcatcttaatcttttcatgtttttttttctttttttttttttttgtgaaccctggagccatgtattctgtaatttcttctgaccttttttttgttttaatgttttggatatctccggacaaccttctgtctgttcttgctgctctgaaattattctgcaaatagatcttttgtaaaagaaacatgcttttatctagtctcctgatgcacctagctatttgttggaaagggactcgctgtgtaaactaatgcctcccacccattctgtattctgggtgaaatgattttggagccctgggaggcaaggcacctgatgataaggtaaagatgtgccttctgaaaccaatgggggcagtggtgagtggcaatctcaccttgcactggaatagatcaattgacaagaagtagatccatttttttggatcccaggaacaaatattttagtaaaatgtatcaatgctataattatagcttacaacatggaatagctcaattataagatataatctatacattttttaattaggaaaatgagctgtaataaagggcattcagtttgtaatgcttctacattacctgtgaaaaaggaaggaaaatatgacagggaaggtggacctgtttatagatttgtacaagatcttatagaaataagtatgtttgtgattcttctggtacctgtgcttgtgctagctgacctggctactattttaattacaatacctatgccaactaagtatttttctgcagtagacttttgttcaggtttttttctgtacctttacatgagaaatcaaggttcatccttacatttacctatggcagctttcaatatttgtggcaacggattcctcaggatttagagattcacctactatattctctagacatttactgttcaagagaacttaaagtcattttcctcaccttagagtttcatgctgattcaatatgcagatgaatcattgatagctgctgacaccttacatgtgataagaagaaaatgtaactttctacaaatttttagcttcctaagcatataaaacatccctagataaatagcaatagtgtcaaactgaactcaagcatttgggacatttgtgactggccaataaaaaatagtcccttcctagactcagcctattttacaaattaagcttgcttaattaaaaaaaatcaagtttgccagttttggggattggttgggaattgcagtcaggagatccctgcctgttcagaaaaggcgaagcctgtcactgagctgttgcatcaaacgtcaccagcacctttactggggtcatgttagcagtggaagatctgtacaggtctgcaacaacctcagttcttgctacctcagaagaaggaattcaaccgaggagcttaaggcggaggaagagactgaggcagagactcggagcaggagtgaatgtttattaaaaagtttcagagcaggaaccaaagaaagtgaagtacatttggaagaggggcaagccggcagcctgagagattcaagtgcacggtttgacctttaacttggggttttatacattggcattccatatgcacagtggcctgtcagcacttgggaggggtcataggcataatgtgttcactggagttgtatgcatgttcctagaagaaggtcatgtaccagttaaactccaccattttgcctcttagtgcgcatgcttgaggccactcacccagctcctgagatcatattgggaagcttctgatcaccagttacaggtgtttctatctattgcgagactgcctttccctggcactggctacaaccaattattttagagagacagtgtaacaactgcctgaccatcacctgatggttgcctgacattcctggggtcggggggtcctctcctgttctgctcatgtctgactaactactatcacagtcagaagaagctgaaaagcctttcaaaccctttaaggacctattgtctccccacgtgtattcataactctggtaaactattctactttttccatctggagaataaaggagttgctagtggtgtgcttactcagaacctaggccctgactatagacctattggttactttcctgtcttgttggattctgttgttctggatatgccaggctttctacaagccacagtagctcttctgattgtgtcactgcccgatgggttcttcctgctcgctgcaaaaaaacaaaacaaaacaaaaaacatggtatttgctgtaaagagtttaaattaactcaaggttggcaacaccacattagagatgaagttattgttcaagtcagtctcatcgaaggctcataggttagggatttttcaaaggtagtttagggaaagggcggggagtggctaggcaatgggtgcttgccgctgattggttgggggtgtaatcataggggtgtgggaaatgattcttctgcatgctgagttacttatgggtggagctacgggagctgttggcaggtccagtggagccatcggtagtcaaacatgcaaaaaacctggatatctcaaaaggctaatcttagattctacaatactgatgttatctgctggaattcatgaggaagttgcatatctcgtgacctctggacaaatggctaacaatcatttatgtctgtattttagcagaatttaggctcctctattctcctagcctggtggtctctcattagctttagttttggggaagggctattatcatttaaactataaactagatgtctctcacggttggcttgcctaagcccaggaatgattaagggcaacttgaaggtcaagggcaagaagggggttaactagatcaggtctccccattgccataattttgtcactgttagaatttgtgcaaaggcagtttcaatttcactgttagaatttgtgcaaaggcggtttcagagctcagctttgaccctaggacattgaacttccatgtgcctcatgttgttgctgctgttttacaaattcatagacagaaaatttctagcacactgccggataagccacgagcaagtcttattatctcatactaatattattctaggcaggtggcaccttttgagtctggttactctgtttgtagatcctaaccaaataggaggatgtgactgcctcatagtcacagaaaatactcaacctaggcctgattcattcagtattcttattctcaatgctggcaatattgttcattgatggatctgtgtgagagacacacaggaatatacaattgcatcttattttataggtagagatggctttttcttagaacatattatacatgattacaagtgtaaaaatatggtgaaataattttatttgcttttcaaatgatttttgttgctaaaaactaaaattaaaaatagagaacaagtatcctaaatgtttttgaaactattatcatagcaattctcagactatcaagactatgaactattttccatgatagcacactaatcataacaatcataaccatttgtatgtgcatatctaatatctaatattcagggataaggtcatacagattacccagtttaatgctcacagattcttatgtgaaaaaatatatatttggtcatagttaaaatggacaaaataagtgaatctgtctgatggtcagatagtaaatatgtcaaacaaacaaatgattacaattttcagttagaataacaaaagcacttagatcactgatttaataatagtgattccctaggtaattttttcatctgtgcaggttgattatcagggatgaaaaagtgtgaaaacattccaattaagtaaattgctctgcagttggtgggaagtactaagtaattacttgtggtgagtccagagatgaagatggagtgggcatctctgagtcatccaggcaaaggaagacaggtgctgctcctcacagcagaacaaggagctgggtttagagagactggatagaatatagcattaggaaggttatctctaacaatcaagtcaatgcaccagcatttgcctgggaccaactgtgtgttaaacactggtaaatactgggagggttaaaggtgcagatcttggggaacctagcataaaattcaacacagcagacatttattctccttgaagaattcctgattttgcaacaatgcctatcatgtcccagaacgaggctggttgttgaaagtctctgagaaaccagagatggcaccagcataataccctgaacttttataaagcacaaagatttataattataataaggaaatctgagagcaagaagacatgctgatcgatctcacacaggaaatttgtcccagatccaagtcaaatgacaagttagatgaattgcctgctttctaaaaaggtattttaacatttaactaatgtgatcatttaaagtcaatagcaatatctcagaaagaacacctgttaagttgtgatatatttagttatatgcactatacacagagagctaagtggctagttctgctctcttcattatctgaattattttaaaaattacatttaagttaatcttgattcgtattttggattgctttatgtttctgaatgatcatttcctcaaagttatcagtagtgagcaaacacaaggaaacatttatttgtcttttttaaacatgcactacactttgtttttctctttttgacttattcaaatatggtaaattaattaatttttatttaaaaaaatgataggatgctcaagtatcaaacatacaaatgtatttgcagtgtttcatttttcaatgattatgtatatttaattaattaaagatatgcataagtgcatatacacatacatttttttcaataaggtactcttgctgtcattgattattcatttattttctaacatttctttctttcttgacccaaatataaactaactatttcaggccatgctcttttagtgctagagaaaactttagattccatagtacttttttttttttttttttgagatagagtctcactctgtcaccaaggctggagtgcagtggtgcaatcttggctcactgcaacctccacctcccaggttcatgtgattctcctgcctcagcctcctgagtagctgggactacaggggcacgccaccatgctagggtaattttttttttttttttttttgaagtagagatgaggtttcaccatattggtcaggctggtctcaaattcctgacctcaggtgatccacctgcctcagcctcccaaagtgctgagattacaggcgtaagccaccgtgcctggccccgtagtactttgtagcgtgctttccagctaaactgaagcctcaggtgacataccatggctctcacagctaattaatgaaaaagctggaaccatcacccacatttcttaattcctacttcagttcatttaataatgctagaataaggcaaagtcacacttttctcattttgtgttgataaacattgtattctaatggttagtaaaatattaataatgcattcatgagcactttaaaataattaagtacagctgttcacataggcagttatcgatactaatttaaataagaaacagttttgcatgttacatcattatctgtaatcttctgaaaataacagggacaaaagcagtatcatccttgcctaatgtcatctgctagtgaggggatgcagacctaagtgactaagttgattccggctgagaatcaaaggaaaaggtccatagattcatccttgctttcaaagagtggcatagtgagaatgagtaagaggaaatatcacttagtattaacagatgataataagtagtgtttcctactaattgattatttaccatatgctagtcctatgctaagagtttagagatacgtgagagtcttgtgagtccggatcatcattctccccagtgttcagaggggaaggctccgcatggttgagtatcttgcccatagtcacagaaccagtatatgttgggacttggcctcagacccaggtctctccagcttcgcagcctgtgttcatcatatgatgtatcacttacaggaaactccaaaactgagctgaagtctttgacagtcgcaggagtcagcatcctgctggagccgtggcctcacagtcctgtctgtgtccttgggagggctctgtggcagccccaggtcccacttgccaggagtcccttcttcacccatgggcatcctgagaacagaggaggctgagggggcagcagcagagggttaacagctcttcagcaggcactgggtccacatgctggagcccttttttgttgatttattgtgtttagacatcagatgtgaaggtttccatgagtcaccttcctcagtgaggaatcatgaaggaatgatcggtctggcctgcataaggccctactcttgccttggtgttcattcattcattaatcatatttttttatacatgattcatatttccccagtccaatacattttatttgtacatattcttttaaaaatcataattcttttgttcacacatatttacacttacatataatattgttttatatctttcattttgctttttactgattaactctgcataaatataattgtactagtcatactaaggtgataaagataatatgctaatttttaataatctatagaaacattttaattacttcataaaatcatcaaggtatatgtcatggtaattatattattaatgctatatacttagaaataatacagtttcttcatataacacttataattaacaaagtgtcttaatcaaataatcttgttaacaggcattacagggagcagcttaacaatatctttcatttgtatagttccttagaattttcaagtcacctacagaaacatcttccaacaagctataattgggcagagcagttagtattatccccatgttactcataaagaagctgagattacaagcactaaaatttgtatccaatatcagcatagtctggcaattaaggaaacagaattagaactcagggactcacgggcactttcttaccccacacacagacagcttaaaataataacagcatattaaaataagaatctctcgtagtacatttgagtgtttgggaaactaataataagctgaagctgctgaagaatctatttcttttagacaggtttttctaacatctttgtgaggactaactgaattgatgtgtgaaattgcataggacagtggtggccctatgcatagtagagatttaatgcttattttaaaattcagagactcatttcagtatctcgtaatttaaaataaagatttgatgataaaaacccactaaaacagaaacgacaaaatgacaaatttggaaaaataacaaatttctaacagtcttcttaaaaatagttgttgatgagtcttaccttgacagatttttttctgcttatggctgtcaatctgggtatttcatactcaaccacaactatccatgtgcttaacattttgcagaccaggatatcacatgagcaccatcactgactgtgactgttagatttaactaatgtgactgctaaaaatcaaagtacagtgttggaaatttttcagtaatgtcattaattcctaagttatttatgaaacatatttccagcatgtgagtggactccaagccacagatttcagtcactttcatgtatacctaaggaacatgttatgaaaactgatcattttatctgaaaatactcatttttgattacttaatataatacttagctagaatgccctcaaagacagagaatccacatcaaacttaagtgactgtctttcaataagatggagcttttatacatgaacacaccacacacacacacaaattgcagaggaatgctgtaaaaaataaatgatttataatcttaaaaatacattatatatattaactagtttaattcttaccaagattgccagatagatataatttttctactttacaaagaaagatgatgatttctcccaaggtcacatgcctgctaagacagaaaagaatttgaaggactatggcttccaaaaactattctgtatactctcactctccacagagctgtaacttttgctgtttatgtctaaaatgaagacgtaatcctctgcagaattgttgaaggctgcatatttctataaaagctggcttatccttctagaaggttcatttttccaccttaataaaacaaagcaggaataggtatttgtgttcgccattcttttgtccgtagtggtcatgtgcttacgtatgaactcatgtctgctctgcaagctctcgaagcaaactttgaatataatgaataagagactacactgcatatttttaagacacacattattttactgttatagataaggttatttcaataataagccctgaatgttatgacagtgaaatgctagtataaatctttcctgcccaaaatgtattctctttaatttctatatctttaaagaacaatggttcatttggttggtatcccatgaagctggttataattctatataagacaataatgtgatttctgaaatttcaaatgaattaatgtgattatatatataaacttttaaatatattttagtcatatgtaataaatgtttgattttttattgatatctctgaagttgcaaagagtatgtttctcatctgccttattcacaaactattaggtaatgtctatttaaagtttcttaaatgttaatctatttaattacgcaaaaattgacattaaattttattttgctacatgatcctattatcacatcactcagaagtatattttccagagtttacactttgaaacaaattgagaaagaagtaacatttggcagataaaggtgaaaaaattctgttttggtagggttcctttgaaaggtttttattgtattgtttttactgaggtttacaaagtttattcagctacagaaaaatatgattttaattctgcaactgaattttaacattggagtcaaaatgctcataggatctgatgttcctgtattagcttggctgtatgtcttagatattaaacccaaattagaaccaaaataaaaggatggatcaaccatctctaccaaccatgccaacaatgaccaacctgggtcacagtcacagcagccacctccacgcaggtggtgggctgattgatttccaggtgttatctcaattagtactctggcccttcaagatcagttttacagatgaagaaaccgcagcttgcagcagagtagcagggtttgaggtggtggagctgggatatggcttattttatataggtcagcctgggctgtccagacagaaggttgtgagtgcagaggttgtgcaaatatttacctgaagtttgtatagcgattgttaactcaaaaaatgttgatgtacatgaccctttagttggaacaagagtgaaatgattatctctggctgggcatggtggcttaatgactgtaatcctagcattttgggaggcccaggtgggcaaattacttgaggctgggggttcgaaaccagcctggctaacatggcaaaaccccgtctctactaaaaatacaaaaattagccaggtgtggtggcatgctcttggaatgccagctactgggcaggctgaggcaggagaattgcttaaatctgggaggcagaggttgcagtgagtctagatcgcaccactgcattccagcctggaagacaaagtgagaacctgtctcagaaaaaaaaaaaaaaaaaaaaggtgaaatgattctcttggaactggcatgaattagcaatagacgaactgttaccaagtctgacatcaacactagcatttaaaattgaccacattcactaaggcatttcctatatttttatttccatgtgtttatacccagggacacccattggtggttggatatgaggcaggctgatctttattctcttcgttttgttgttaagcctggtacattctttttttttttttttttttgtgacggagtctacctctgttgcccaggctggagtgcagtggcacgatctcggctcactgcaagctccacctcccgggttcacaccattcttctgcctcagcctcctgagtagctgggactacaggggcccaccaccatgcccggctaatttttttgtatttttagtagagacagggtttcaccgtgttagccaggatgatctcgatctcctgacctcgtgatctgtccgacttggcctcccaaagtactgggattacaggcgtgagccaacgcgctggccctaagcctggtacattctttagtacagcaaaataattaggcaggagacattcttcattcttggttgaactaactgctggcctgttccatacataaatattaactatgtgccccagtcatgttaggtgatagcacttctagtgcaaaagagcattaaccctttccttgttctcacacatgccatattcttaaaaatctgaaaacaatgaaaaaatatctaaaacaattttgtttgctttgcactctgatccttcccaatgttcagatagcaagatggagtgaagagtgaaagcccctttgtcctggagcagatagtggcagtgtgctcctcttgacacccccaggaagcaggccacaggtgcatggagctgtgttcactgtgaagtggattcagcctgataacatggaatcaatgatgccattgaaataaaagccagatgtaatcctgcccacactctatgatagctgtcctacatccagagtgtcctttcttcttcctagactgtagtttttcatttataaattaagggtgtggggctggaatcatgtctaggtcccttccaactctctaattgcagattccaggattctcactgcagatcctttgcatgttaccgtggtgctcgattgccctgccatgtgatgtggctttttgtgagcatctttaccacttgattagggaggaatctgtgggatagcattttagaaaagtgaacttcatagaggttgccatgtttatagtcattttaatgatgtggatgaaatttaaactaccttgtaaataaaaaaacgtagacaatggtgacgaattcagggactggagaggttgtcacatccttgttaaccattagcagtgtttcctttaaaacagcagctttttgcatattagcaaagcgagcatacattgctcattgccatgagaggtgacgacatgaagatggtgcatcctgcagatacattgatccctttctctgttttctcctagggttttccaggaaacacaaacgcagacagtgtggtgcactacagactccagcctccctttgaagccaggttcctgcgctttctccctttagcctggaaccccaggggcaggattgggatgcggatcgaagtgtacggatgtgcatatagtaagtggcctttattccctgtgtgaaatcaaggtcagcatgagattctgtcaaagccaaactgtaaaagccaatgtcggcatgaaatgttgaacttgactttttctgtctttttatatagctgggcaagcagaactggtttttattgaaacactctagtgtctccccatgacaatatgaactttagttactgtcttttatagttgaatttagtggtggacctgaactgaaacttacctgtctttagattcccagagtttagcaaagtacttgcaatatggtaggcatctgatgaaacgaatacaattcaaactaacaacagatgatgctgtttttctgaagctgagatgacacgctgtctgggaaaacaggagctgtactgggggcagggtgtgatttctcgcaatctcttggttctctgtgtttttctctgctaacgtcctcttttgcacaccatgctgtcgcttcacttgatcttcacttggtgggaacctgtgtttagttagcctcttttctcacctattctttgttataaaagtggaaaggatggggccgacatgaatataacacaaacaaaaagccggccgtgagattatttggtggtactcagtgacacagttgccacttgatgatctagaacatacttgtattctttctttacattatcataaaaatgttttaaattattgtcaaaatggaataaaattgaaaaatactcctgtataaaactggagaacaagtcaaagagcagtctggatggaaatgtcttaagtggcttcaatttgggtccggccggatgttcatatcacactatttacacacagtcactcccattctctgcctactcacagctttagccctgcagaatattaattttctaaagcatgataacaacgtctgtcattcatgcagcatttaatgtctcagatactattatttccattttattacataacccctgtacaacccagttcatttcctaactctgcttgttttttagtgtttacatttctacagggctaaatataatgatgttgctttaccaacggtcttttttcttcctgttattgttcatctccttccatccctgtgttttctgggacctataactgtgctctctgtttcaatggctaagatgtctgatatttagaatttctctttgatgctgtgaagttaccttctcctctcattactctgaaacaacttcaggtttactgactccaaagtggaacatgctctttgatggcgatttgccattagcttgatgttccttcatgaagagatattactccagttccttgggctggaggttggtaccaggaagatcaaagccctgtgcctgattccaggaagggccggtgggcggtgcagctgccatgcaatctgctggcaccgttaacttctgtaaacacatgctgttggctgtaagggactactagtaaaaaaacccaaacatgcagacagataatatgtgaccactgctaactagctaaaagtaattctttagaacaagtggacatctacattgtctttttttccttagaagaataattgttcaagtatggtgattttatttttgttgttgacagtaatacaaccctttatgacttatgttaataatggtagtttcagtattttcctttgtatttccactgccctgcttgttttctagaacgttgcttataatgacttataatatcccttccacgcagcatctcttcccatttatttgtttatgtatttatcaatttatctttttttattttaagaggcaagttctcattatgttgcccaggctggagtgcagtggctacaggcacaatcccactgctgatcagcacgggagtcttgacctgcttcatttgggagcagggctagttcactcttccttaagcaacctgatggtcctccgctcggagagatcaccatttgatgctaaaatttgttcagacacctgatcatcatagtgcacccctgggctccatcgatcctctacctcagcctcctgagtagctgggactgcccagccctagtgttattagcttttctacacttcatttacagtaatagattcattattcctttaaactgtgtgtgttttcacagactcctggcttactctatgcatttatttctatttccacttctagcctggggataggttgtaggttctcccagagttgctgctcaactgcagaataaagccatgagcacagatggcctcgggcccttcttgacagctgtattctcctggttttccatgcacctttgcatgctactcttcttgccactccttaaaggctaacattatccacagattggttgtaggtcttttatcctgctcccaagctctctctgagtcttttatccacttccatgagttttcagtagcatttacacactgtggctgataacttccaaatagacgtatccgcaacctactctgaggagttccaacctctggtaccaacctctcttcactggccctgtgagcacttaaaactcagttgtctatctgctcattttcctttgttttccatcttataaaatgataccaacagccacctattgactgaaacctgattctatctcctaaatgttttgaatttctttctcttcctccagtttagcctaaatgagcaccagcctcctaaatcagctatttgtctctggtcttgatctttccagtttttagtccacacaataatcaggatgattcctggaaaaacatgcacattcgattgttcaaactcgattgttgaaacatgcttaaagccacacccaagacactaggattgtttcccagaggccttagacagaaaaataaattccctatgctctactgcctgtccaggcctttgagggcatctctcaagaacaaaggggaactcccagaatcttaggccagaaccctataagtccttgacgcatctatctctcttgccctccatgtccagtgagtcacgaaattctgtattcttccctccaaattacaccttgcatgatttcagctctctttagctctactaccgacttaatctaaacttggtgtcccacagattatggaaattgccttccaagtttgggtcattctgtctctgttcatagctgactacattatattctccacactgcaactcaagttaccttttaaaaatgcagaactgatacaattacgtccctgtttaataccatcagtggctttccattgttcctaaaacaacatccagactcccagcaaggcctgaaggagcttgtccctgaataactctccagtgccacctcttgctgccgtcacctgctacctgtccactgtcaattgtatccagctttttactgactcaaagcctttacgcctgtggtctcccctgcttgaaatgctccttccctatgttcttgactggctatttactcttcctcttttggatcttagtttaaatgatgcttcctaggccctcactctacatttggttcctcattataagttcccaggaagcctatagtatgacttcatgtgctatagtcactttttataatgtatctgtatctgtcttattagaggcctaatttcctttttcctcattagccttcaggctacactagggtaaggtacattcattgctgtaacatcagcacctaatacagagccaggaacatactaagtgcaccatagctttgcattgagtgaatgaatgaatgaagcaattcagaaaaaaagtctgacagatgataataaaatctgaataatgaatctaaatttcagatatttatttctctcttatactagccatccaggtaaggcaggtatcttggagattatattgttataaagtgtagtattaaaaattgtaataactctagtaaaaatagcgaatataaggttttacagttatgtttccattcttccatctgatatttgatgcatctttatgtagtagaaaggcagttattaacacccagatgttccaagtgagcaatctgagaagccacaccaagggccggcagtgcaggagctacaaatagtcaccagagacagggagaggactccagtcctctgactaccaattccatgttcttgatggataataactgccgaggtttcataaaggatcattatattgatacttgttttgatatattgctatattgattgatggcggcagcttcttttctactttcagagagacagcatcaagctgcattgtattgtatataaacatttagtttttgattctgtgccttcctcctttttatcatgccagctttaattatcctcaatttcagagttctttaaatcactccactttctttgatattaatgcaaaaaatagaacagtcctcttcttgttgttttctcaagtggttagtatcctttccatctctttaattcccagtccgctagtgcagattttaagggcttacattccactccatgctagtgtttcagtattttcattagataacactcaaacatggcttttgtctgattcatgtttctgttaaactgagattgggcttctattcctttgtaagtcacggcaataattcatgaagaaaaaagaaaatggttagtattcaaggttgacttcataaataaccaagaagagcttggttcaccacttttttggtcccttagtggcggaaaatttggtgggggagggggtctgggagtggtggattcctttttaaaattttaatacttggagcacagccgagataattaacagaattctaaaatgttcttttcacgaagatttcttttataatgtcccaagtgaaaatcattttttattactcacaggtaattctttattcatgcattttctgttacattttcttataacttagtcttcaaatagttttatatgtcattcagactgtcttacatagctatgctattaccaatcagtccttttcttattcatcattctagcttcacttataattggttgaaccatatatttgccagttttgtagatcaaatacagttgaatattagcagcttcatctggattaactgagtgctgtactgttttctgtaggaacaacagatggcaagtggaggtttccggtaaaacaaaacaaatagaacaaatagtgactggacaaaagcaaattttattttctcccttccaaaattttacctgtccttgattagaatttgagacatgggaaattttcataactcctgagatggtccaagtttgtatttcttcattggtgttctaatgaagttagaactacctacctctgtaaagttcctttaattgttttatcacttttatatatacacgctgtgctagtttgcatcactggcaccaattctgcacctgttccttgccagtacgtgtgagtggcgtatgcttccctgccccctgatttttgagccagccagtgacttcctttggctagtggtaggcagagtcaactctacagtgtacctactgtcctcctttgtgtctaccattaataagcatgcctgaactatgaattccagtaaaatgaaaagagatacatgctttacatattttgaagctgtttcattaaatgcatatagattgggaattgttttatctcccttaaagttgattttttgtaattatgaaatatccttgtttatttctaataatgcctcctgcatgtaagtctgcattctctgatgatagtactgtatagctatgccggatttcttctgattagtgttttcatggaataactttttccattctttactttcaaactttttgtcttcatatgtaaggactctttctttattatttaaaccgaatctggaaatcattgagttttagttgttatatttagtccacttatattaaatgtaattactgacatatgtgaaattgtagctgacatgttactctctgttttatatttggttcacttgttttatactcctttttctctcctcttcttttgggttaatcaagtttaatttttccagtttttccactattgtttgctgttctaattttgttcccccaggtacttgagctactacttttatcactttccaaacaatcctaggatgtaagtacaacttatgttagtttagttaaactcttcccaccatgtgtgctatgttgacacattttagtttcatacatacatgtgtatatgtgtacatatatttttaatcacaaaatttaatataattttgtttgcaatcagtattcacttgaatctactcacatatttactttctctgcattttcatgctctttctgaatcaaattctttcagctagaaagactccttttaatatttgtcttagcccagttctactggtaataaattgtcatatagcttttgtttgcttgaaaattgtctttattttatgtgaacttctgaaggctgtttcagcttgctggagaatacggtctgtagttattttctttcggccttttaaagatggcattctattgttttcatgatatttattaagaaatcaataggtaattgatttttatcctataagggaaatgtgtatttttcttctggttacttttgagaatttattctttgtctttgattttcagcagttttgccttgatgtggctattttagttttcactgaatttgtcctctttggatttcactaaatttcttttttctgtgcattgattattagattgggtaattcttcactgttacttcttcaaaatattgcctctgtctcgcatttcctttcctcctttctgagactccaattacatctgtctgagatgtttgtatcttattttctttctttgtctctctctttctccctcctcctgcttctctctctccctctcctctttcatcttttctttctatttatgctgcagtctagacattgtgtactgctttatcttctatactactaatcagatcttctgctgtgaccaatctgttgttgaatatgccagtgagctattaattttagttattgcgattttcagtttgggaatttctgttcatgtatcctagtgaaactccttatcttgctctctattttcctggaaatattaattacagttattttaaagatttttcgttaacttcaatatctggattatctcttgatcttttccattgtctggtttttgtttccgttttgatgtctgataattttggctgaattctggacatgttggacagaaatttgtagaggctagagaagacaaagtgatcccccagtgaatccccaccacagcctctgataggcttctaggttaggcacagttgttaattcaaatcagcatttaactgactcagtgcagcgtctcagtccccatgagacctagttgatatcttatatctggagtacagtgcttcactagtcccaactgagatttgaaggcctttgccaaaacatttttttgaaaatctctgaattctgccatctgactcctaattgtgatgagtctacagagacccctgcttcgtgacccagcctcatagctgtcctgtcactttctgcttggccaccttgtctcttgcccattgctccttgggagttgaccagtgcttcaagggtaaaagcagaaagagtgttctgagcttgtcttctaagatctttacattcttgagtcctggcagtcatagtagatctttaaaactttcaagaagattatttaaactttacttggtacacattttctacttgtccttggtaggaagtgtagtcttctgaatgtttgcttgtcataactgaaaatataactaactgcatttcttttaatgccatgggaaatgtattgaagaaaacaaagtgtatataattttttcatataataatgtgtttataatacaatctacttaatattttggaaaattatttttctgtaaaacactgaagtgctaattaaatttcaataaatattttttaaaaataaataaagccggtcacagtggctcatgcctgtaatcccaggactttaggaggccaaggcaggcagattacttgattgcccagtctgggcaacacagcaaaactccatctctacaaaaaatacaaaaattatctggacatggtgatgtgtgcctgtagtcccagctactcagtaggctgaggtgtgagggtcgcttgatcccagtgaggtcaaggctgcagtgagccaagatcatgccactgtactccagcctgcgtggcagagtgagaccttgtctcaaaaaaaataaaaatttgtaataaaaaagtaaaataaatagaaactcaaaataagatgaaaaagtaaatccatgtccatcagaaataagtaagttgaagaattggaatgtgaacctactcacagaggattccagactctgtgcaatcaactatctttaccaggaaatgggagaaggagaaaagagagaggaaagaaaagaaatagagaggaaagatcatgcatgaaaattaaagatagagatcaaggcctttactgagaatgcagaaccaaggcctgttttccctaagttcctcttattatgcccagaaggaaagaaaatatgtgagtgaataaaggcaaatatttcctaggaaagctttgtgtattcatcgattgcaggattcaatattcttatcatcctccccgaattgatctacagaatcccaatacatctattctaacttattattatattaaaatgaatcgtcactagtctttagagaaataaaatcacaatgagaaaccactatacacctagcagaaaggctaaaattaaaaagggtggaaacaccaagtgtttggcaaagatatggaattctcatacattgctggtgggaaatgtgaaaatgatactatcactttggaaaacaatttggcattcttctaagctaaatatacacttaatatatagctcagcaattccactcccatgtatttacccagcagaaatgaatgcatatgtcaacataaagatgtatgtgtgaatgttcctagcagctttatttataagagtttaaacctggaaacagttcaaatgtctatcagcaggtaaatggataaacaagttgtcaaacagttgaataccccaagcaataagaaagaacagactgttgatatatgcaacagcatgtgtgtatctcaaaaatgttacacttagcaaggaactcagacacaaaagaacacatacacgatacaattttatgaaattttggaactgacaaaactaatctgtagttacggaatgtagatcattggtttcctgggtctgggtctgggtctcggtgacagtgttgggagtttgatgcaaatggcaattagtgagttgatatgaaattgcctacaccttgattctttggcaataacgtaggtatatatatttgttaaaactcattgaactataaccttaaatttattgaatataaattataactctatgaaaatgatattcatgtttccatattggcaattgtgggttttgttgttgtttttttgagagggagtctctctctgttgcccaggctggagtgcagtggagcaatcctggctcactgcaacctctgcctcctgggttcaagctattctcccacctcagcctcctgagtagctgagatcacaggcatgcaccactacacccagctgatttttttgtatttttagtagaaattttaccatgttgcccaggctggtcttgaactcctgacctcaaatgatccacctgcctttgcctcctaaagtgctaggattacagtgtgagccactgtgcctcaccccatattggaattaatattcaatttatttagagagtaaacctctgtaatttgcccattatccctgataaatcatcctgaagcctttgtgtcatcacagctacctagttagcttattaaatatgcaaacccctgggtctcaaccacagaaatcctgattcctggtctggttgaggctcacgttctaaagtctccaagtggtcactcctagtcaatctgagtgaaggtgattgatagaacactttaagaaaatttctgtggaatcgtgtttttttttttttcttttgtaagacatcagtgtttgcaccctatggaatcttgctgttttcaagcaatgttttcctctcaatgttgatgtttcccctgaaaaggcagtacaaggtaggatggggatgagacatgcctgtgcttagaatgacagtgagaagtagaaaagtagtaatgagaagccagatttaagagtacattctgggtgtgaaaaatgtgaaagtaggccaggcggggtggcttatgcctgtaatcccagcactttgtgaagctgaggtgggcagattgcttgagcccaggaattcaagaccagccttggcatcatagtgagacccccatctctagaaaaaaagtaaaaaattaaccaggcattgtagtgcatgcctataatcccagctacttgggaggctgaggctggaggatcacttgagcccaggagttcaaggctgcagtgagctatgaaggtaccactgcactacagcatgggcaacggagtgagtctctgtttctaataaaagtaaaatgtgaagataaaatatggcgtaaggaaataaaggaaatagcaactcaaaattacttatgtcttagcttttcagaagcgtcatactttgcaggagtctaaagaaggtagactccttccttatcctttcttagaagtcattctggaccagatgcctgtttacagaagcatcactgtgaatgtggcagaaacaatcatatttcaggattatatgtcctcttttccatactgtgggatccttaaaagtaattcattgtcttctgcatttttatctttcacctgcatatggaaggctttcagtgaatattagctgtatgaatgaggacataacacattttagcaaaattacttctgacacagttcttccttgtatgacaaagttctttatctgcaagaattcgtatttgggaactttgtgaacatatctgtccttagtttttccggtattctttgaggaagtgtgacaaaaacattataattgcaccaataatcttcaagtatcatttaaaaactctcgtggtcctctaacacaagaaaatgagatagatatattaatacttctgagtaagatttaggttaccagtgattgaagtgagtcagcccaggaacaagctggctggcagagaaggagctgtgtaagtgtggatgaatggttgtaaatctctttttcctggtggaaactgaagatttcctaggtccttcaaaaattaaatctgctatcattttaagctgtctactttcctatatatcccctatgtgctattttaaactcatttccacctctttttctgcccagtgccctgacaataataatgaagcagtcgttcactgaaggtaccccatgtgcccagcactgttgtaaaagtacaaatactaactcatttaaccctcacaacgatcttgtgagagaggagtgtatgtgttctcacttcacttatgagtagactgaggcagagagaggctatgtaacttttccaggatggagtcaggattcaagcccacacagtatatactctagtgtactagaaaatgtggctcctgatctaatggtgacagactaacgtgtcaggggtccacattgctaatactgatcgagattcagcaatcaaaactataatcttaattaataaagctaataattataaactaaattcatataaaattagaaaagcacttcctgctttaaaccacaagctaagttttctttattcattttggatagcaaggcttttattctgaaaactttgaggaacgttggattttatcgtaaacataataagtgacattaattttccagtatcccactacatttcctatttatataattgaatttcatacaaaggattttttccaacagatttctgagaaaagattatattaaatgtgttactggaattattttattttagtgtattattcaaatatatattgtaggggaatatttgcattgattatggctaggtagaactgtttttttcttgaaatggggtcttgctgtgttgcccaggctggggtgcagtgacacaagcactgctcactgcagcctccacctcccgagctcaagcgatcctcccacctcccccttccaagtagctgggaatataagcaagtgcgaccagtcttgccatgctgcccaggctggtctcgaactcttgggcccaagtgatctgcccgcgtcagcctcccaaagggctgggattacaagcatgagccactgcacctgaccagctgggagaacttttctttgctcttgcaagtgttttaaaatgctaaaagtatgacttttgtggacaagtgagaagagagtttaccttttagcattacttctaaagaccaagacttgaaattttgcttctccagtgggaggatcttattcaagagggactacatgggagttgtccctctccagtgctgatcttggtgggctcattactgttgacttattgaactcaatgctttccatcccaaacatcattttttgtttcatatttttatgtattgacttcataaatcatagaatgttttatgatttttagaaagtttggatttacaattcattaatctgcttttattttaaaatatgcataatgagctataagtatattcttaaatttctagatacaagcactagcgattacaataaagaaaaaatcaaggtattagctaaagaacaaaagagtttcaaggtcattgctttatgtctcttttacttgataagttttttactattctatttgcctgagggaaacattccaggaactgtacttcacatgccttagaagaccaatactgctgttggagagtaatagtaaacatagaatgagaaaaagaaatgtataggttgcaataatccagaaaaaaccttttcgggaagaaaactttgttagtcaactaaaaaaaaatagctcaaatattagcattttctttaagcaacaaataaagacatgattataagtataagggaagtgctaaaaatgtgaaagtctgtagtcaatctttttcaagtttcccttagttcatggccagggaataataatcttagatgtcttcatttacatttgacagagagttttgtttttatcatgaacacataataagttatgtaacaaggaataattgtttaatttacacatattttactcagaatgtgcttattcatcatgcacttgatacattaattccttgtaagtacattaacccaatgtgagaaaatcaaacttctaaattttaaaatgatacataaaatggagaacttttgaagtgcagtttactatatgtatttcagatactgtgaatgaaatggatagccatgcaaaaagtactagtaatatttttgtgaaattaaatataattaaacaatgccatcttattggcttgaatgacatcagctcatcagcttcaaatagtttcatatttcactaggttttcatgcatcttcatttattaaataaatatatttttcaaaggacaattgcttatttttctttttacttttaaaaagaagagattttctgggtaatattaatttcttcatgtgattttgacaaatattatcaaatattattttatattactgataaaatgaaacaacttgttttttgatgagctgaacatatgtgacatttatagtgaatttataagaccctgacagagtgctgagagagtgtggcagcattggagttctgacaagctacagcaggaagaaccaaaacagaggtgttaaggccatgctctctcaacaaagcatccaagaaaacaaaacctctgtgcctttgtcagtcagggctctccagagaaacagaaccaataggatgtctgtgtgcctgtgtgtgtgtgtgtgtgtgtatgtgtgtgtgtgtgtagagagagagagagagttttaaggaattggcttacctgattgtaaggactggcaagtcctaggtaagaggtgatattgcagctggagtccagaggttgtctggaggcaaaattccttctttcctagagaacttcagttttctttctttctcttacagccttcaactgattggatgaggcccacccacgttatagagtttaacctgctttactcaatgtttactgatttaatattggttacctctaaaaaatacctgcactgcaacatcaagactagtgtttgaccaaaagctgtttaccatggcctagccaagttgacacattgcagtgcccattagcagtaccattagctgagggttgagaaaaatattacatgtcagctcatttaaaatacatttattacatgtctaaagcagtaattaataagtatgatatgtgtttctgtatctttacagacaaaatctttagtaaagtaggtacatgtgtaagaattaagagaagccaaagctactgggaatgaacaaaggtatttaaattgagtgacactgatatttaatataagagtgaccttaaaataaataatttatgtagtgaaatatgacttctttcctgagtgtttttaatcaaacagaatgagaagaaatgggctgctctaaagataagagccattgggagtagattaataaaagcatttctagatgatgaagtttgagaaaatgttagaaaaatctaacagtgggtattacatatatcaactcctgatgccaccagaaaatatattattgtcagttgtttccttcagtgaatggcttagaaatacaatgtgtgtctatgtgtgtgtggtgtggcatatggatgcacacattttcaatgtgctactgtatggcatatttatatttagaattgctttttaatatcttctttcctagaatctgaggtggtttattttgatggacaaagtgctctgctgtatacacttgataaaaaacctttaaaaccaataagagatgttatttctttgaaatttaaagccatgcagagcaatggaattctacttcacagagaaggacaacatggaaatcacattactctggaattaattaaaggaaagcttgtcttttttcttaattcaggtaaaaaaatacttgaactttataccagtagttaaaaaaaatctgtttacatttgttggtactcagtcttttcacagttagataaaatgaccatataattcatcatctaaaccagaacacctttaagaaataaaaaatacacaagtgatagttactctgggacagtaagtgcaaagtagaactgcaatgaacaaatgtaaatgaaagtttaagagcattactaccagatgcatgcaatacatatcctaagtatgatttctgtaaacagcatatattttgacaaactgtgcaagatcaccatatgtgtgtataatatatatgtaatatatgattatccatatcataaagacaatacatcattataaaattatgagataatgctgataatgaggttctaagaaagaaaatatttgcaatgtaaatccaaatgtcatgagtaatagaaaaaatactaagaaaaatttcaacaaagtgtagaattgaacttaaaaaaataaaaacagggtaaggttattgtgttcaagatagggagaaagtgagaaaacaactctgtaagatggaaagttggatgcaaactgtgatgctcaactaaaaaagggaagccgtgattttgaacagaaataactgtttttttccttctcctttaaggcaatgctaagctgccttctactattgctcctgtgaccctcaccctgggcagcctgctggatgaccagcactggcattccgtcctcatcgagctcctcgacacgcaggtcaacttcaccgtggacaaacacactcatcatttccaagcaaagggagattccagtaacttggatcttaattttgaggttattatagatatatagtttaaattaaatataacctgaaaaataaggtagctgcatagagaaatgccattttatagtaattcataactaagttgactaatagtaataggtatgtctgtcccggtactatgaaactgtttatgccttctaataggtcagtttattataatagatcatcttttccaccttgaaaagaagtaaacagtcagtgttaggtttaggaaatccacaaatgcagaaataccaaggtagcaagcattgttattaaatgtactcatttgaatatatttcatttgaaatttcatctggtatattacacttgttgtttgactatgcagattcctgggggattttttttcttgtcttggtgcaatcctaaccaacatagcattatttaggatcactttgagaagttaacaagataaacaccaatagatttattaaataacaagaaagtcagatgctcacatataaataatatcctgatattttttaagtcattaatgctttttgcaacccattgcccatatgtatctaagctacactgttaaatagcatctattcttccagtccttcacaggacaccttaaagtgtatgaaggatcagaacaaaccagaaaaactgtgatatttactggcataagtggctttggcatataatattaaactgaagatcctagtcctatactggattattcagttttattactttaatttaaccatgtaatagcaaaagataatatctaatgcagaggttggcaaactgggcatcaggccaagtttggacattttttaattaaaaaaatacaaagcctgtttttgttcaaaagagaaggttttattggaacatattctctttctttatgtgttgtccgtggccacattggtacttcgtgtcagagttgagtgctgcaaaagagatcatatgacccacaaagggtaaatttaactacatggctgaaaatttcaacgtggcagaaaatgtgtgttgacttcttccttttaagtttgttcaaaactgtgtggtgccagaaataaaggtattaacagctgccattatgatagaacacttcatttggaataagcaagcatgcaaatataagataatgggaatggatttgtgacaattagtactagacctattaatttataaatgctttaaacacgtaccatcagaaaatcactaaacaatgttatttatgtcatttttctttctaagatcagctttgggggaattctgtcacccggaagatcacgggcattcacacgtaaaagctttcatgggtgtttagaaaatctttattataatggagtggatgttaccgaattagccaagaaacacaaaccacagatcctcatgatggtaaggaagcctaatgggaaggaaagaaaaaaggacattttattttttgcatttaaaaattattcatgtgaagtctccatttcatctaatattttaagaatcagttcttactttaacagctgcccatgtaatatagtaatttagttttatttatttatttatttttttgagacagagtctctctcttgtctcccaggttggagtgcagcggcgcaatctcagcttactgcagcttacgcctcccaggttcaagcaattctcctgcctcagcctcctgagtagctgggattacaggcgcccgccaccatgcccagctaatttttgtacttttagtagagacggggtttcgccatgttggccaggctagtctcgaattcctgacctcaggtgatctgcctgcctcggccttccaaagtgctgggattacaggtgtgagccaccgggcctggccaatttttttttttttttttttttgagacggagtctcactctgtcacccagactggagtgcagtgtcacgatcttggctcactgcaagctctgcctcctgggttcacgccattctcccgcctcagcctcccgagtacctgggactacaggtgcccaccagcatgcccggctttttgtatttttagtagagacggggtttcaccatgttagccaggatggtctcgatttcccaacctcgtgatctgcccaccttggcctcccaaagtgataggaccacaggcgcactttttttgtttttgtttttgtttttgttttgagatgcagtcttgctctgttgcccaggctggagtgcagcggtacagtcttggctcactgcaacctctgcctcctgggttcaagccattctcctgcctcagcctcctgagtagctgggactacaggtgtgtgccaccacacctggctaattttttttagtacagacagggttttgccacattggccaggctggtctcaaactcctgacctcagacgatacactcgcctcggcctcccaaaatgctgggattacaggcatgagccaccttacccagcctaatatagtaatttttattatgcataaaaagttataaagtaaatatgcctcatgggacatcattgtttcatttttatatgaaataaagtaactttctatttttacatggaaatcagaattcatatgtctcacgtgtttttggtgttgttatccacaggagaccaatcattttgcaatggcagtccctaatgatctattccctaatcaactggaaatacttccaaatcagttaataaacttctttcaatgtttaaagtttgaaatatctaagttgggttaaagggaaagctcatgtttagttgtcagtgtatctcagcagcacatcatgggaatatttatttgtattgttggaaacatgttttctttcctgttatgtgctggaggagttggctcatgggttgcaggaccaaaacctgaaaatatctctgactgtgtgtcaccagaccacacaatgaatacatcacttaggttagcatgagaaaaggggaaaaacagctgtgaagcccatgaactttccaagaaggtaaaggagaaaaaaaaaaaaaagttgggtttgaagtctaagttttactatgaacagcaccctgctgagatcataaaaatgaaaaataccatcaagatacatgaaaaaggaaacaccaaagggaagagtgataacaaggctccacagagcgcagtttcctttgacaagatgaaaaagaaatgaaaagaggaaggagataaatggaacagccctctacctaaagtttctgtccatggagaaactgacatttaagtgctgctcaacaggaaaaagaaaaaagacctggttattgaagttggctttgttggagatgcgttactcagatacagatacaaagatgggtttggccaatgggcatccgtgtcaagaagcctgacctaacacgttctgaatattaagctaccttttatctgccagtccttggtgttcagaagaatccctcctcctcaccctaacttctatggggctatttccaaagacactgtcattgaagtgaggaagagtgagttgggccttatgacacaaagagacaagactatttgaggacaatagacacaggttttcatatacattccatgttattctgaattactgatgggttcgctgatggaattattgagtatagccaataaggagaaccacagttaagctggtgtctctgggttctggatatcatcctcaagaaaactatttactaattacattgaatgaggttattaaaatgtgtaagtttcacacaaaaacaaaaagacaattcattccaaattgtgcatatggatatataatgttaattatgggaattccattttaagaattactacaattctatgtgttctgtataaaaacaggaaaatagttgttccaatatataaaaggaaaacatttaaaaatgtattttcttgggaaaatcagctgccagaattcattagtcaactaacaagcactcctctgtggcaagaagccctgcttctctgttgtagcaggcagctacccacctaaatgatgaggtcaagaaatatacagctgataaaaagataaaaaatatgtaatagtccagtgattacatgtgtactacggatcagcgccaattagttgtaagcttttggtatttagttcgttacagcaaatgttttcttttttaaattttcttctgcaaatgttttcttgtcatgaaaagtgttttccgtttagcagaattacaaaaatagtcaagaagaaatgttctgattgatgtatacagttagaatgtgtattaaagattattataaaatgataactgaattatatccatttctaaagtatgttgggacaaaattttttaaaaatgtgattctgttttgaaaattgttttaccactggatcagtgtggttcttaaacttggctttatcttggagtcaccagaggagattcaaaagatacctttacctggctccacctccagagatcgggattttaaatggtctgtatctggattttaagagcccttctggtgattcgactgtttagctaggtttgagagccactaccctagatgagctgtcctgctccagtaacattctttttctaaaatcttttatagtatattagaaataaatccatggaaattccaagtaaaatcagaattactgtggtttttctctggaactgaaattcctatgtgtgaataatgcccaagaattgcttattcctttcaccagccaaacaaagcaaaacaaacaaacaaacaaaaaccatttaaaaacctagtaagatgttgacttaccagatattaaagcatgctaaaagcttctatactagaatcagtatggtaatggataggaacagagaagtcagtagaacagtcaagatctcagaaagatcccagtttatgtgcaaagttgttagtaacaaggaatgtggctcaattcagtggaacagggatgaattatttctgaaattctgccggaacaaacaagtgtccataaggcagaaaataagcatgatcactatcttatacacactaagaatatgtaaattaaagaggatgagaaacaaacaacaatcttaaagaaaatctatgaggttgtatgtaggacctagggtagtatgaaactttcttaacaaagattggaaactcagaagctgtaaaatacaatatagacataattgactatataaaaacatcaatgttttcatgctaaaaatactatatgcaaacattgtatataactattagatctgaaaaccatttgaaaggctgtcaaatataactttccaacagctaaaaatatgaccaatacaaatatcaaataagcatgtgtcaaagatttagtcaattcgttaatgagggaaccagtaaaatagtaagctggttcaatagagattttgaggattgtgtagagaagaccaaatgttgctcaggagaaagactgagtatgaaaatgtcctgttatttgctgtatcctcagggctagcacagggcctggaaaatagctggcatagattaaactcctgttgaactaaaattatattgagactcctttactaatgctgagaagtagagaagtggagaatttctcacacacatacagaaagccacatggatatctgcccaattataataatacttatgttgaaagagaagataaatgtcatagatttcagctttagcaggcagactaatcctggattgataaaaagccttgtacgtcttcgtaaaatctggctttaattagatagaagcaccacctgtaaggctgctcaatgtgctcttttgttttatttatagggaaatgtgtccttctcatgtccacagccacagactgtccctgtgacttttctgagctccaggagttatctggctctgccaggcaactctggggaggacaaagtgtctgtcacttttcaatttcgaacgtggaacagagcaggacatttgcttttcggcgaacttcaacgtggttcagggagtttcgtcctctttcttaaggatggcaagctcaaactgagtctcttccaggcgggacagtcaccaaggaatgtcacagcaggtaagagttgtattcccataaacctgacatatccacacggaaatcatttggtaattagtgagtgagtgaggcagtgagatgctccatgcccccactagaggaacagattgctgcttccttttagactgttctgtgtggtacaccccgctgccactaaagtgttcttttgaccaaaatgactatatatgagaaatatgaaatgcatatttctgcagatgtaccttcccatatacaaggaatacccttgagctccatttcctgacaaacatataccagcctccatcccaaagaactagggtcaggacctcatggaacagacaatacctagaggcacattcctctcctgtcctccttctcctttcccttctccgccctgccgctcagggtctgtgcacaaatattctatacacagtagtcaattgataactatcactttacagggaaagatgcccggcaaataccaagagttcttattctttcgttgatggctgattcgttttctgggatagccgggcaccctggaagaatctcagctcctccacttactgcccttctgaaatgtaaatcacgaagcctcctaagcctcagctgttttcacttgtgaagtggtaaacctcagatctcctttgcagggagaacaataggaagtctgattttattagcacaatgtccaccccacacacaggccctcacatccccactccccatcagggcctgtttttgttgggcaaatgctaggttaggggctcaaatcccatgaagccagactgagttacaatagatgggaactaatctcacatgcagtcagatgtgggcaagtttgttaactacagagctgctggattttgatgattggatttgcagatgggaggagcactgggtcctaaattgacattgtgcctaaattggcatcggaactaaatgggggctttaaaaaaaaaaagcgtaatctgaaaaagaaaaaggcacagacgaagaggctgacttctgcttgagaccagggggatatcatactcaaaaaaagattccttttggctgtaagaggcacatgtgactatactgctattaaatgttgtggtacgaaagcacgatttcaagacccgtgaagaaattcggagggcggggccttatctcagtacttctggaacaatcaggcaagtcctgggtgttagaatctgtgtccacctcacacaggtgtttcaggggagataaaacagatattcagaggagacgtatattttttatcttttagaaatgcaaacctagtttccatttcctcacgaataagattttttccaagaaaggttaaaatcgtgacccacacacagatacagaatgaacacatgtcagagattttctttaactcattgatgagagaaccagtgttagggaaataagtacagataaaattgcctaccaacatagtgaatcagtttcacaaggtagaaatgaaatagtcttattatggaataagtattaagccagactgtgatgtacatttcaggcaattgctaatgtgattgcaaagataaagaaatttcatccatttatatagccaggcagatacaacccattacatacatgttctaaagataaaggacaacttgtcctcaagtaagaggacttgacagcgccttttgctacacagcccatcttacattcacctggtgattggggaggcacactcctttatgcaaaggaaaactaaactccatgtctctttgacaagtgggtagttgcaacttggagccaggcacctacgttaaactcccacggagacaaggagataggagcactgcctttcttggtgtttacatttcaaagaaatgtctccaaggtcctcaagaaaaacactcctggaaacaagaaagaggctaaataagattttgtttgtttgtttgtttgtttgaagattttaaagatgtacaattacaagttttctgaaagaaatgctctaaggaaaaaaagtgaatgaaagtgtgtatcccttttagcactaagaaagcttttgtttgttttggtttgtgtttacccttacaccagtaaggcctgtttaaagaagtaccacacatttatagtcagaaaagagatgccgactagctaaacttttcaatatccaaagggaaaggcaaatcccttctctgtacacactttgcatctctatggacaagcattatttgcattattatcaatgttctgcaagttaacttctgtcactacacagctgtaaagtaactagtccaagatgatggtttacaatcccgtaatatcagctgatctttccattgaaaagatacccagtaatctcctttgcccatttcaaagactgccctcaatttttttcctacagtagttggttcagttttactgctgatgagttgcatatattctggattcaatgaagtgctgaacaagcacttcatccagttctgggttgcacaataactagaattaaatataattaaagttcttaaatctcatcaggattttgctttagctcatggctttgtgagtatgatattttgcctctgcagttaaaatgttgtagttgttaacaagagatcatcttcatatcaaatgtgtttaaaataacatctatgttgtgggcaattaatttagtaacttctcattgaaatatttacagattctactgtatctgattttcttgtgcataaactatggccaaaggccaaatacaacctaatagaaaacaaaaagaaaacaaatgtggatgatagacatgaaaacagttatacaaagatctgcttttatttgtcaaaagatattcttaaagagggcactttttgcagttataaaaagaacatgtcaaagattttgtttaactcattagtttatgagggaatcagtaagatgttactgctgcaatgattttgtgtataatgtaaaactggcttattccatgggatggggtagaggaaccaggaagaagttcagttgtatttctgccagacaaaattcatttgcatgtctatggacaataatcatttgcctgctttcaattttctacaattcacagggtggtaaagaattcaaagaaggggccaggtgtggtggctcacgcctgtaatcccagcaatttgggaggccaaggcatacagatcacgaggtcaggagattgagaccatcctggctaacaacggtgaaaccccatctctactaaaaatacaaaaaaattagccaggcgtggtggcgggtgcctgtagtcctagctactcaggaggctgaggcaggagaatggcttgaacccagaaggcggagcttgcagtgaaccgagatggcaccactgcactccagcctgggtgacagagcgagactccatctcaaaaaaaaaaaaaaaaaaaaaaaaaaaattcaaagaaggtaaaaggcacagaaacctgcagaatcatataatcctccagattgtgtttagacaatgcctagttttacattgaagacatccagaatcttggttgattttaaagaataatttatttccttacactttattactacttctgtttctgtttcatacatcactgaaggttaaaagggaaagctaaaatattaatgttaatgtttaatttttaagaagtactacatttgaaatgctaataatatactaacttcacataaatgcatgttaggaagaaaaataaatgaagcatagagtcattttaataatttacaggtttcccaagactatcaagtaaaatgttaactttataggaaaatttctgttagtctaaagtttattataatatatgtaacttctgaaatagtttcaatcttggcctaattttaaacttcagtgcaaagttaatttaataggcctcatgaagctaatcttatttttagcccatttattggcatgtatctttgacatattatcaggtaaaagaaagcacggaatacctctagtgattttaaataccttaacatttaaatttaccatcaaagacaattcattatgttaccaaattatttgacaagattaatttcataattactactaagaatcataatgtggatgtgagtgtaaatatataaaaatattgtacatatataaagtacaactccagttctttcctaagcattttttatcaaatattaaataatcgcttttattttattttattttatctttttgagacagcgtctcactctgtcacccagactggagtacagtggtgtgatctcagcatactgcaacctccacctcccaggttcaagtgattcttgtgcctcagcctccgaagtgactgggactataggctagtgccaccatgcccagctaattttttgttttttagtagaaatgtggtttcaccatgttagccaggctggtctcgaactcccaacctcaggtgatctgcccgcctcagcctcccaaactgctgggattacaggcatgagccaccatgcccagcgaataataacttttaaaagacagtataattatatctataataataatttaattcagaaacacacgaatatatgttaaagattttaactaatcaatgaagaaaccagtaagatgttacaatcagttcagaggataattcaaagtactacacatacaggcagataagaaatgccaaaatgaattacagacagatatgaaatggttcagtaagcaactgcacctcgctaggcacaagtcatttgtatttctatgggtacaagtcattttgcattactatcagttttctacagtttacagggctgtaaaatagctcagacagtgaaagcagggtttaccttaattaatgggtgcagtaagccagacatccagtgatcttccatttcaaatcctgtcacaccccataagtatgtgcaattttgtgtcaactttttctaaaaaaaccttttcacaatcattcttgacatattttttatcaactcactttcttgattcttgtaaaatgtttttgttagattcagtaaagcaagtaagttttgcatttgaagattaaaccaaactgtgttgtttttatcccattgtaaaggcttctactgtatatatttgataattaaattctagttactttaagcaaattaccagaatttgttacagtgattcttcagaaagagtaatatttttattcatgtgttattttcataataaatgaaatttttaaattaaagataggtggttaatgtttttttcagtgatacatgaacatgtaaataccactcttctctgacttattcagtgatctgaatcaaattgttttcaagtgtttacagagctcataatttagagttgtctctgactgattgtatttcctccaggtgctggattaaacgatgggcagtggcactctgtatccttctctgccaagtggagccatatgaatgtggtggtggatgatgacacagctgttcagcccctggtggctgtgctcattgattcaggtgacacctattattttggaggtaagagaaggcaactgaatgacactggcagtggaaccactttttatctttattgctttgcattttgagtctctagtcaaatttaaaccaagttgatactaagaaataatttatctctagccatgaaattaataccttttgagtttgtaaaaaacatgaaacatttaatcaatttttcttcccaatacaaaaataagtatctgcagaaagtttacttgctgtttaaataacttcatattttcatttaacattaaaagaaaaatatatttgagctacatgtagtaaataagtggaaactttcaaacaatatcatagtcatatctctacaacagataaatccatttatacttctaacagttagctcataaaaacaaaacaaatcgtactgtctgaagtcattggcttacataaaatattacttatatatttaagtccacatctaaatctatactattgaatcattattagtacacagctcagtttatagatagatggataaatattttttacatggagaaggcataataggaaatatcatactgattatgaagtactttcaaaacattgacaatgtaaacaaatattaattaataggagacaagcatattaaatgaatccagtataattggtgttacactggtgcaaagtattgaatgtttgcttccccaccccagattcatatgttgaaatcctgaccccaaagtcatggtgtcaggaggctttggagggtaattaagtcaggagggtggagccctaatgaatggaattagtgcccttataaaagaggcccaagagaactcccttgcctttcctgccatgtgaagttataaggcgaagactgtggtctgtgaagcagacactgcatctgctttgcctcaaactcagacttagactttccagcatccagactgagagaaataactgtttgttgtataagccactctgttcatggggttctgttaatagcagcccaaactgactatgagaactcatacagctaaagaaatggaaacaagtggatcttttgattataaaggaagtttggatttttttaaattaaaagaaccactaggaataacagcaaaaccctgctatgtattctagaatgctcctgtgaatccaaagattatgcttttatatctggaaaccacagttaagagaaacaatcatgtgagaaaacttatcacatgggggcatggatgcctgtacattacagcattctgttatcatcccatatcaccacatatatgataagaaaactcactctcaagtaagaaagttttcaactaggtacgaaattccatgctggacacagatacagagagccacttgcactgtacctaaacactgaagtgttactgaggtaacttaattacttgtaattcttactggaaaggtaaatatattcagcctttcttagtaataaaaattatatgtaaacagaaatatagatctagtaatagaagacttgttatatacatgcagtcctatacattgcattttacctcatcagtatttgtggtatttcgcaaagaatatatacttttccaaatatacagccacagacattcaaagacttcactgagctgtcctctggcacacaggtgtatttaaattgttaaagaaaattaaaatggcctgaggtatctctgaccagacaaagccttgtaagtggccttaactttgcttgatttaccaatataagcaaaacttaacttgagctatttcttgtaaatggctttaaaaataaaaaaagtcaaacttaaggctaaccaatcagaagccaattaacttatataactagagactttccagcaggatcaaccaaataaggcaattgtataactacaaccagtgaaaaatttgctactatatttaccttacagaagctgtccctttttgttcccttgaaagggtccctgaaccagttcccatttgaagctgcttcaacagtgattcatgaatcactgttagctcaaataaacttttgtgcctccatttaccttttattaatggatacatttatatctgtagttggatgcttttttcctctaagcagacacaaagtaaacctgaagagcttaagatttttatttatttatttatttttattttttgaggcggagtctcgctgtgtcccccaggctggagtgcagtggcgcgatctcggctcactgcaagctctgcaccgccaggttcacgccattctcctgcctcagcctcctgagtagctgggactacaggcacccaccatcacatctggctaattttttgtatttttggtagagacggggttttcaccatgttagccaggatggtctcgatctcctgaccttgtgattcgaccgcctcggcctcccaaagttctgggattacaggcgtgagccactgtgccaggccaagatttttaaaattagttaatgccttggtgtatcttgagtggatgataacataggagtcctcagaaaaatgcagccatgcccgccagccttttcagaagagcgaagttggcttaaggaatcatcatcggtccaagattgttagtgatctgagaaatttcatgtgctgaggatgatgccaaattaagggtttccaagtatgagtaccaggatacctcctatacctgctctcagccatatgtggtatcgacaattgcctctaacaaaatttttccaaaccaagtagaagaaaacagtaaacggaacagagattttttttttattaggatgggactgaaatctgtccctccttcaggatgagggctgtaatctgtgtgacagaaacagatgacagagtttgatccacactactttgttttcagaattgctagcccagattgaataggtccagaaagaaactaatgaaataagcaatagaaaatctctaacattatagtctttgacaatgtatattcatatataattcccatttcctacagaaaatacgtgatgcttctcttttttttttaaacttattttaggttcagaggtatacatgtgcaggtttgttatataggtaaattgcatgtaatgggggcttggggtacagattattccatcacccaggtaatgagcatagtacctagtaggtagtttttcgatcttcaccctcctcccaccctccaccctcaagtaggctgtggtgtctattgttcccttctttgtgtccatgggtactcaatactaagctcccactcataagtcagaatacatggtatttggttttctgttcctgtgttagttcactttggataatggcctccagctccatccatgttgctacaaaggacattatctcattttttttatggctacatagtattccatggtatatatgtacattttctttacgctaccgttgatgggtatttaggttgattctatgtcattgctattgtgaatgaacatgcacgtctgtgtgtctttatggtagaaagattattattcctttgggtgtgtactcaatggggttgctgggtcgagtggcagctctgctttaagttctttgagaaatcacgaaactgcttgctgcaatggctgaactaatgtataattcccccagcagtgtataagcactcccttttctccacagctttaccagcacctgttatttttcgccttttaaataatagcaattctgactggtgtgagatggtatctcattgtggttttgatatgcatttatctcatgactagtgatgctgaggagtttttcttatgcttgttggccacatgtatgtcttcttttgaaaagtgtctgttcacgtcctttgcccgttttttaatggggtaggtttttttttctttcttgttaagttccttatagattccagacattagacctttgtcagatgcataatttgtgaatattttcttccagtaggttgtctgtttactctgtggatagtttcttttgctgtgcagaaaccctttagtttaattaggtcccatttgtcaacttttgtttttgttgcaattgctttcggtgtctttgtcatgaaatttttgccatgtcctgtgtccaaaatggcatttcctatatttcctaggttatcttccaggatttttgtagttataggctttacttttttttttttttttttttgagactttagagtcagtctcacctgttgcccaggctggagtgcaatgacacgatacagcctcaacctcccaggcttaagaggttcccccgcctcagcctcctgattagcctggactacaggcacgtgccaccacattcagctaatttattattattattattattattattgtttgtagagacgaggtctcgttatttgcccaggcttgtctcaaactccgaggttcaagctatcctcccacctcaccctcccaaagtgttgggattataggcgtgagccactgcacctgacaggttttacattttattctttaatccatcttgagttgatttttgtatatggtgtaaggaaggggtctaggaactgcttatggttagccagttatcccagcaccatttattgaatagggagtcctttccctactgcatgtttttgtcgactttgttgaagatcaaatggttgtaagtgtgtggcattatttctgggcgctctattctgttccattggtctgtgtatctgtttttgtaccagtactatgctattttggttactatagccttgtagtagaggttgaagttggctaacgaaatgcctccagatttgttctttttgccttggattcccttggctattcaggctcttttttggttctatattaattttaaaatagtttttactggttctttgaagaatgccattggtgatttgataggaatagcattgaatctataaattgctttgggcagtatggcccaatatggttaaaaaccatatttattattcctatccatgattatggaatgtttttccatttgtatgtcatctgtgatttctttgagcagtgttttgtaattcttcttgtagagatcattcatctccctggttagctgtatttctaggtagtttattctttttgtggtcattgcgaataggattgcattcttgatttggctctcagcttgcatgttgttggtatataggaatgctactaatttttgtacattaattttgtatcctgaaactttgctgagattatcagatcgagaagcttttgggcagagacgatggggttttgtaggtacagaatcatatcatctgcaaacagagacagtttgacctctttttctcctgtttagatgccttttgtttctctctcttgcctgattgctctggcgaggacatccagtactatgttgggtaggaataatgagagacggtatccctgtcttgtcccagttttcaaggggaatgcttcacatcttttgcccattcagtatgatgctggctgtgggtttgtcataggtggctcttactatgttgaagtatgttcctccaatgcctcatttgttgagggtttttaacatgaagggatgttgagaaaatacctgatgcttctctagagacaaatatatgaaagcaaacaacatttcatgaaggaatgaggaatattttgtggcagcaagaatgagaatgactctccaagatgccctggaaactgaatatgttacatcacataagggattttgcagatgtaattaaggttgcagaccttaggagatgatcgtgattcatgcagtgggctccatgtaatcacatgagcacttaagagatttaactctggttggaggcagaagagacacagaagagaggtgtgggtgaggggaagccagagaaactagaagcaggagaatgtctctctgcaccattgctggtttagaaaataaactgggcactatgaagagcaacgcaggcagcctgacattgctgagaggccccaactaccagccagtgatgaattgggacctcactcctacaactacaagaagttgaattctgctctaacctgtatgtgcttggacacacattctgccctagggccttcataaggagcccaagagcaccttgattttgtccttgtaagactataagcagagtcatcagtccagccctcccacacttctaaagtgagagataataaagagaatgttttagtaatttgttacagtgatgattaaaagctgatacacattccaacctccatcagatccatttacagacattcccattcagttctaaacccttggacaatggccaaaaaaaaaaaaaaaaaaaaaaaaaggtttcctcaaacacaccctgagaatatactgaaaaagattacatatatatatatatatcttaggtggtggcccacgcctgtaatcccagcaatctgggaggctgaggccggcggatcacctgagatcaggagttgaagacgagcctggttaaaatggtgaaaccctgtatctacaaaaatacacacacaaaaaaaatttagccgggcatgatggcaggtgcctgtaatcccagctacttgggaggctgaggcaggataatcacttgaaaaaaaaaatatatatatatataaaatattttttaaatatatatatgaccaaagagaatagtttcaacagaaagtcaaaatagccaacacagtttctgtgttttgttttgtttggattgtgtatggccttcgagtgaagtaacatacatgataatgaaccatatagggacacagtgacagaaatgggaaggctgatccatgatcatatatgcatacatagatacactatggattccaaagtcccctttgacctgaaagtgtgagaagagcccataacccatttgaaacagatacgcagcaaccacaacccaaattgtatatgcataagtaaagttgtccttatttcagagatgatattatggattgaattgttttccctcaaattcatatgaactccagaatgtgaccttgtttggagataagatctttgcagaggtaatcaagttaaaatgaggtcattaaggtgagctccaatccaatatgaccagtgtccttatgaaaaatggaaatggaggtgcagagacacacagagagggaagacgctgggacaacatgcaggaacaacgcctcaggaagacagaggcctagactgttacacctgcaaggccagggctgtttactgggttcctccctgaccccacatcccacctggggatgaacccgacccagaccttaccacccactgctgctacactgccataaatccctttttcaaaaaaattaaaatatttatttgacaaataaaaattctatatatttaaggtatactatgtgacgatttgatataggtatacactgtgttctgattaccacagtcaagttgattaacacatccatcacatcacacatagttaccatgttgatggcagaggggagtgaagtcattgaaaatctgctctcttaccaaattccaggtaaataacacagtatcattatgtatcaccatgctggatcatcatgctggatcccttttgtttcatggggttgtatcaccatgaaacagtatcaccatgctggatcccttttgtttcatggggttgttgaaaaaagactacaaattaaggactgaaatgcatgtcttccagataggcctaaataaaagatcacactcaggaaccgattttaaatagaccaccctttatgaagcttcccttcatcattgtgcccaacggaattgtaacagtgtgaaatgagtgccactaccttttccactgctttatgtgctggttttattgcaccatacaggtatccctagagcctcggctcctctggagcatcttattgatttcccactgccgcatgaagaaaggccatgctttgcccaaagtgactaatagttttactcagtcggttatttcaacttatttttattgcccagtaatgatgcagtgaaacattttaccaagtcagggagcacatcagcctttcctagacaataataaacagaatatttgccagctcagtcaatgattgagtacagccaagagacactgcagcctaagagagggcagtcagagtggggaggtcacagaagggtgcaataaatcttctgcccagggatgtttactcagaaagtccttggtcattagaaatgtcatttaactctgtaaataataagatacatttgctaatcaatgcttgaggtgcttcttgagagtattagtatagttttgcattttactgttttttttttccagaatccttttaaaattatgttggagacagcacaatatgaaagtaaaattcggccaggcacagtggctcacgcctgtaatcccagcactttgggaggcctaggcaggtggatcacaaggtcaggagatcgagaccatcctggctaacacggtgaaaccccgtctctactaaaaatacaaaaaaaaaaaaaaaaaattagctgggcatggtggtgggcgcctgtagtcccagcttcccaggaggctgaggcaggagaatggcatgaacctgggaggcagagcttatacagtgagctgagactgcgccactgcactccagcctgggtgacagagtgagacgccgtctcaaaaaaaaaaaaaaaggtaaaattcatccctaaaattggctgtcagcatggaaattataaaactcattttctaaactctaacagtccttcagagcaaactttccaagagcaactgtgaaaacagacaatgtcaatctgcaaagtttctgattgttttctttcctcatattccgaggtgtgcatatgtgcctcaaattgtattaaaacatttgctatagatgacacattttataacaaaaaacaaataagccaatatatccaagacctatcatttcaaaggtaaaatatttaggaagcactaaaagggataagaatgaaagtactattcatttttttaagtgatactaaataaagttgattacagaaaatgatttgtcaaagtataaatatagtatcacctttagggtttaaattctacaggtgagattattcaagagcccatttccataaatatatacatgctaatgtgagaaatgcttttgagttatttttatgcatatcataattttattcatttttactgtgaaatagatcatatatgtacagttaaaaatattgctaatttttcaaaagaatgtatatattgttacatgaatataccacattttatcagttctactgtcccattttgctattgttaggcaattttcatttttgcttttagatttgctttataaaatttaggggggtggtgtttcgttgttttgccttttttttagacagggagtcactctgttgcccaggctggagtgcaatggagcaatcacagctcactgcagcctctgcctctccaagctcaagcacttcttccacctcagcctctggagtagctgggactgcaggcctgcaccaccacacccagctaatttttgttgttgttgtttttcttcgtattttgtagagacagagttttgccacgttgttcaggttggtctgcggtgatccatccacctcagcctcccaaagtgccaggattacaggcatgagccaccatgcccagcctaaaatttagtttttaaaatattcttaacatacctagtttttccagtgaattttgcattccttgtgtgtgcttttgtaactttatttacccatctgtatagtaaacttcgggaaacaccagctctaaccaccatgtttaacagcataagctggttgttaaattttactgatgtatataaacccaaaatagatcatttcttcacatagaaacagcctttggttccgctagtattcattactcattttagtaatttaaagaccacatgacccaaattcttcttgaatgctgtgcagtgcactgaaagagactaataagcccttttctgttttctaagcaaatttacttcttgggatatttctgttcatacggtttcctatgacacatagcatcactaagagtcaaataagtgaaactgaaaacattaaaattaatcctgtaatccagttttaataatgagttcatttcattatgtttctttttcctttccatttgttttatactggcctggagaaaacaggcttgatggataaaatccacagtattttcttcctaactagcttatatatttagaatggcctgaatatgtacagctgcagacactaacttcattcctacagtataatatctaccaatgattgaaactagtcagctgcacgttttatttatttattaaaaaggatttggatttttatacaatatttaaaaaccacaaaatgaaaagggatcaatcaacgtatatcttggaggtccttccaagagtctcagtatctaacagccatggaggctgtgacctttttccttcttttctcagcctgcttgtcatttaagggtcaccagagatgactcatgctctagttcttaaaatcaaacttgttccaccaaatccaagatgctgaatttgtacaaatgtaaaaacatcctcttgccacctgtccaccaaaataccttctattcaagtgaacaacagctttaattgctgactcaactctcaaattctaaaaaggtctgtgcttcatcatcagggacaccaagaatttcacatatcacacattttctaactttgccatatttttcatggcaaaattgggaaataccatggactttatccatcaagcctgttttctctgagccaatataaattgacaatggaaaagaaaaagaaacataacagaatgaactcattatgaaaactagattaactatactcttttcagtttcacttattttatccttaatgatgctatgtctcataggaaaccatatcaactgaaaaatatgtcatcacacattcttctctggtttcaacttccaagtcttcttccacctccccttcaccaaccatgttccttagtaggaccaccttagtaggactcaagtatttcagtcagtggatttgtacctgacctttcaatgcatctttctctgcggcgtcgcccacgatgatcttgccgcctgatttgctagtcttccccaccggaaaggcgtctcgaagcccctgcaggtgctccccgaggccccagccttcccggaagccgcgcttctgcatgatgttgtgcaccaccgttcccaccacgttagtgaggaaggagctgctaggacggtttggagatctcagtctgtcctgttcctccttcactgggggaggaatggctgctttggaagaccgtgactgaggtcttgaatcctcttcataaggaaaatctcggggtgactcttggtctttctctaccagagaagtgggaggggcaatggcagctccaccctactacttttcctcctctctccctcctaatcttccccttcatcagaatctggatttggtcgccttgatcagaactcccctaatttcttgcctgtcttcaggcctcttttccctttcttctatttcctttcatatttctagctcctgctgtgtctgtcgttcctctctttggcacttcactactttctcataatcataagggaacataggatcatattcgtcagctaagggaatcagaacgtcccctgcaaaaacccactgggagcaggatccttcagcccacctgctgcatgccgtggtgtgtccccaatttgcaggtcatctgaggagccgcctggccttaggtcaatgactggcaagagctgcactgtttctaactttggctctttccctgagtgagagctgccttcctcacctgaagctgagactgcagaagtttgacgttttggaaccagccttctgcttttgagtcactggtctccactctcaggccatcgtatgggggcatctttttttttttttcaatttaatgttgccctgctgactctacccatgggtagccaggttaatatgaaaaaatgaagaagaagaaaaacccaccaatttcctgatgccagataaatggaaaatgttatttgcaccaaagaaaccttgagagacttggaacaaatcactggtggatgtgggtttctggatctcactagatttattttaatagaaagtttaggccagacgcggtggctctcacctgtaatcccagcactttgagaggctgaggtgggtggatcatctgaggttagtaattcaagaccagcctggccaacatggtgcaaccttgtctctactaaaaatacaaagattagctgggcatggtggcgggagcctgtagtcccagctactgggtaggctgaggcaggagaattccttgaacctggaaggcaaaggttgcagtgaaccgagatggtgccactgcactccagcctggcaacagagcgagactctgtcaagaaagagagagagagagaaagaaagagaaagtctaatttgcagatgcagacctatcttctatactgtcatttgtccattcttttttttctggtctgtgatttcatctttttgaagtgtttttcaagcagcactctgtacggttgcaggttgtgcatatagcctgcagttttttgcattcatgcctgaaatagagattgactgaaggtcaaattcttttaaacttacctttatggaatctttctgctattcaatgccatgcctccttccatgatattgagaatacaaaattgactgttgtgtcgccagtcctcacatccttcttgtaggaatctgctagaccaagaacttgtggcaacactgcattgaagtctgtcactgcaataacacacagtgacaattttcttgccaacctcatatgcttacacaagtgaaaataaccgggctaaaattttcatgggtcttaatatctttatttgtttgatttcatatccatgcagtactttatgattagaatttgtcctgaaagtttcataactttttgcgggacacctggatttattttagtttttttttttctaacagagttatcgaattcattttcttttaagaataacctggctgggcgctgtggcttatgcctgtaatcccagcattttgggaggctgaggcaggtggatcacgaggtcaggagatcaaaaccatcctggctaatatggtgaaaccccgtctctactgaaaaaaaatacaaaaaaaaaaaattagcagggcatggtggtgcgtgtctgtagtcccagccactcgggaggctgaggcaggagaatgctgtgaacctgggtggtggagcttgcagtgagcagagatcacaccactgcactgcagcctgggtgacagcatgagactcaggtctcaaaaaaaaaaaaaaaaaagataacctaagttatgtgtcaggaaacaccacatggtgaaagaaagattagcagaactgttgatattcctataattcattactggaaaatatttattgaattaataatcctcttaattcttaatgtgtttatttcttaatgattagtgagatgcagtagaattatacaaagttcactctctatcccattcttcagaaggttctgctgtaccatttaaacttttatttcttttgtaaatataaaaatataaaagattttagtcttcaaacttttaaacaaatatggtgttaaatgttaaacttccaagtgtctgtgaggttatgtatagtttcgataagctaaaaagaagccttaatatgagggaggcttttactttagggatctaaagcagaaagtattaaagttaaagagataaagcttcagttattaaaatggaaatctaaacacaacatttaatttttatggaacttttagggaggaaataagagtacaggcattgagaggtgcttcatttattccagtaagaggaatcttcattgactattttttgaaattgtgctagtgattaacaatataaggtcaaagagaggtcaatgaaaaacacataagtacaaattctatacttcatttttttcattttaatgaacactgtaaagaaaactcaatcctctagtgataaatattgatgtatatttactataatctttggagaaaagggtatttgcatggactgaaagtgtcatgccaaatattaggtttaatacctaatatttgaatgattgggaaaagaaaataagaaattatatctcacaagtttgaaagagacaatacttacagaatcaatataagcaggcttcttttttaaaataaggcaaaggataaaatttttaaaagctatataatttcataatatacaattaaattaattactaattcaatttctcttgtcattggcattacaccattatgaaatgaggttcctctttcatatttgtatgttaaaattaagtattcatttagatcagaggtaggcaaatcacggtccatggcatattatataagcccaaatgaataattgctttgtatttttatttttatttttattttatttgagatgaagtctcgctctgttgcccaggctggagtgcagtggcaccatctcggctcactgcaagctccgcctgctgggttcacgccattctcctgcctcagcttcccgagtaactgggactacaggcacccgccaccacgcccagctaatttttttttgtatttttagtagagacggggtttcaccgaattagccaggatggtctcgatctcctgacctcatgatccgcccgccttggcctcccaaagtgctgggtttacaggcgtgagccaccgcgcccagccctgctttgtatttttaaagggttataacaagaaggacatgcaacagagaccaggtgtgacccacaaaaccaaaagtgtttactatctgcgttttacagaaaacctttgcagactcctgacgtagacaaatgccttatgattttattctgaattaatatgactctttctacaaacagttgtctttaaataataagattttacaattattgtgttttctttaactagagtgtgtactttcatccttttccttacttttcaaacttagagttccattattaggttatatattgtaactcaagagggtgggagtaagttcaagacactactttcctatatgcttggactggtgtggagtaatactgcttacgtcaaagtcaggcactcaccactgcttcttataagtactcttcttgtttcacaaaacaagcccacatagtaaagggaagtgatgtcataagcattgccatttgtaatttaggtgaaattagctgacgattgtagtgaaatttttaatatttaacttctaatattggaaataatcaaatgtctattttatctctttctattcatagaacattctggactgcaaatttttatccttatgtaccctaacagtgtgttatgtcctgttactttttgtgttgttgttaacattagaatttaatctttagttatatatttgactaaagtacctaataccaaagaaagtgttactagaaaagcaaatctaggtatttccacccagtcagtataaaaaaatacgtttttaaatactcccaaatatacatacatcgcaacgcacaaaaacagctatagggtagatatttaacatattttagataaatggtagtatacaattatattttcaggtagcatttttcacacttcacagcatatcctaaataaaatttgggctatgatttcatttattttaatttaacctccactttaatttttttcacttatactacataatgctaaaatgcatgcttatttcttagatgagatttcacaaaagaagccaaacctcttttcacttggttgggaaataattcctgttataggaattttagatctgaattttcccccgcaatttcttattctgaattccaggtattatcttaaatttgatcagttctaaccttgccccttctcacctctctaatgaatggtgaagctcatcgcatcataccgatgtccataaacaagcgggagcagcagtcttcatatagtaaatactgtggaatagttttgtcatagttgttgcttttgtcctatttttgtcttcatattcaggctgcctgggcaacagctctggctctggatgtaaaagccccctgggagggtttcagggctgcctaaggctcatcaccattggtgacaaagcggtggatcccatcttagtacagcagggggcgctggggagtttcagggacctccagatagactcctgcggcatcacagacaggtaagggccatcctaggtcactttagcttgcctgttttcaaagttgaagaaagcaaatgtagagagctggaaaaaggcattccgttctctttttcgttgttgttatctttcgagagggaatgaaatagtcataattactatgaggattagaaaacttcatcttggccgggcgtggtggctcacacctgtaatgcggctgaggctggcggatcacgagatcaggagatcaacttcatcctggctaacatggtgaaaccccgtctctactaaaaatacagaaaaaaaaaaattagccaggcgtggtggcaggcgcctgtagtcccagctactggggaggctgaggcaggagaatggcatgaacccgggaggtggagcttgcagtgagcagagatcgcgccactgcactccagcctgggcgacagagcgagactcggtctcaaaacaaaaacaaaaactgcatctctaatggaataaatagcattttttaaatgatagtattttattagaagatatacaccttatgaattttaccttaatatgatcccgagttgctcagctaatagttataaagctcgcttttgcaaccacacacccatcagttggatgatatttttccaggcagaggaatttgccaggttactattcatcagccacccaaccccacatgttctgcagagaaaataaaaagtaatttctgctagaaaagtttgaatcataaagacggatgaagatgtgtgcagaaggacatactcaatgaaatatggaggttagacaagaaaaacatttaattcaaataagtattacaaccacagttatgctagttgtgccataattttacaaagattttggctgagaagaatcatagggtcacacctggaaaaataatatttctacatacaatttgccccagtacatttggtatttactttcagtgaataaataaatgctacagatttaaaaattgaaaagtgataatctggcccagcgtggtggctcacgcctgtaatcccagcactttgggaggccaaggcgggcggatcacgaggtcaggagatcgagaccatcctggctaacatggtgaaaccccgtctctactaaaaatgcaaaaaattagccaggcatggtggcgggcgcctgtagttccagctactcggcaggctgaggcaggagaatggcgtgaacccgggaggcggagcttgcagtgaatgagatagtgccactgcactccagactgggcaacagagccagactcttctcaaaaaaaaaaaaaaagttatatctgcatctggtagaactttcaaaacctgccttcttcatggagtaaattcagttagtcaattctgttttaaacattaactgtaaaattatcttctctggctaaacaggttttaatttataactcacagttagtgacatactaaaaaaacgcaattactactaaatgaaaagttcattcatatggactttatttattcagcatggaataatttccccctgtgaacattctgttgatttgtaggaaaaatgaattaattcaaagatgaggagtatatgaagtgtaagaatttgtcaagtacctctcattcttgaccttgagatttgaattcttggcacacagctgggactgcatttacatctcaacaccagctccagaaccacactctgtagtcgtgggaagggtagttgggaaggtttctggccatttgctcacttaatataatcccaagttgctcagctaactagccagggagctcatctctctctgagttaaggggtaatgtcccatgggcccacactgtgagtgacaacagctgtcagctcaactgtgatgcaagtgtgattttcttcacttgtatgacattattttgataccttgttaattactcacaaaatatgatccatttgcagtgtttctgttatgagatatatattgtgaggctgcctcttttcagagatgatccattttgcctgctttgtgcatgtagctcccaaagtacaaaactattgtttttactgttataggctgttttgttttaaccttaaagtcccaagagttacattggtgcctaacttggtctctaagatcccacattttaaaaaggcctccaaattgtaccccaaagttacttgtaaacatgctcaactaagcatgaatgtgtgagccacacttaaacttcagccatgatgtgtacaataatcattgcagataaggattttaagaaagcacttttaaattattttcaaatagggctacaaataaaggctatttactatttcattcccaaagtcagtaacgtagaagactagctcctctgagattattttgaaaacctgaattttataaagcaataaaattagaaaactttggggacacaaaatgacatcctacagagttaaaattaaagacctttgctgttccctttacataaagttttgaaaacctgaaaatactgaaaattcacttttaagtatcctgaaaacaggcctgtaagcatctatcagcctttctttgttgttgttaacaaacaaacaaacaaaaatctaattgtattagtctgttctcatgctgctaataaagatatacccaagactgggtaattataaagaaaaaaggcttaatggattcacagttccacatggctggggagacctcacaatgatagcagaaggtgaaggagaaacaagacacgtcttatatggcagcacgcaagagaacctgtgcagggaaactcccctttataaaaccatcagatctcgtgagacttattcactatcatgagaacagcatgagaaagatctgcctgcatgattcagttacctcccacaggttccctcccatgacacagtgggaattatgagaactacaattcaagatgagatttgggtggggacacagccaaaccatatcactaactcacaaagtagaaacatatgttactcaaataccacacctaaaaatcctacttagggacagataaggggtatgaagttatcttttttagtcaaaattttaagctacgcaaaaaatagcaatgggcactttggatgacagagtcacaaataatggatgtttatgtttggataggtgtttgtttgtttgtttttttgagacagagtctcgctctatcgcccaggctggagtgcagtggcacgatctcggctcactgcaagctccgcctcctgggttcatgccattctcatgcctcggcctcccgagtagctggaactacaggcgcccgccaccacacctggctaattttttgtatttttagtaaagacggggtttcaccgtgttagccaggatggtctcgatctcctgacctcgtgatccacccgcgtcagcctcccaaagttctgggattacaggcgtgagccaccacacccagccaggataggttttaacttcttaatcacctcttacatcagactcctatactgttttaaggtttgccctgtataccacatggcagagcttccagtggagtcctgtgctgcgttccaactggggctccctgagcagggaggcctctgtcacctcctcacctggctgtgctgaccaggctgctgaccccactcctgccctccctctgccatcttcccctctgttggtcttctgcatgctagctacttcctctattatttgtactacatgtaaatttttcacaattgatgttgtgtttagttgaagaaaaatagtgtatacatgttgatagtctctagatcacttaaatagttcttatttccaaatattttgaactaaaattattctctccctgttgatatcaaacagcagtggtttttaatgttttttaaaatttgtggaatcttcaagtcaggtatgatcttaagatgctccattatattaagaaggaaggggaggagggggagaaggatgtgggggaagaggaacagctgctcttttaaaaatggtatgagggtgggcccccaccccagccaaccttgcctgtcgctccagctccccctcttctgatcagttcacacaggcttttccatgccttggcctttgaaatacttgaaaagttgtgattctcatggcccctaactcttctctgaatgcagactaaatgctcattaacaccatgtaattatggaagtcttggccctgagctggtggtgcagtgctggagagccaggatagggggctgggggcatggggagggtagggaatgctgcggattcttcccagcccctcaggttcccctcaaaggatctctcccgaggccaaatacaggcccctggggctttctgtcaacttcataccccagttctctgctggtcgtccttccaccacagccaggaggcctgtcacaacctcccagcccctcttctgttacttctctgggtcccatggtgaggggcacttgggtgctccccgcctctgccgctccagcatggactatgatgtccctcacggcctggaaggtcagtgtcctttagaatcttcactctttaccaggtccttagctgtgtactcagcagtgggagacagcggccagaggctgagatccaaccctgctcaaggcagaggtgggtcatggtattcaggccaggcctccagaaggtcacactacctcttggtgacactctgtgtcaggtgctggtcagtttccatagtgtaccctgctccctgttcccctaacaatcctgagaggcaggcatgctaggcccccaatattatagtgggcggcagcagattccaagaattctgaaagtgtgagacctccaactgttctttttcaacattggctggttcagggtcccttgaggttccctgtgaattttaggatggattattgttttctgcaaaaaaaggcattgagattttaataagaattgtattgaatttgtggattgctttgggtcatattgacatattaccagtgttaagattgcttaaaaagcaataaccgactgcttattgcaaatctaaaaggcgacaagatgacctaaattaaatgttcttcaaaatttctgaacctctgtcactatgtgactgaagctgttcctgtttctttcttctcccctctgtatcttcctccctgtttccccttctttcttttaaaaatgaccacaatatagtaactgagcatgccatatttcatagttttatgtgtgtaattggttttgctagccacatgtcaagttattgtgtcacttgggacaaagaaaaaaagaaatgtgttgaaaattcagctgtcacagaaacctaataatcagctgcatgctaatggatatatttatctaaagtttgtcaatataattagagaaccttgatggcagacccagtaatcacgtcatgtggggttatcttgcgtatgctggcctttcacattaacctgtttttggtaagacacttattttttgatgattgaaaaagggaaacagcagttgtatctgttttcttttaggtgcttgcccagctactgtgagcatgggggcgagtgttcccagtcgtgggacaccttctcctgtgactgtctaggcacaggctatacgggcgagacctgccattcctgtaagcctcacacctccctctcgtttctgtcagcatctctttgtcatttcattttgattagttgtttatatgtatctgcatatttgcaatcatgcaaacacatcagaagagatatttcagcactcaatttctagtttacttttaatccaccttatttaatacaagggtgttgagacagtgcacagaaatacgtggtacgcataggattgaaaaaaagaaactggcaagcaatggggaaataagtctaggagaatcagatatagtaaaaggtagaaactaaattaaattaaaaatgcatgatgttaacagcttgttccattacttgagttggaccataattttaattctgagaatcttctcagtcaaagaaaggtggaaaaacaaccccttgccaggctgtcaatgttacatttaaggtatttaaagattttttaacaatcactgggatgatgcaatcatgggattgtacatggcaagatttttgaagaggtaatgggatatcagctagaaactagaggacctttaagatctcttacaatgactgtgattttctttggtggtggtgatgatgattgtaaagtgaataattgtaaaagtattaatgtattgagtacttatgtcagccctctgctattgctttgcatatattaactcatttaaccctaaagcagctggaagaaagtactcttattatcttcattgcagagttgaggacagaaagaggttaagtaacttggcccccagctagtttgtgggaagatgaggagttgagctaaggaggttggctccacagccttggctccaggatgcctgattggtggtccatgcaccagcagcacccacagcccctgggaacctgttgcaagtaaagactctcaggccttacccaaacctactaaatcagaatcgctggagatggggccccgagtctcttgtaaccaaccttcctcatgcttctggtagacatttaagtgtaagaacaatgtctaagggatggcatattctaacacttctcaactgcctctgccatattaaaaatcatctgtctttactgaagaatcaccctctgtgaatttcaaaggccatgccgttttattgaactctaacctgttataattagaacatcacagaatctgaaaagccttttttttcctatttgtttttaacttttagagttttctttctgtatatctctactgacgtttctgagcaacttctcctcaggaatatttcgcccatccctgggtcttcaaggaaacagagatgcaaagtcctcagttccacttgctcatcctgagttcctaattgaaacttttaagaactcttccatgagacatttgattttcacaaaagccacaggagaaaggcaggctgtggagtgttaaaaccacacttcatacatgcaatgagaattctgcgctcccagtcctgaggttctgtaaaggatctgggcaaaagaggagacagtccaggagtgactctcacagattgaagcatgaagtatgatttttgtactagaagggtccctgtttataaagctgtgacacattttcttttttttgtttgtttgttttttgttttttgagacggagtcttgctctgtcgcccaggctggagcccagtgtcatgatctcagctcactgcaagttccgcctcctgggttcacgccattctcctgcctcagcctcccgagtacctgggactacaggcgcccgccaccacgcctggctaattttttgtatttttagtagagacggggttttgccatgttagccgggatggtctcgatctcctgaccttgtgatccacctgccttggactcccgaagcgctgggattacaggcatgagccaccatgcccagccgctgtgacacattttctaggagttgagtggcctctcacaccagaggctgaatgtcttgataaggtcatagagttggtgcagggaccacatcttttacttctgtgtatctttcatcctccaggcatagtatcttacctaaaagcagaagcctattcttgtgtgttacctggaaaatttatatctgccaccacactcagcattgtctgattgcatttaatgttgcaattaatcaatgagttatattagtccatggttattcactgcaatcaaaatataactccaaaaacttctgagggaaaatatcaggagattgaaaaagtatttcaagtgtcagtctcatctaataattgacggctataggtagaaatttgccaagcccacagtcattcactgtgagactagactgccacacctagttgaataggttattttgtatttctaattgtataacatgtatcaattatgtgcaactaattaattgtatataattattaattgtatataactcattgtatataattaattatacaattaaaatcaattgtattcaattaatatatactatacattaatacatgtatacattatcatttaaaaagccaaacagttcacataaagcacaagttctagtcactttcctcaatatttgtctccattccaaacctagtctgtgccctatatttaagtattgttattaatttgagtgaatcctaccagacatatacaaatatatgtatctatttaaatcaatatgccataagtggcacaaaaataaagattagcaatgtccatctcctgcagatattaattccataccttgtacttggtaaaacatttacttgcacaaatgaaaatattcaattatgctagagtaaatttacattatatagggatatctttcaaaaaagtttctctcctgttttgaatttcagctgtcttgaattgtcacttgcaaaatacttagggacgtttcttttttaaatcagctttaattattttttaatgacgagaagttgatagcttataaattccatttatctctttaaaatgctcattcatattgttttaaaggaagcaaagggtataactgccgcatagcttaagaaaaactttacagaatgcttatgggaaaataccagattatttaggccttttaatgtgcttaggtattcagttattacagggagaatgagggtttcttccttaattatagagtttaattctgaggtatatttgccatgagtttgaaaagaaccatgcttcaatagcacgcagaattcagattcacaaagttttcctctcgtatctcttcaagtgttttacactgtgcttcagagtttgcatgctttcttgcctaaaagcaaaagaaaacatttatgtagagaaagtacagtctctagacattgccaaaagattgtctattgaagatagtatcgcattcccactgtaagcacatcttcatgtttgaacaccaacacaatctttccttcttcctcaaaatagaaatacactgtgaccgaatatttattcagcatctaacaacatccaacatttgaatgtattttgactaggtaatttttttctcctttgttaataaaaatagatttaattttttaaatgtcatttttcttgcatctcatcaaatatactttcatacactataaaaatgatgttgggtcatatgtatcacatgtctgtaattcagaaatgcaaacctttggacactgactcaacatctggagatattttttctggttcttatggctggtgttctcctacagctctctacgagcagtcttgtgaagcccacaagcaccgagggaacccatccgggctttactatattgatgcagatggaagtggccccctgggaccatttcttgtgtactgcaatatgacaggtatgttgataatcgttagatgcatagatcagaatagaccaaggagaaatttacctagttggcagcattattaaaacatgcagtttgatagtgtgtacttgctaagtagaagcattaaatatgtatttattaattttgttgtcaacaaaattttcttgtatttcttctttgcctgggttggattataggcaagattcaatgctctgccaaggcatctctctagctcctacactcctcataatacatctgttcatgtgcatcatgataaaatacaaacctctgattcggtgatttacatgctttctgtatttagaaaaaacagaggtgtttaaaaatgctaagaaataacatagatatgttaatgttctatgtgcatcttaaataatttagtgatttttatgtcatataattttttcataaccaaagaaacttgattatttctcatgctttagatattagaaatgaacactgcttgggctgcgcatggtggctcacgcctgtaatctcagcactttgggaggccaaggcgggcagatcacgagatcgagagatcgagaccatcctggccaacgtggtgaaaccccatctctactaaaaatacaaaaattagctgggcatggtggcgcccacacctgtagtcccagctacttgggaggctgaggcaggagaatcccttgaaccagggaggcagaggttgcagtgagccaagattgcaccattgcactccagcctggcgacagagcaagactgcatctcaaaaaaaaaaaaaaaaaaaaggaaaaaaagaaatgaacacagcttgattatagaagattgcactagaacgccttttaaatagttacatttttacagaaatttgttgtcacctagctcttccaactctctgcaaagtggaaatctggaataaactgttctcatttattgtgctgacaaaaggtttcaaaagtttcataaatttggacaataaccaaatgggtcagcaagcatcaaggataaagaaacaaataactgaaattacatgggcatttaaagtgccttagcaaagattgtcaaaaaatagtaaaactttacaggggatgttcagaagattcagagccacctgcacagcaatgtgctgaagataaagaaacacaggcgttctgccataagataccaattacctccaaaatcccgactcaaacaatgaaagcaaagtgagaaatcccataaaaatggtcttggtggatatcaaaagactcaaccaaagtcacaaccaggaaggaccttggttgtcatcattttaagatgaggaaatcaaggctcagaaaagttggttagggaagtatctactgacaaaatctagctaatggtaggggaatcactaaactctggtctcttttctgccctagaaaatgtcaccttctctttagatgccgcattgctctatagccagtaataaattctctagttgtacaaatcaagcaataatgattataaaatgtgcaatttcaaactactctaatagcttgaaatgtatatatcgtaataaccttcaaaaagcagttgcttcagagcttggaagtcagcactctatcttaagaacaagtaaaaagccaggcaaactgaaaaattaaccaatttttttagatccagcagagaagtgaggtcacagaacaaaccactgcccctcaaaattggagagacaggcaggcttatatacagaatgacagttttcttccacaagcactaacctttggggaaaccgttgtcaaggtaggaaaacctaaacttaattgacgaattgttggatgtttgatgtggacacatctgagaattaaaaactccaggaagacccagacagagaaggatccccacacttctgtgagtttgacacctagcttgactgggttctcacagtgaatgttggagaaaaatctcctcatgcttccagaaagggaaggtgaaaaggaaccgtcttgaagtacaccagagctttctgttcttcttaacaaggtctttcctcaagggcaaatatttcacctaagctactggtgttttgttttcttttgttttgttttgttttgttttttgttttcagagcctaacctgcctggaggaaggaaattacccacctctggccatcctgtcccatgtaagggtggtgatgggagggagggctgagaagctcttgtgaaggtcacagcccagaggcacaggctccctaaaggactcagacctaatcacaggactacagaacctttccccttcccacacatgttacttatagtactgcaggcctctttacagcagttacagttacttttacctggtacatcacatctggttatcaagaaaaaatttcagctggacctataatcctattactttgagaagctgaggagggaagatagccttagaccagttttgagaccagtctgggcaacacagtgagacccccacctctgcaacaacaacaacaaaaacaacaacaaaacagcattgtgacaacaacaacaacaacaaaacagcatggtgacatgtatctgtagtcccagctacttgggaggctgaggtgggaggatcgcttgagcctgggagttggagactgcagtgagccatggtcacaccactgcactctagcctgggcaacagagaaagaccttgtctccaaaaaaagaaaaagaaaaaagttcaaggcaaaaaacacactttgaagagacagagcaagcattaaaaacagacggtggctcacgcctgtaatcccagcactgtgggaggctgaggcaggcggatcacgaggtcaggagatcgagaccatcctggctaacactgtgaaaccctgtctctactaaaaatacaaacaaaattagccgggcgtagtggcgggtgcctgtagtcccagctactcgggaggctgagaaggaagaatggcatgaatccaggaggcggagcttgcagtgagctgagatcatgccactgaactccagcctgggtgacagagcgagattttgtctcaaaaaaaccaaaaaacaaacaaaacaaacaaacaaaaaccagagtcagatatggcagggacattggaattatcagaccaggactttaaacaactataattaatatggaaaaagctgtaatgggtaaagtagatagcatgcaagaccagatgaacaatgtaagcagcaagatggaaattctaagaagcaaaaaggagtgctagagatcaaaaacagcataacagaaatgaagaatgcctttgatgggcttattagtagaccaggcacagctttggaaagaatccctaagcttagagatacctcaatagaaacttgcaaaactgaaaagcaaagagaaaaaaagactgaaccccaccccctgcaaaaagaaaacccagaacataatatctgagtacagtggcacaactacaaaaggtgtaacatacgtgtaaagagaattctaggagaagaaagaaagaaaggaacagaagcatatttgaagaaataatgactgagaattcccacaaattagtatcagacaccaaaccacaaatccaggaagtttagagaacaccaaagaaggagaaatgcccccaaaactctaccaggcatatattttcaaactatagaattcaaagataaaagtaaactcctttttttgagatggagttttactctcgttgcccaggctggagtgcaatggtacgatcttggctcaccacaactccgcctactgggttcaggtgattctcctgcctcagcctcctgagtagctgggattatgggcatgtgacaccatgcctggctaatttttgtatttttagtacagacagggtttctccatgttggtcaggctggtcttcaactcccgaactcaggtgatccacccacctcagcctcccaaagtgctgggattacaggcataagccaccatgcccaggccaggtaaaagtaaattcttaaaaataatcagaggaagaaagcaccttacctacataggagataagtattacagcatcttctcttcagaaatcatgccagcaagaatgcagtgagatacttaaagtgtgaaagagagaaaacaaaacaaaacaaaaccttctccttgaaaagtgaagaaataaagattttctcagacaaatgaaagggtcagttctctaaaagagataaccttaatatgtatgctcctgacaacagaacacagtggatcttattttcttttttcttctgggacatataggaatgggtataccagatgctggggatttcatatgatatactgagtaaattttaagtgcagacaatccccgtttacagtagttctacttacaatattgcgacttccctatgtgaaaccatatgcatccctatttcaagtacccatacaactattattttattattattattattttgagacagaggcttgctctgtcacccaggctggagtacagtggcacgatctcggctcactgcaacctccacctcccgggttcaaatgattcttctgcctcggcctccccggtagctgggactacaggcatgtgccaccacgcccggctaattttttgtatttttagtagagatagggttttactatgttagccaggatggtctcgatctcctgacctcgtaatccgcctgcctcggcctcccaaagtgctgggattacaggcgtgagccaccacgcctggccacaaccaatattattatttttttttttactctcagtacagtagttaataaatgacatgagatattcaacactttattataaaataggcattgtgttagatgattttgcccaactgtgggctgatttaagtgttctgagcacatttaagttaggctggtttgagctaggttcagtaggtcacatgtattaaaatgcatttttaatttataataagttcatccagatgcaacttcatcataaattgaggaacatctgtactgttaattccaatcaaaatcatgagttaaattagcttaattttcaaagttggatatttatttgagcaacaggagtggaacagggatcaacgtgttacagttaccctccttctgggctagtgagacagcctccagtgtgttctgactcagccacacctctgaacccctttccacatttagccactgttataattaatctactcaggtccaattcacttgagcccaggaggtcgaggctgcagtaaactatgaaggtgccactgcactccaagctgggcaacagagggagaccctatctctaataaaaaagaaaaagaaaaatataagggttatattagatgctctttaagatcctttccagttccaatatgcttataatcaattgaaataaattatgagcaattagggaaaccacaatggtctgtgtccttctttgggtcttttactactgatattataaggagaagtgagtcaagtggaattttataaacacaaatgcatatcctataatgtccctggttactattctactcttcagaaaaacaagttttacagatgtattctcaacagttcccttctcagtactgagggcatttctgtgattacatcttaaccatgggtgactgcaaatctatcatactgcccaccagcctatgtgaactactccggaccatcatttctctcccattgtacaagaaatcatgaacacatggccaaaaatggcatgtggttgagcatcttcaatgcccaacttagtgttccataggtttttctatatttgattcagttgataggaaaactctgaaggtgagagtaggtgatgtgcacagagtaacaccaggttgtaaaaattctaaaatgaggccaggcgtggtggctcacacctgtaatcccagcactttgggaggccaaggcgggtggatcacctgaggttgggagttcaagaccagcctggccaacatggtgaaacccccgtctctaccaaaaaatacaaaaattagccaggtgtggtggtgtgtgcctgtagtcccagctacttgtgaggctgagacaggagaactgcttgaacccaggaggcagaggctgcagtgagctgagatagcgccactgcactccagcctgggcaacagagcgagactcttatctcaaaaataaataagttaaataaaaaatctaaaataaaaaaatagagcaatattaaaggaagaacccatggaattgaaattaccataggcacacttagagcctcctttggtgagtacagtgagtggagtgataatttaatttaaaattgcattcgttatttaaatttgcagatttttttctgtacttgtggctcatttgtgggtatcacacctttgctctccatgggttctgtgactaaagagatatttcagtagcatggctggttttcttttccttctttcctctgatctctgttgttaggcgtgtgtaagtaacagtaaggctgtgaaatttgtcttacgcacaagccatttagccatttagcagccaagccattaaaaatcctgagatgtgaagggctgggagggtgatttctcaaggtaaaatgtatcacattgttttgtttcgtagttcttaaaaaatccccatacaaatgtttcttcgtttctccagttcggaaaatttttatgtaaaatgtccattattctaaatacatcttattagaggttaaaggaccagacagcaccagcatagtagaattaaagtgacttcaagtctggtgggaggtccattgttgggaacactaaagaactcaagatgcacttcttcccttttgagattgtggagtcattttgtttttatttcatcaaaacaatataagtaatcaagtgacagagatacatcagaaatgatgtcagcaggcagtcagatgctcagggtcaccgcctggaaagtgctgttagaagctcaaggcctctgattcctctgggcttggtcactgatggagaagctgacataattaaaccactttattttaatagagctgcttcctatcatacctgtgagtatgtgcgtcacatcgtcccaatatgtatcttttataaatttattcgataatgaaagaaatagaggcacatacagatgaggaaaatgcagatgagtttaaaaagataaaggtccaggtagtaacagtttggccccatgcttgtgttgatataaaaaaatggttttaacaactaaaaagtcattgcttacatgatacatttttaggcgtgacgtcgcaaaagtttggtcatcagttcttccaatatgctttctcttagaggctgagttctggctcagtacattgttacacaggtccaactcctcaaatcgcggcaaacatgcagtaatgtaaatttcaattaaacgttaattcacataaaaggtctgctttgcctcttgctgctggcgtctgccgcccagtgatgcctctcctttgcccgtttctgctcagcagactccgcgtggacggtggtgcggcacggtggccccgacgcggtgaccctccgaggtgcccccagcgggcacccgctctcggctgtgtccttcgcgtacgcagcgggcgcggggcagctgcgggccgcggtgaacctggcggagcgctgcgagcagcggctggctctgcgctgcgggacagcgcggcgcccggactcacgaggtaagcgccactgctggaggctacaggggctcacgaggccggggcgcggccctcgggctgcgagatgcctttgagggagaaaaggccagggtccctcccgtggctcttagttcaaagccctgaccgctctctccttctcttcccgctcttggttggaccaaagagcattcaagagcgccttcctgaccgttgagagacgttcagcgcgttcatatgcaggactagtgacttgtcctttcttaatcaagggaaattttgctaataacttatgccttagctttccgttcacactgaggagataatggctgtagggcaggctgggtctaacagttcttcatgaagaccagtgggaaccggtaacctccttactcttctcaaagtcttcctctaaatctacttggaacctttgtttcctccctttagattaactgaatatgcccttcctcagccccgccactttcactgtggtctaggatgaaataatgactagggttattaaaaccttttgtcagtgggtgtctcatttttttgaaattatatcttgagaaatgtataccttaatcttcatatatggaagtaatgttttggaaactctgcctgcatcaaaaccgtcttctcctaagttaaagaccaacttccccctcctttccggaatccccacagtcccctgcaggactcaccgctgctctccaacagtttccatatagtttcttgaaagcactttattgctaattatagttaaatactgaaatttacctttcatttttttagttttagcaatcccaaatagtatataggcgggaggatcactggagcccaggaagtccaggctgcagtgagctgtgattgcttcactgcctccagcttgggcagcagagcaacaccttgtcttaaaaaaacaaaaacagtgtatgtcggtagcataataaagccacttaaattaaatttcactcttaaattttcaatacaaaatctttaagttggaaagtggtgtatgactgtcatctgaaggtggtttgcgctgatccactaacccatacctgcattgccttccctagtccgtctggccaatcagcccctggaatatgccagaccatttcctctgcctggattgacctctctgtcacccaggctggagtgcagtggcacgatctttgctcactgcaacccgctcccctcccggattcaagcgattctcctgcctcagcctcctgaatagctgagaatacaggcgggtgccgccacgcccggctaatttttgtatttttagtagagacggggtttcaccgtgttggtcaggctgttcttgaactcctgacctcaggtgatccgcccgcctcagcctcccaaagtgttgggattacaggcgtgagccaccgcgcccggccctcacactcttaaatcttacccactgtgctagacctgtgcagtcggcatctgggtcccttcccagggtgatccctctctcccctggatgcctgccagccaatttggtctagtagaaagagcaaaggtctggttgcattcaaagtttgaagttcaagtgctaagtctgtcacttagcagttgtggaaatttaggccattccttaatctttctcagactttgtttcctctttgatgaaatggaccctgtagtactgatctcatggggtttcttttataaatgagatatcttacataagttcagtaagtaagaaactctccttcccagttctccagttttttaaagttggcattacaaaacttaattatttgttagttcattgctgttgaatgaagtgtagccttggctttggaatcgtttaaaaaaaaaatccccaggtgatcttttggaaactactgggctaggggctaaaataacacaagaaatggaatattctactcccatcagtgagaatttccctatttctcctcttttgaaaagataatttaaaaaaaattttgagataattgtagatttacatacacttgtgagaagtaacagagagaacccgaatagccgttaagcagttcccccaccccaaggtgacatcttgtagaagtatagtgcaatatcacagccggaatcttgacatccatacagtcaagatacacagtatttccatcagcacaagaattcctcctattggctgggcacggtggctcatgcctgtaatcccaacacttcgggaggccgaggcgggcggatcacgaggtcaggaaatcagaccatcctggctaacacgatgaaaccccgtctctactaaaaatacaaaaaagtagccaggtgtggtggcgggtgcctgtagtctacttgggaggctgacgcaggagaatggcgtgaacccgggaggtggagcttgcagtgagccgagatggcgccactgcactccagcctgggcgacagagcaagactccgttccgtctcaaaaaaaaaaaaaaaaaaaaaaaaaagaattcctcctattgctctattgctcgttaataaccactagtatgttctccatttctatgggtttttttaaacttcaagaatgttatgtaaatgaaattatatagtatgtactctttgtggttgagtttttttcactctgtgtaatcctctctagattcatttgcataattgtgtatatcagtaatttgttccttttcattgctgattagcaatcggtggcatggatatgccagagtttattcactcattgaagggcatctgggttgtttgtttacagtttggggcaattatgaataaagcttttatgaacattgtgtacaggttttgtgtgaacattagttttcatttctctggaattaatgccccaaagggcaataggtgggtcatatatggtaattgcatacttagttttataaaaagctgccaaattgttttctagaatggttgtaccattcccaccaacagtgtatgatttcatttcctccacatgctcatccgcatttggtgttgtgactattttttattttagctattctgataactgtgtagtaatatctttattgtggttttaatttgtgtctccctgatgtctaataatattgagcatgttttatatgcttatttgccatctgtatatcgttttcagtgagatagatgtctgtgaatgtttttgttgttgttcattttctaattggattgtttggatttgttttgttactgttgaattttcagttctttatatattctagatactagccttttgttggatatgtgatttgcgaatattttttcccactctgttgcttgcctattcatcgactcttaactggaattttttagagcaaaagttttaattttgatgagattcagtttatcatattttccttttatgggttgtacacatcgtgtcaattctaaaaattctttacctaaccctaaattccaattccaaagatttttgaatttttttcctaaaagttttatagttttaccttttacttttaattccatgccctattttgggacacattttatataagatgtgagagttgattctctctcactctctctgactatgaatgttcagttgctccagaaccatttgttgaaaaggctatccttcctgcattgaattgcattttaaatagtgttaaaaattggttgaacttacttgtgtggtgggtctgtttctgcattctttatctgtttcattaatttatatgcctccaccaatatcacactgtcttgaacgtggtagctgtgtagcagggttgagttattcctcctgctttattcttctttttcaagattgtttaagtctgtagcttgcctcattctgtataaattttgtaataaatttgtttatgtctacaaacatcttgctagaatttttatgggaatgacattaaacataatagctcaatgaagggaaaattggtgttttactgttttgagtcttccaatccatgaacatgagatatctttccatttatttggatctttgatttcttgcctcagcattttgtaattcttagcatccagagattatatgttttataagtatgcttaggcatttagttagtttcttgattgattgtaagtgctgttgtgctttaaatttttgtttacatatgtttcttgttagaatatgaaatatgattgtttcatactaatcttataagctcttttttgaacttaatatttttttagattccttgggattttctatatggaaaatcatgtcatctgcaagtagagtcagctttatttcttcctcgtcaatctgtagggagttaatttatttttcttgctttattgcagtagctagactttcaatactaggttgagctagagtggtgagggcagacatccttgccttgtttcctgtcttaggggaaaagcattcattcttgtttcctatgttatgtggaggtagttcccttttattcctggttggctgacagtttttattttgaaaggacattggatttttgtcaaatgtcttttctgtgtcaattggtattaaaatattatatttcttcttttgtctgttgatatgttgaatcagctttgcataactagagcaactcccattttgccataatgtataatttaaaaaatacatttctaatgtgtttgatttattaatattttattgaatatttttgcattcaaattcataagagatattgatatgtagttttcttttttcatattgtctttatctggtttcagtatcaggacaatactgcctacataaaatgaatttggtagcattctctagtctcctgttttctggaagagattatgtaaaattgactttaatttttatttaaacatttggtagaattctccagtaaggcccggcagggtggctctgtgatcccagcactttgggaggctgaggcagatggatcacttgaggtcaggagttcgagacctgcctggccaacatggtgaaaccccgtctccactaaaaatacaaaaattagttgggtgtggtggcacacacctataatcccagctactcaggaggctgaggcaggagaatcgcttgaacttgggaggcagaggttgcagtgagccaagatcacaccactgcactccagcctggacaacagaacgagatttcatctcaaaaataaaaaccaaaaccaaaacaaaacaaaaagaattctccaataaaaccatctgggccaagagattttttttcagtaattttaaattatgaattcaattttcttaataattacaattacttaaattacctatttcatgttaggtgaattgtggtagtttgtactttttgagaaatttgtccattaatctgaattgtcaagttgatttgtgtagaattatttgtagtattttcttattattcgtttgatgtctccagcatctgtagtgatatccacttaaatttctcatattcatagtttgtctcatctttttttgtctgtcagtctttatagaagtttttcaatcttactgttttttagaactagattttcgtttcttgattttctctattatttttgtttcaaattctattgaaatctgctcttctctttgttatctccttccttcagcttgtatgagttaattttgttttctagtttctagaggtaagaacttacattattggctttagggctttcttctttcctaatgtaggcatttagtgctacgttttccctatcaacacagttttacctacatttcacatattttgatatgttgtattctcattttcatttagtttttcatgtagtttcattttcatttaagtattttaataaatttctttgaagcatattctttgacctgtagcttatttagaagtgtattttaaaaaatttctaagtgtttagagattttctttttctctttctggtattgatttccagtttgattccattatgcttagagaatatactttgtgtgattttagttcttttaaatatgttgaggtttgtttggctcccagggatatggtctgtcttgtaaatttttcatgggcatttgaaaaaaaaatgtatattctgctattcttaagtggagtattctgtatgtatttcaatgagatcctgttggttgattatgttgttcagatcttgtatatccttgctgacttcttgtccagtagttctgtcagttgctaagagagacattttgaaatctgtactataattgtggatctgtttatttttccattctgctccatcagttttcttatattaataggctttatattttttagcaattttaagtttacatagaaattgagcagaaagtactggaagcatatgatttttattctttagtttgttgatctgatggactatattaattaattttcaaatgttaaaggcatatctagagtaaatcccacttggttgtggtgtttatttttaaaaattgtttggttcaatttgctaatattttttaaggattgcttcatccatgttcaagggagatatttgtttgcagtttacttttttgtaaggttttgctggtttgggtattagggtaatgctggcccatggaatgagttaagaaatagtcactctgcttctattttctgcaacagattgtggaaaattggtatcatttatttctccaatgttgatagaactcaccagtgaatcatctgggcttggtactttctgtttgggaaggttattaattactggcttagttaaaaaattttgtttctcttgagactttctctttcaccatgttttattatttagaaatgtgtttttaaattttttggtatttgaggatatttcagctctctttctgctattattagtttaattccattctgattcaagaacatgccttttgtgatttctattcttttaaatttggtaaagtgttctgtggcctagaatgtggtttaacttaatgaattgtgcatttgtatttgagaagaatgtgtattctgcagtgtctagataaaatattctataacgctaattgaattctaaagtattcagttagatccagttgattgatggtgctgttcagttcaaatctatccttaatgattttcttcctgctgagtctgtaacttactcatagaggggtgttgaagtctccagtggtaataatggatgtgtctctctgtccttgcagttctatcagtttccccctaatatattttgactcttctgttgctaggtatatacatattaagcattattatatcttcttgttatattgacccctttattattgtgtaatgccctttttcatctctgataattttccttgctctgcagttggctttgtctaaaattaatttagatactctgtctttctttttggttagtgttaccatggtatatctttctctagctcttcaaatctacccgctattttatatttaaagaggatttcagtagacaacatgtaggtggatcatgggttttgttgttgttgttcactctgacagtctcagtcttttattttattattatcataccttaatttctagggtacatgtgcacaacatgcaggtttgttacatatgtatccatatgttaatggtgtgctgcacccattaactcatcatttacattagctatatctcctaatgctattcctcccctctccccacaccccatgacaggccccggtgtgtgatgttccccttcctgtgtccaagtgttctcattgttcaattcccacctatgagtgagaacatgcagtgtttggttttttgtccttgcgatagtttgctgagaatgatggtttccagcttcatccatggccctacaaaggacatgaactcatcctttttcatggctgcatagtattccatggtatatatgtgccacattttcttaatccagtctgtcattgatggacatttgggttggttccaagtctttgctattgtgaatactgcctcagtaaacatatgtgtgcatgtgtctttatagcagcatgatttataatcctttgggtatatacccagtaatgggatggctgggtcaaatggtatttctagttctagatccatgaggaatcgcaacactgtcttccacaatggttgaactagtttacagtcccaccaacagtgtaaaagtgttcctatttctccacatcctctcctgcacctgttgtttcctgactttttaatgatcgtcattctaactggtgtgagatggtatctcattgtggttttgatttgcatttctctgatggccagtgatgatgagcattttttcatgtgtctgttggctgcataaatgtcttcttttgagaagtgtctgttcatatacttcgcccactttttgatgaggttgattttttcttgtaaatttgtttaagttctgtgtagattctggatattagccctttgtcagatgggtagattgcaaaaattttctcccattctataggttgcctgttcactctgatggtagtttcttttgctgtgcagaagctctttagtttaattagatcccatttgtcaattttggcttttgttgccattgctttcttaattggtatatttagactgtttacatttaaagtgattattgatacttggattaatatttgccatattgtaactcttttttatttgttgcccttgtttcttctttttttcctgaattcccctctcacattttttgttttaattgagcattttatatgattccatatcctcacttctcctagaatattaattacatttcttggtaattgttttagtggtagcctttgagtataaaatatacactataacaatctactttcaaataacactattccacttcattaatggtgctggtactttataacacagcatttccaatccttctgtcttattttgtattacattattatcattcattttacttattcataagccataatcacccaatacattgttagtattatttagagctgttacctattacatcaattaagaagaagacactagattttattttaatttttttcttctctaatgctcctacctttctttatgtatttctgtgtttttgacctatattgtttttcttttctctgaggaacttctattaacatggcttgcaaggtaggtctactggagaaagatttcctcaattctgtttatctaagtctttatttctactttactatttaggataattttactggatatagaattttatattagtgtgtgttttctctcaacagtttaaatatttcacttcactttcttcttgcttgcatggtttcttaagggaaatctggcataattctcattcttgctcctatgtaggtaaggtgttttattttactctggtttatttcgagattttatttttaaaagattttattttaattttaagaaagtcttcaattttttgcaatttgaatatgagatgcctaggtgtggttttttttgtatttaacctgcttggtgattgctgagattcctgaacctatggtttcatgtctgtcattaattttgaaacattctcaactgtcattattttaaatatttcttctggttctcactctcttccttctacttctggtattccgattatgggttacataggttacaccgtttgaatttatccaacagggctgggcgcggtgactcacttgcctgtaatcccagcactttgggaggccgaggcgggcggatcacaagttcaggagatccagaccatcctggctaccacggggaaaccacgtctctactaaaaatacaaaaaattagctgggcgtggtggcaggcgcctgtagtcccagctactcgggaggctgaggcaggagaatggcgtgaacccaggaggcggagcttgcagtgagccgagattgcaccactgcactccagcctgagcgacagagagagactccatctcaaaaaaaaaaaaaaaaaaaaaaaaattattgtccaacagtttggatattatgtttcatttttcattctttttctctttgtgtttaatggaaaattttcattgacgtatcttcaaactcactgattctttcctcagcacttcccagtcttcccagactttgatgaggccatcaaagacactctacaatgtttacttttaatctctgtatttccttctgattttgagatttcatatctttgtttatagtacctatctcttcttgcatgttgcccactttttcaacatagagcccttagcatattgattattatttcaaattccttatctgatatttccaaatctgtcataactgcatgtttgcttgattcgtctcataagactgtattgtttggctttagcataccttgcaattttctgttgaaagccagacatgttgtattggcaaaggaactgaggtaaggaagcctttaatgtaaggttttatgtttatctggttagtagttaggctgaatttgctctttgcataactgttgtgtcagaggccaaaatttcctctaaggttattttatttttctttcttccgttttgagttttcccagagactctgtcttaaatagggtctaaaattgacagctctttcatttttaatctcctgttactatacaggtaatgtactgatctgattgatgataaggtgcggggagaggagaagcatcctatactcttttttttttaatgtttttattttattttaatttttttgagagagtctcgctctgtagcccaggctggagtgcagtggcgccatctcagctgactgcaagctccgtctcccgggttcacgccattctcccgcctcagcctccccagtagctgggactacaggcgcccgccaccacgcccggctaatttttttctatttttagtagatacggggtttcaccatgttagccaggatggtctggatctcctgacctcgtgatccgcccgcctcagcctcccaaaatgctgggattacaggcttgagccacctcacccgacccaattttttgtatttttagtagagatggggtttcaccatgttagccaggatggtctcgatctcctgacctcatgatctgcccgcctcggcctcccaaagtgctgggattacaggcgtgagccaccgcgcccggccagaagcatcctgtactcttaggattaggtcagtcttttagagaacctgtcttcctggactgtgaccttcagagtgcttctcagcttccttccccttcccttgggtaagaaaagaagggtagagggggctggttctgggtatttccattcccctaggtggtttaggctctagtaaactagctttttgggggattagaatgttgttaaggagaacataatgttcagcgcttatttcaaaaatgttttctccttccctccccctgctggagacataagagcgtttttttcctatctttattctgagaacttgatggggctcttcctggagataaaactcttgaaggtgtgttgaccctctaaggcgtatcccccactctaggagttttcaatctctgtagcttgtccttgctcagtatccatcaattagtcagttacattttaagtgcttttaccagactccaccatctgctttggcaccattagccgtgatgctgttttcagttgtctctgcagctttaggagtaatgtttgccctatgactttaactgtgtaagaagaactgtttatttttagttagtgcagcttttttcttgttgtgagaatgggagcgatgacttccagactcttaatgtcatatcagattggaaaccagaagtctcaatttttgcctcatttttttaagggtgtattgtttcttgcatatgcatttatgtcttcctggtgatttttttttaaatcattatgtaatgtccctgttctagtatttttgttctgaagtctattttatgagatagccattctgctttctttcaaatttaagttttgcagagtgtattttttccatccttttacttttaacctgcctatgtttattttgaagtgagtttcttataaatttctcgttgtgttatttttttttcagttgattctgccagcatctaacttttgttatattttaaccatttacatttaaggtaatttttataattttcttactcgttgcttggtattatagtgtacatatgtgacttaccacagtcaacttaaatatcttcactctcataatgaaatatggaatccttatgtctatttgggtcctttatcttccccacttctaaatatcattgtcttgagtatcatatggtattacagtttttgtgtcaattatcatatatcatttcaaaaattgataaggatagtctattatatttatccatatttcttctcttttcatttttttcctgatgttccaagaatccttcgttataatttctttttgaaaaacctcctttagccattctttagggaatgtctgctagcgacaaattattttagttttcttttgtgttaaaaaggttttttgttgttgttattgttttggagatggagtctcactctgtcgccctggctggagtgcagtggcacaatctcggctcactgcaggctccgcctcccgggttcacgccattctcctgcctcagcctcctgagtagctgggactacaggctcccgccgctacgctcgtctattttttgtatttttagtagagacggggtttcaccgtgttagccaggatggtctcgatctgacctcgtgatccgcccacctcggcctccgaaagtgctgggattacaggcgtgagccaccgcacccggcctaaaaagattttatttccatttttattcttgaaggatagtttctctggatatataatttatagttgacaattcttttctatcagccctgaaaaaaaatatgccattccttctggttctgtaatttcagatgagtaatctactatcattcaaattagggttcttttacaggcaggtaatgtgttattctctcaggctgctttcaagatttgttttgttttgtttccaaaaagttcaattatgatggatcttggtgtcgatatttttgggtttatccttttttggacttaacttcctaaatctgtgggtttgtatctttcaccacatgtgggaagtttacagccagtattttttcagtactctttcagcacactttgttctctctttttgagattcggatgatattgtctgataggaccctatggctcagttctttttatattccgtctgttttctcttttttggtcaggttagataaagcctattggtgggtcctcaagttcagtgattctgtcctgtgtcttttcactctattcttgagcccattcagagtttttttaaaacgttatgttattgtatgttccagtcctggggtcctaagcttcctctttctacttttcagaattctcttcggttgtcttctgtattatttccagaatctatcattatacttggtggaaatagcagggatagacaagtctacaagatcttttatcagtctagaagttcacccacttacatctttttgttactgtttctaaaaaaatacatttttactactttatggggaatatgggagatttagatgtaaatttacacttgtacattaggatataatgagtgttttgctctttaatctgcgacagtttaatggtgaagtcggtaacttttaaagtggcattccgagaagagtgtattaatttttaaaaatatcttttacgttgtagtgacaagcttttagcacatttttaaaagattcctggtactaatccctctttaaattttcccagattgcctttttttcgttgttttttttgttttttggcagaggggcaggtgatagatagtggtggtggtaatgaatgcagagatcttatctatgaatgagttataattgagttgtaataagcagtaaggtagaagctaagttccagatctcgattcatattccaatggtaacaacctattgaaatttgaaaaacagcaccacatgatcaagcatgtttaaaaaactggttgagttaatccaatttcattttcctcatggcctaatctgtgatgactgcaacttgtggcctctgacccctttccttttttaagataggtggcctgacacctgctttttaaattatcctaactttactgtgatgtgctgtcagtccatcaccccaatcttcactcccaacccctggcagcatcccttgtcctaatatgcagttctatagatctgagttagtgtctgactctatcatttaatcattgtcagtgctgagaaggaggcgcactcgtcagagctgtagttgacccagggcactttgtttcttcgcatgagaaatttctaacctcagagatgagaaaagcctatcaatgtcattccttaacctccaaataaagagtcaggacatccaatgcaataaaaacaaatacctccaaaaattagtaagtactgacagagaataccatatctttccaaatgtgtaatatacaggtagttagcaaaaagatgggatgagataaatcaatgtctttgtataatattaaactttctcaatgaacatttcataatttcaaatagattttatctttagtgtgcaaattaccctggtattaattttaatggtgaatttttttgaatgttatttctatagaaagtatgtatcacgtgcaactgactgatttctaatagaagaaaaatagatggaatcatttaagcctagatattgaaatattgggggaaaaacattggttaggcttaaagaaacgtttcagaggtaaaatacaagtgtttaagtatagtttcattttctctctctctgcctctcacacatacactttacacctgggagtaaagggagatatatggggagggtgatagtgagggacaaagtagatgtcatctttcttatacttgtctttcagatggaaccccactgagctggtgggttggaagaaccaatgaaacacacacttcctggggaggttctctgcctgatgctcaaaagtgtacttgtggattagaggggaactgcattgattctcagtattactgcaactgtgatgctggccagaatgaatggtgatttccacatgatttccctgcacaaaaatgtggtttttattctttaattatgcatagttaattaaatgtcagacaagctggtacaataaggtaactagattaaagtatgttcaagcaagctgaaatacaagttttgatgaaatatgatcagttaatctaaggattaaattttatgaccaaagatttactaattcattgtgaatactatataatgtgttttttatttttcgtaaaagagaagcagctgttaagttttccactcactggaaatcaaatatcattctctgcgaagtttagttaattaattaacgtagtattcatgtggcaattcaaaaagcaaattcctccaaatctttgtcttaaattgatttgggatataatgctgcatattctgtctttcttttagaaattaacattaacacaagaaactctgagaggtcctgcataaaaggactgtgtttattttttagaagcaacaatttcccacactcattgaaatctgcagtgcaatagcaaagcttcaagcaccaactgttctgtagaccatactttgaaacaactaacatagaatttccggaatttgaaaattattttgtaagctttcttttgagcagaaacaattttctcatgtagattgcaatgcctctttttcagaagttctttttgaggttattcttgaaatgcatattggttttctttttttttatttgtaatatgtaaatgttttcaacctttgggttcatgtcagcaacttaaaaagcattgtcataaaacaactagatcgtgtagagtacgtgctttaaaaaaaaacttaggccaggcactgtggctcatgcctgtaatcacagcactttgggaggccaaggcaggtggatcacctgaggtcagaaggttgagaccagcctggccaatgtggcgaaaccccgtctccactgaaaatacaaaaattagccaggtgtggctgtgtgtgcctgtagtcccagctgctcaggagggtgagacagtagaattgcttaacccaggaggtagaggttgcagtgagctgagatcgcgccactgcactccagcctgggcgacagagcaagactccacctcaaaataataataataataataataataataaattaataaataaaaaatgtaatggtcattccaggtgtcagtataattgatttggacataaaatagctaatctaagcagtaatttgattcctaaaaattgagttgtttggcctgcatggtagtccacttatttatttggcataaaaagtctactttgcatcactttaaaaaatattgtgaagttgggaaaactcacttgaatctactggagctttctatagaatacatactatacatttacatggatattatttttaatcttcctcaagttcaaaattacaaaatgatcatacagatttatgagacactctttttgaatattttgatatgcaatcttaatacaactttctcttacttaaaaatgaatgcagttttagtgcagtgagtaacaggaacagatctgatccatagtttcaaatctggccaccagtaagtttcaggtctgaagtaatttgccgtcagttaaaatggttttgtaccatattttgtatgatgtacattttaaagtgtctggtatgataatgtgatgatgtgtgttagctttgggctctaatgagacaaacagcgaccttcaaatcttttgacggacatctttaacaatcctagaggttttcatttcctccattccacaaggggctcctgcctgtgagggctccagccctccagctcctggctgttcagaagacctccagctcattggtctgtccccacccccattctctacaggtcagaaaggagagcattggcaggttattacaagaaagccagaatggcatatatgctagtggctttataacttagttcgaagaatgttaaccgttttgttttgtttttgttttgagacagagtctctctctgtcgcccaggctggaatgcagtggtgcgatctcagctcactgcaacctgcgcctcccggattcaagcgattctcctgcctcagcctcccgagtaactgggattacagccgagtgccacacctggctaatttttgtatttttagtagagactgggtttcactattggccaggctggtcaactgtttttttgttacagaaccttctgttagtattaagtgcatactttattgtagacttcacgtatgcttagggcagtaaccagaggaacgtatcacttggagccacctgtattgagtgaccctcccatgaactgagtttgaggaggggatgggaggaactgaggtgggtgcaggtcctctgatacccttagccatgtcacttcagcaccgtcaaggactgcactggtgtgacagaagccctgggctttcatttggaaaaaaattcaggagagaagcaggttttaaaaattaactcccctcctacattcagaagggagcattgtggagtcatttgctttttaaccttattttatttactttgcagcttccagtagacaggtctatccaacagtaagaccacaagcattctgaaatcctaacccaactcttgtagattgttttgtaaatgtgggggtgtgtatgggggtgggaaattacaatttctattttaatttttcaaataaaattgatttttcagtttataaaaatggaatttaccagtctcatgaaatgaaaagatttataattgtaataatttagattaaggtgtagacataagaacataaatcttagtctttattacttattttctattactgaggtgtgcttagtaaagttttcctggtggaaagtttataataaaaatagtatttgggaatgaaagtaaagtgaaagctattttaagtctcttcaggcatatgtccgttaatggggcaggcagtattgttaatataaaccatcgccatttttccataagttgtccctgtaatcagcaactcgtctaagcatattacttaaaaaaaagtttatgatcagacagttcctcaggcacagtaagaatattctatcaaataactataacatgccaaagatttattataaaaacatatatttaaaaggcactataatgatttaaaatattgaactatgctgcaagtcaatatatgtgtataaatgtatagtggactatgttcaaatagaccaatatattctctaaaatatacatataacatataattcagctgtctgcaaaaatccacaagttgttttgctaatataatgatgacacatgtaactgtaatattattttacttaagaatttaaataggacttttgtgtgattatcttagagtctttaaaagtaaccacaaataaaaagcataaaataagatggtttaaatgcatactagtgtacaaataatcataataaatacgagtaaactctgttcatttaaaaaccagatattagattttatcatattggatttttaaagaagctatagcttgtttacaaaagataaaatataagcactcggtgaagttgaaactaaaagaatagaaaatatttaccaagtaaatacaaatcaaaagaaagcagatatagctgtattatgtcagacaaagatgaaaagcattgttagggataaacttgaactctatctaatgctgagataaactcactagaaagatctcactacacttgtgtgtatcatcagattgtttaaaatatataaagaagtggcagggcgccgtggctcacgcctgtaatcccagcactttgggaggccgaggcgggcagatcacaaggtcagaagatcgagaccatcctggctaacacaggtgaaaccccgtctctactaaaaatacaaaaaatattagccaggcatggtggtgggcgcctgtagtcccagctactcgggaggctgaggcaggagaatggcatgaacctggaaggcggagcttacagtgagtcaagatcacaccactgcactccagcctgggcgacagaccaagactctgtctcaaaaaaaaaaaaaaaaaagtatgtgtgtgtgtgtatgtatatatatatgtgtgtgtgtgtatatatatgtgtgtgtgtgtatatatatgtgtgtgtatatatatatgtgtgtgtatatatatatatatatatatatgtaacaaatatgcaaaggcaaattgacacccaaaacagtggaataattaacataacatttttgggaatgagtaagtgaagcaggtaagaatattttaatattataattaacaaacttgatatagcagccatatatcgtttagcaaggaaaaattatttctttatagaatgtattatacattattgttgaataagtataaaaaattttgtaaatggatggaatcttaacaaattttacggaattgtcatgatggaaactatattcttaactgtaatcaataatgaatatataacttttaaaagctcatgcatgtgtcagttaaagacacaagaggaaataaaatagatgtaagtgatgaaaagtttggaaaagaaacaaacctggcagatattgtagataatatgattgcctacatagaaaatccaaaataatataaagaaatatcaggaaaaatgagagttcagtaagtttgctgaatttatggtcagtcagtattgaggaattacttgaatttctataaaatcgtaaaataattaccattacacacctagaaaaattttatttgcaatattaacaaaaatgtaaagttctgtggaataactgcagtacttttatggaaaaaattacaaaacttattcaagagaattaaggacagccaaataaatggattgactcactactgtcgtggatagtatgactcagtatcttaaagcagtagttctcaatcgggggtgatttcgactcttgggacatttggcattgtctgaagacatttttgtcatcacacagagaggaaggttgtttatattagtgtctattaattagaaatcagggtgctgctgagcatcctacagtgcacaggacagccccccccatgacaaaaaaaaattagcccaaaatatcagtaacgctgctgttgagataccctcttttaaagttgacattctcctcaaattagtctgtaattttaacaaaattccaaaaaatgccaagtgtttttacttgtgtggattgcagcaacctggttttaaaattcatatggaaattaaggatgaaaggataagcaagataatttttaagatgaaaaataaagtgaagaaactagttctgttagctgtcaagacatactgtattgctgtagtaattaatgcaggttgaactggccagaagataggcaattaaacagaaactgagaatctagaaattttttaagtgggttagatgtggatcataatgattttattattgctgacctactcccccaaaataatcattaacagttgggctgggcgcggtggctcacacctgttatcccagcactttgcgaggccaaggcgggcagatcatgaagtcagaagttcgagaccagcctgaccaacatggtgaaaccccgtctatactaaaaatacaaaaattagctgagcgtagtggcgcacgcatgtaatcccagctactctggaggctgaggcaggagaatcgcttgaatcctgggggtggaggttgcagtgagcagagatcacaccattgcactccagcctgggcgacaagagtgagactctgtctcgaaaaaaaaaaaaaaagaagaaaaaaaagttaaaaagttgactcaacatttctcccttttagctttctttgcaacctcccaaacttatggctctactttgccttaaataaagttccctggcaaataataagtagtagcttttagaagttttcacacttcctaggaaagtacaatttccagaaccgtaggaatttctaataaataaaaattttaataaaatataaaataaaagcaaaaagtctttgaaagttctcttactgaatttttaatactgctccaagagattatggtacctatgaaagcactatttccaagtgtagactatagtataagctttagaaaataatagggagaaaagaaaaatgagatgtccctattaattaggaagttttgaggaagtctgataactattacaaatcctgagtattctattttgatttccaaaggttgggaatctgcctgtaacaataagaaactggtgaaaaacactggctatctttatgctcagaatgaaaacaccagactttccaaaacaatgaaaaaacaagactttattatagtatctgccctaattaaactgaaatgtggatttcatttacacattctcaatattttgcacagtcagtattgaaaatggaatgaaacttggagctcccgtgaaatagatcttttaaaatacaagcatcctccataaataattaaattgcattttctctactagactatcttgctaaaatgatgatcacagaattggaaatggtaatttttaatggctaccacattaataaaaaatttcctagacctacctcattcagcaggagacatatttctagcttgtctaccatcagtccactctaaagctgaatggtgatgcctttagataatcaatattctgttctttgcattaaaatgaataacagaatcttaactaggtaaagcaacagggttttagtctgaattttagaaataagctttctttaccattaagtgtattttttcagggaataatcttaaataatatagccattttattttagttttatattttccaatttgaaagtttgatacctagtcttttataaaagaagttgattaatgggtacaaaagtcgagttaagtaaaagaaattctagtatttgatagaactagagaaattatagttaacagtaatttattggatatttcaaaatagccagaagagaattgtaatgttcccaccacagaggataactgctcaaagtgatggatatcccaattaccctgatttgatcattatgcattgtattctagtatcaaaatagcacatgtgcccccagtatatgtacaactctgacatgccaatttaattttttttaattcagaaagccttattctgaaaatacaaaagtgttgcaatgatgaaatatcaattattgtgatcttttgccacaaatgcatacaaaagaaggtttgagaactgggcaatttaaaaaatacagtatttactagatactgtggagtttctaaccgtaactggactaagagtgttttgtctgtaaatcagaatatacatgcagttgagacatatatgtaataaaatataaccaaaagtatataaatataagcattttattatatatgcatatatgcaatattattggccaaatatttattacatatacagttacatacacatatataataaaatacttttgcagcagagtagacaaatgcctttattttggccagagacaaaattagtggcatagctaagaccaggaccccaggttcccctaggggatcctccaggtctctttgtattggacacagacgtgtgcatttattttcccagtcacataattaatactcatggtattcaataggctgtgtgctttcagaaggcagagactaaaatatattttttactctgtgtcctcaattcccaggacaatgtctgttcgacaaaaggtgagcgctgagtgtttggggttttttgtttgttttttgtattttttgagacagggtctcactttgccacccaggctggagtgcagtgttgcacacatggctcactacagcctctacctcccaggctcaagggatcctcccacctcagcctcccatgtagctgggactacaggtgtgcaccatcacacccagctaatttttgtattttttgtagagacggggcctcactatgttgcccaggctggtttcgaactccagagctcaagcaatctgcccaccccagtcttctaaagtgttgggattacaggcatgagccactgtgcccggcctgtgtttgttgcctgaactactgggagcagtgtttcacagaccactttcacactcattagtctatgtattacttataagggtgtagtatgtatttggttttgaatctgtgggactcattttgcatttacaaagttaacaaggaaagaaatacccagtaatcataaaaggactttaaaaaataatgataaattaatattctgcaaaatgaatatctaaatccagtgttactatttttatttgtaaagaataatcacttagatattattctaagacaattttagaagggaagttaccttcttgatttttccccttctctgtaatcatttagatcaggaattggcaaacgggtcaggaattaataacctcttgctttgggtgaaatccagaccactagtctatttttgcatggcagtgagctaagaatgttttctttacatttttaaaaggttgaaaaataaaaagaatatttcatgtcatataaaacttgtatgaaattcagatttcatatccaaaaatttttattgcaacccagccatgcctgtgtctgtggctgctttcacacttggtggcagagttaagtagttgctgtgagaagctgcatggcctgcacagcttactgtatggtcctttacacaaaatgtttgcccatccctgatttagattcatggtagtctctgtgctctcaaaatattgaaaatgttaagtattctgttaagctctatgatgttagtttcaaattgagataagagatcagagttaattttgcccgtatgttaatcagaataattttaatggtttcggttgttgttctttaggactagtgacacaatagtcctttcccaaaaggagcacctcccagtcactcagattgtgatgacagacacaggccaaccacattccgaagcagattatacactggggccactgctctgccgcggagatagtaagtagtgtcaagaaaaagctttattttcataataactttttttggttataaaggggtagacaaatgcccttgttcttgccagaaagagaatagtggcagtactaggactggggcgaatatcaggaaaacacacataccataaaggcacagtcagtactgaagatctgtgtttccttactgaagcattagtttatagaaaatgaatcatctttgttttaacttattacttgcttggctggatttattatcaattgattgtattttttccagaacaatcatgagatgaactattttctgaatgctaagggatatttattcattgcccttatactcttcagacaactatagtggtaggaaattattggacactctctattttctgacctctgtacatactgttttacattacatggcaccgaatgtgtattaatctctttcctgcagcattttcgttcatgggtggctttcatggtcaagtcctcactcccccacctcagtggcactataagcccagggttcttagaggatctacctactgggtagcacgggaaccacaactaagctagtaaaaatcttctttccctgagaaaaattgtaatagtgtttcttacccactagcatcatacattgccgtggagaagtctgagactaaatgtatttttatttcctgttctacctcaatgtgtgggggctacttctgagaggggtggttcaacaaggagcctgagcctctctgtacattcttgccgagtgtgccagatggtgtggtgtctccatcccctaataccaagcagtttctgtagccaatcgtgtaggcagctaagtagttcaaagagaacacaacatcactatcgatgtgtactcactccccagagagggcggggaccggcttgtctcctgcttgatgaaggagtcccggacccttgtctgggggctcctcatctgagatgcaaacctacccactgtgtgtgtagcatccacctgggccaatggattgtgttgccctgtgaaatttggagataaggggaaccaatgcaaatattctgacactcatgctgcatgctgtgctgtgagcaataaagttctttaactctgacccagaaattttgtgttttctatcagcatccattaatctgtggcaagctaaattgttagcttgcaagtagggtgaaatctcagattcttcacagctcttgacagatatgttatccttcaatttcaaaaacttatccagaatatgccttagcgttaattattctgttatttttttctaaaatgaaatatgcttattttgaccgaaatattctgttctcttttaagaaaaaatggtttttattatgctttgaatactttgtttcatttggtggattctcttcatctaggactgttgacttgtttcctttgccccccatacattttttctgtttcttccaatggctttaatctctttgtccttctcctatgcattcaatatgattattctaagcttttcccaatgtcagtaatttgttatcagctgtgttctccatttccagatatttccgatttctctgttacctctgtgattttgtttgggtctttgattttttttccttaaaaatcatcttttctgtttatctcatattttagctcttattttactgaattggtttttatattattcccatagtgtgaaactcttatgaaatttttctttccttgtgttctctcttaatttccttcctccatcccattcagatggctccttccttccttcctccctccctccctccctctttctctccttcccttcctccctcccattcagtctggcttttatactccttccttccttccttccccactccctccctccctctcttctttctttctctctctttcttttctttctttttctttctttctttcctgtcttctttttttctttctcagtatgtttgcactgtttctgtgctttttgaaacattgtttatacttgtagtgtaagtctacactacaggtctgtctggcaggtctgtccagacatttaattcatttatatggaatggagttgaattcttctcgacattcatctcttcacaatcagacacatacttcttgtcccttctgaactgcaatagcaggactagagttggtcatcctatcaatattttttcccataatctaagagctcaagggagggatctgttgaattgtatctgatttactggccattctctgtgctgttttatcttcaagaattattaaatgtcctgtgccaggcatcacactgaagcatggagggtatatctgcaggcttcagatgcctcccacagttcagtaataacccctggaaatttgtagctttttcccctgcctattgatactctgacatcaaacactggtttctaggtactctgtacttctcaaaaacattttctagattattttctctctggaaatttacctcagcccttcatttctctccaaatgtggctgtatttgtgagactcttcaggatatgtcattcaccttcagtttatatcctactttcagcaagacttctgaaagtatggagaagagaaagtgtgatatttgaaatattcccttctctttttgggagactgagatgggaggatggcttgagccaaggagttcaacacaagcccggacaagatggtaagaccttgtctcttacaaaaaaactaaaaattagctgggcatggtggcctgtagtcccagcaactaggaaggcttaggtgagatgatctcttgagcccaggaatgtgaggtggcagtgaactatgatcatgccactgcactccagcctgggtgacaaagtgagacctcatctctaaaataaataaataaattgattaatgaagaaagaaagaaaaataaaatattctcttctgtaaaacttgtagcttcctcttcgtttctcttttcctttccttatcttcatctctgttttctttaacataacacttattgattcttttcccttcttttggggcagctgggactaggggatctgcagggatagggtcaaggaatgaccactgggttagaagctaggttccacactggggaatgagcaaatatgtaaaaaaagtgaggagcataggagtgacctcactgaggaaagagttatacatgtgggaaggaggaagactgtaatgaaccctgtggtgctgggttaaaaacggaggtatccacatgaactcatggattttaatatacataatagataactgtagaatacacatagaagagagagactgcgtgtgtgtatgtgtgtgtgagagagagagagagagatacaaatacacatatttcctagctgactactgagagggctagaagcaatgacaccctagtaaatagcctgcagatctgggcttctaaacaccattttctgtcattctctgctaaaaaagaaaccacgactccttgaagaaatggctgattccagaaatgtggcagagaaaatttaagatgagcctggatcattttgttatgacaaaggggaaaaaaaaagctgaaaaaggcatgggtgtcagcttaaaggagctgccacatttgagacaacttaagcatcaaaataagttatagagtataaaccattgaatagaatacaaattcaagagtgacgtgaataaacaaatggataaatacacaaataaattagtaaaagatcaagagaaaagctatttcttggtttgtttgtttgtttgtttttgagatggagtctcgctctgttgcgcaggctggagtgcagtggcaggatctcggctcactgcaagctccgcctcccgggttcacgtcattctcctgcctcagcctcccgactagctgggactacaggcacccaccaccatgcctggctaattttttgtatttttagtagagacggggtttcaccgtgttagccaggatggtctggatctcctgacctcatgatccgtccgccttggcctcccaaactgctgggattacaggcgtgagccactgcgcctagccgagaaaagctatttctaacgtaggcatgtcaaccaattaatgtggaaggaatgacagagcttagaaaatcactattggcagccatcagaataaaaattcaatcaggagccatcaatatattgtaaaaccattggatgaaaaaattttaaactgggtaaagttgtgtttctgtaaccttaaagtgtcaaaaatacatgaaaaaagagaaaaataataacttcatgttggagaaactggacaaatgccactttacaaggcagttgaaactaacaggaccagtgatgggcttatcagcattgctgcctgctgctgcgacacactgaggagaacacagcagcccttctgtggtatttttgacaaaaatgcacaacatgaatccaatcatgagtatgtcagacaaatccaagttgaggaacattctgaaagtcaactgaaaaataccaaaaagtcaaaagtacacaaaagataagaaaagactcacacactgtaccagaataaaggacactaaagaggcctgagtaatacatgtgatgtgcagtcctgtgatgggttttggacagaagggaacaaataagcttcttcttgttcttgattgttcttgccatgaaaggaattaagactgtgtgtgtgtgtgtgtgtgtgtgtgtgtgtgtgtgtgtgtgtgtgcaggaaggaaagcaagagtctgtgttctggcttctggagtcatttttccaactacctccttcaaatctccacttggatgcctaatagatatctcaaatgaaacatgtcccaaactgagctgctgctcgaacctgcttctttagaattatttcccttcccagttagaccaaaaaccccaaagtcacctcagactccacccttcttctcacatcttaccgagttcttcagtaagttctgttggtcgtacctttgaggtgattctgaacttgaccctgtccctactgtgttgctgcgcgatcccctgactggtctcattgcttttgcttcgcttttgtttggccttctctgaacacagaattccaatcctcagcgtaatcaccatttagctcttgatgtcatcagtatatgacatggatgctcagaacccccagtgaaagctcatatacattctattaatgtatttagcagtcataatcctgtaagtatcaaatgtagctgttatttttgtttcatgactttttttccttttgtcgttttctctattgtaaacagagtcattttggaattcagcttccttcaacactgagacttcataccttcatttccctgctttccacggagaactcactgctgacgtgtgcttcttttttaagaccacagtttcctctggggtgtttatggagaacctggggatcacagacttcatcaggattgagctgcggggtaggctggccactctggacaagtcacagggtacccattatttagcaataaaagctttaactcaacaaaatggtagtatttcattcttactttgtgattctatttcattataaaacactaaacttctatgattttaggtaattttttgtttttgagagagggagagaggattttgctgtgtcactcatgctggagtgcagtggcattatcttggctcactgcaacctcagcctcctgggttcaagcaattctcctgcctcagtctcctgagtagctgggactataggcacgcaccaccatgcccagctaatttttgtatttttggtagaggtggggttttgccatgttgaccaggctggtcttcaactcctggcctcaagtgatccgcctgcctcgggttcccaaagtgctgggattacaggtgtgaactgccacacccagccagtaatcatttttaagagaaaataaaacaatgaagcatgaagcacgtaataatccattaaaatgtcatgccttccctagagtactgaacagcagagccagagctttaaaccaaactcatcacattgtttactgaattccaaaaatatttgaccagacatattgttttttatgtacccaaagcttaatttatgactgtcaaaatttacattcagtgtttatagaattagatgagactttgagccgtttgtaaataaaattactgaaacctcaaaaacaaatactatttggtattctagctatgggtacatagctatgggtagtccagctatgggtacatatctctactatttaggacttaacaaggttgaattgtgaactctgaggataaatatgttaaaatccattctgttttcctccaggatacagatttattctgcccccaccccaactcacagtcttgtttttctgcatcgccgtcattatctccttccatcctgagcgtgccttcatgttttcctgtgtctgcacaagactcaattttctgtgaatttgcttgagcaatattcatatctaatatttctagctcccacagaagtgacattttccttcgatgtggggaatggaccttgtgaggtcacggtgcagtcacccactccctttaatgacaatcagtggcaccacgtgagggcagagagaaatgttaaaggagcgtctcttcaagttgatcagcttcctcagaagatgcagcctgcccctgctgatgggcacgttcgtttacagctcaacagccagctcttcattggtgagtgctggtggtttataactgaatttagtgtgagtccagagagggaccaaaagaaaataagaactgtgatgtactgagagcaacagttgccaacaactactgcttattggtactatttgctgataacctggtaggttccaggagcttgctgtgtgcttcttatgtgacatttcttttgtttgtttgtttttgtttttatttttgttttcagacagagtctcactgtgtcgcccaggctggagtgcagtggtgcaatctcagcccactgaaacctccacctgccgggttcaagcgattctcctgcctcagcctcctgagtagctgggattacaggcgcaggtgccaccacgcctggctaatttttgtatttttaatagagacacagttttaccatgttggccaggatggtcgtgatctcttgacctgatgatccacccacctcagcctctcaaagtgctgggattacaggcgcgagccaccgggccctgcagtatctcagtgtttaggtatcaatgtttaggtattgtcatctgtttacagatgagatagccaagcctcagagaagtggagtaaccagctaatgagagagatcccaggatagccgacccccaaacttgaaccattcacattgcagaggattggcatatgtgacagctatattttatcaacactattagtgagatcattagacatttttatccattccttcagtttcacttctcggtggagttagagagcttgtaattgggacagaagtcctccagggtccactcaaaaccagatcgcaggatacccgctgattggaagcagcactgcgcacctcccccgcggccaggcttccaggagcccactcccggttttcctcgctgctgttctcacttctggggctctctcatcacaggctccttgtttataacccggtctggctcatctgttcttgcactccatttatttaaaggtgatagctctggaagtctttcctttagtttgcttacttactgttttatcactgttgtttatttttccccttgggaaaaatatattttgctatattgcttttgaaactattctaacgtaggagctacacagattaaagctctcacttgttcattcttaagtgttttaaagcgaataaggatgcaatctaattaaaactggactaaatcacaaattatcacccaacctaatttacaggggagggtagatacaacttccaggtactaaatgctacacgtgaacccacgtatgtatgtggatgtggatggggtgttataccatgacttcctaaaacctagcttcaggcgtggttagctcttctattaaggtgcagtgaggctttttcaaaggacatgaaaccatcaaactactggaaaggaggactacacggaggggtcaaaccaagaacttgattttctcacttgtaatcttggagattatttaagggaatgcctagaaacacaattagcataaaattcacctagaatcagcattcattgcggtggatgaagcactggcttcagaatcacccacaaagctgattgatagttcagatttggggcccccaccttaggcccaccgaattggaatctctgggaggaggctaaaaactgcattttccagaaactctaggtaatttccatgctcctaacattgagaattgtcgccttcataatggtgtttgtcactacacaggtgttgtaaacctctctaaatggtttcttcagcattcaagtttgacatgacaaaatgtgcatgcatgcagtattcaattactgtttagcactgtaccctctgagaggaggagatcctggggtatggtgtcaccccttccaacttcccctcctttgcttatccatttcctttcacactttatttttagagtccatccaagtaagaaatttatccatatatatttttattattgtgaaaaatttggaagttcatacctaaccattataatgcacattcttattcataaagaaattaaaataatgtttgatgaatgcacattcttattcctaaacaaagtaaaatagtgtttgatgtggtttatattatgtattttgttctttgtaaaggaactaaagtgaaattctttcttacctgaagttaaggaaatgtttttagaaggactatttgccagactcaccatgtttgaaagttatgtaaataaatgttttattcaatgtcatttaaagctgcatatctcataacagttatattttcaaaattgtatatgttcacaaaattttttgacacattgtgattattgccactctccataaggcctgagtttgacatggacataaaatcctgaataaaataccaaggaacacatttctatttgcagtgtttccgttgtaggtggaacggccaccagacagagaggctttctaggatgcattcggtctctgcagttgaacggggtggccctggatctggaagaaagagccacagtgacgccaggagtggagccagggtgtgcaggacactgcagcacctatggacacttgtgtcgcaatggagggagatgcagagagaaacgcaggggggtcacctgtgactgtgccttctcagcctatgatggaccgttctgctccaatggtaagtgtgaccaaggagcaggttatagggaaagtacatgaaacttaaatagtatgaagaatgcttctggcatttgatattataaagagaggataagattgaattatttgaaatggaataatttctgtaccaaattcctctattgaatttagaagggatatgactgtttttgaaaacttaaggctatcagtcctctctgggtttcttatttagaagatctctgggttaccccagcatctgttcaatgctaatcctctcgaaataatttggttttcaaaactctgtccttgtactgttctaattttaacatcagtaaagcatcattcttatttttgtttttaatttttagagacaacgtattgctattcaagcctctctgttgcccaggccggacttgaactcctaggcttgagcaatcgtcttacccattgtcccttgtgacagtgactttaagtgattcaaaaggcctttatagaaatgtcttttcttataaaacaagcatactaactagaaggggaaaagaatatttaaatattgacagtcattaacaggatcactcaaacactttgctctatgatgtttgactcttcttagaggagtgcagtggggtatcacacagcttctgctcaggtacaatcatgttttcaaaagaaaagggctgggcgtggtggcttatgcctgtaatcccagcactttgggaggccaaggcaggcggatcacgaggtcaggaattcaagaccagcctggccaacatggtgaaacctcatctttactaaaaatacaaaaattagcagggcatcccagctactcgggaggctgaggcaggagaattgcttgaacccgggaggcagaggttgcagtgagtcgagatcgcaccactgcactcactcctgggcgacagagtgagactccgtcttggggaaaaaaaaaaagaaaaggaaaaagggactgattttagtattaagtactctgtactgacttatttaatatatttataatacttttatgaaacctcttacaatattgaatcatcagagctaaaatgtaattgtgtgtttaagtgtctctgggctgttacacttactatttttagcagcaaaacaggctttaatcactataaattgtgtgactttcaaaagaattttgaggattcattatctagaagtcatttaaattttcagaagttcttgcatatgtcttttattagtcctgaagatctctgtgctcacaaatctcatagctctggtgcaaatacagagctctttttatatctcaagccaacatcaggagtaaccactccttcatgagcacaagtgctgatttctaaatcattcccaatccacatttgctaagtgcaatttgaatgttattttataacccaaaattttcttaaggatagacgttatatggtaagtaaatggaaaatggtcctccagtggctggggcatatgttatagttagattacctaatctaataagaatgatctggattttcagtaaattctttatattttatggaaatggaaagagtggagtagtattccaagacagtgatcatcacccaacattttctttttatttacagatatatttggggggtgtgtgtatgtgtatgtgtgtactaaacacatttttggaattaacttgatataaaattaaaatatcaacctttcataaagtgttttaagagaagctgaaagcccttcaacttttctctctcagaatactgtagataccactttggattagcctttctatccagacagtaaatttgagaaacatctttggcataaaagaacatttctaaattctgaccttgaaggagggttggtcttcaaatcaccttttctctagttacttcaggagctctgtttcatgcttcctacaaagtaaatcgatttttaaagaggaggtaacattcaaataaaaaacctggtactctggcatttccaggctggccacataaggagctctgtaaaccctctctcatacgaaacaggcataactagtaaaaattattattttaaaaaacaactattgaaagtctttagaaaatgtcctaaggaaatacatcaaatgaagaaacatttattaatcagtaataacagtgagagtttgaggcatttaagccaagaccctctccctgcacctccccatccctagctcagtatgacggaagctccactctatatggatatagccaagaagccaaaggtttcctctctacccaggtcctactacagagatactgcattaccccaagattgggtgccagcatttcttgtcatccccagttttgtaggacagaagctctgttcacgcagaaacagctgagaagtctggggtttccttcctacaccaactcctcattccaggacataaggtcttcaggtgtggcagctggaaaaatcctgtgtcccaattgccctcactccagcttacttgtaaggaacagtttctccaccaggagaggcaaggcaagaagttacctttcccaccctgtgccctacttgtaagcagaggttttactacaaaggagcaggccactctcactctccacagcttcagagcagtgaggcacatttaaccaagaggtagagggaggccatgaaaatacacagcttggtagccctccccaagtgaactgatttctatttggaacagagcatggatcagtttaagctagtggtatgaagatattggcagtaagcaattaagagaatgttgataactctaagagagtaatgagttaagccagggaagtttaacagagaaaagaaaaaagaatcagcaaacttgaagcaagatcagtagagattatgtatcctgaagaatacagagaaataataatgaaaaaaataaacagatcatcagagaaatatcagacataactaagcacaccaacatatacgtaattgaaaataccaggagagagagaaaggatcagaaaaaaatatttgaaaaataatggttgaaaacatccccaaattaataaaaatcattaatctaagatacagaagctcagtgaaatacagatgacacaaagaagtttatatccagacacatcttattaaaaactttgaaagccaaagtcaagaaggaaattttaaaagcagtaagagaaaaatcatatatacaaggaaacgccaggatcaacagctaacttctaatctgaaagaatggaggccaaaggacagtgagataacatattcaaagagatgaaagaaaaccattgtcatgaagaaacttacacccagcacaaccatctttcatgttcagtagcacaggatgactatagttaacaataatttattgtatatttcaaaataactagaagagtggaactggaatgttcctaacaaaaagaaatgataaatgtttaaggtgatggatatctcagttaccctgatttgatcattacacattgtttggttgtatcaaaatattacctctaccccataaatacatacaactattaggtattcataaaaactaaaaattataaaagatagtaaatatatccctacttacaaaaagcagagaattcactgctattagcctgcattagaggaaataacaaagaacgttccttcaggttgaagggatataacccagacaataatctgaatctacacacaaaaaacaaatagcactaataaatgtaagtgtgcaggtaattataaaagaaagtataatgtcatatttcttacccttttcagtgcttaactattttaaaaagcaatgtataaaactataatagagaatatacaaatatataatgtatatattttcattgttgggcctatagaaatatattacaaaaaaacagcacagaggagacagatggcagcaaggctgtactgaaataaggaataacaccaaatggtaacatgagtcagaggaacaaagaaagagaactagaaatggtaaataagagagtttatagacaaagtctataaatatttatttgatcttgtttcttttctcagattttttaaaaagagaacaaattatataaaataataatgggtttggtatgcataaaaatagttccaaaagagaagaaatagagctatgtagaaataacttttctaaatctcacttgtattaagttagtgtaaacctgaagcagattattgataagatatatataatgcaagcttagagcaatcactaaagaaaataaaacattgtcatgaagtatattaaaaggcctatataccaaaacctagtaggatttatcccaggatttcaggagtggttcaacaaatgaaaatcagtcaacatattacacaagattaatagaatgagaggggaaaaaaaaacatgattatcttaattgttgctgaaaaaaaaaaacatttaacaaactccagtaacctttcatgattgaaaaacaaaaacactcaataaactaggaatagaagggaactttctcaatatgataaacgccatatatgaaaaacctgcaactaacatcatactcaatggtgaaagcttcttccgtaaaataagaaacacaacaagtatgcccagttttaccacctctatttatcatagtactggaagttccagctaaagtcattaagcaagaagaagaaataaaaggcatccaaatttcaatagaaaggctatctctctctcagattaccttatcttatatgtagaaaactcttcagaaaataaaagctgttaagagaaaataaataaattcagcaaagttgcaggatacaaaattaacaccaaaaatttggttgtatttctctacactagcaatgaaaaatctgaaagtgagattaaggaaacaattccatttgcaatatcatcaaaaagaataaaaaacttagaaataaacttaactgagaaagtgaaagacttagacattgaaaactataaaacgttgttgaaagagattaaagaaagaactaaatagatggaaagacattccatattcatgaattggaaaacttgagattattaaaatgacaatacaaccccagcagattcaatctaattcttatcagaatccccaaagcactttttatacaaatgaaaaagcccctatcaatatttaaataaaatttgaaaaagcccagaataagcaaaacaattttacaaaagaacaaagttggaggattcacccttcttgacttcaaaacttactataaactacattattcaaaacaatgtggtactgaatgaggataaacctataaatcaatggaatagagctgagaggccagaaataaacctacatacatacagtcaattgatgtttaacatagtctttgtcaagatcattcagtagggaagtaacagtctattcaacataaaggtaggaaaagtggatgttcacatgcaaagattgaagttagacccttaccaaaattaactcaaaatgaatcaaagttttaaatctaaaagctaaaactataaaatttttagaagatatataggcagatcttcatgatcttggatttggcagtggttttttaaaaatcaccccaaaagcacgggcaacaacaacaacaaaaatagattatttggactttataaaaattaacaacttctgtgtatcaaagaacactatcaagagagtaaaaagacaatccacagaatgtgataaaatatttgcaaattatgtatctgatggaggttcactatctagaatatgttaataatttccacaacttaacaacaaaaagtctaattggacaaaggacttgatgagacatttctccaaaaagatatacaaagagtcaataatcacatggaaagatgatactcgacatcattagttattaaagaaatgcaaacgaaaagtataatgagctgcctcttcaaacctactagattgactataaaaataaataaataaataaataaaaacagaaaataacaagttttggcaagaacctagagaaattggaactctcttttgttactggtgggaaagtaaatgccacagccactgtagaaattgatttagagttaactcaaaatagttaaacatagaattaccttcgaacccagcaattccacttctacatatataaccaaaacaattgaaaacaagaactcaagcagatacttgtatacaaatgttcatagtagcactaatcacaatagtggaaataatacaagtgtccgtcaacacatgaattgattaaaaaatgtagtgtatacatataatggtatattgttcagccattaaaaggaatgaggttctgatacatgatacaacattaattaacatagaagacattatgctaagtgaaataagccagacccaagagggcagatattatataacttcatgtttactagatatcaatagacaaatttgtagagacaaagtagattcaaggataccagcagctgagatgagggggcaatggagagttattgcttaatgaatagagtttaattttgggaagatgaaaaattttggatatcaaaagaggtgataattgcacaacattgtgaatttaattaatgctactgaatttcatattttaaatggttaagtggcaaattatatattatatatattttaccccaaagtatagtgaaatcaagaaagaaattaaaatgttacactccaaaatatccaccaacacaaaataataagtcagaaggaaagtgaaaagaaaacaaatgaaacacatagaaaaagaaaaagaaaatggcagatgtaaatctaactgtatcaataataatattaaatgttcatcgattgagcaatccaatcaaaagacaaatattgtcagaatggataacaaaagaaatcttaactatatgctgtctaaggacatacaatttagattgaaaggggtaatttagttgaaaataaaagaagggaaaacatgtaccatgcaaagagtaaccctagagagccaaagggactatactaataccagaaaaaataaactctaaaacaaaaggtgctactagaaatagggaaacttatataatgataaaaagttaattccctcaaaaagatataacaattacaaacttatatgcagttaataatatagccccaaattgcataaagaatacctgacagaactgaaaagagaaatagaaaaaccaggaataaaacctggaggattcaatacttcactttcaataaaggatagaataattactcagaagattaccaagaaaatagagttgaaaaaaataaaaacgcaatcattctaacacacatctgtagaacacaccacttaacaatagcagaatgtatattcttctcaagtgttcatggaacatattctaggttagacaacatgctacctgtaaatcaagcctcaacacatttaaaaggattgaaatcatatgaagggactttttaaaacacaatgagatgaaattaataacataaagaaattgtggaatatcacaaatatgtggaaattaaactatacactccgaaatcaaaagggaaattagaaaaggttttgagataaatgaaagcaaaaatacaacattactaaaacatatagtaacacagctaaagcagggtttagagggaattttaaagctgtaaacatcaatatttaaaaagaaaaatggttcccaaataaaaaacctgacctgccaccttaagacactgaaaaaagaagagcaaactaaatctaatgtaaggagaaacaggaaataataaataaaacaggagaaatttctcaaatggataatataaaagtgacagaaaaaattaaccaaaccaaaagtcagtcctttaaaattgttaacaaaattggcaaacctttagtacaactgaccaagaataaaagagatgattcaaattactagaatgacatatgaaagagtgatattactaccaaccttacagaaataacatggattgcaagagaatataaacaactgtatgttgaaaaaaattacgtaacttagataaaatggacgaattcctaggatgacactaactacaaaattaacacaaactactacttctgtttcaagaaggaggagaaaatataaattggcctataacaataaaaggaatgtcttaataatattaaaataccacagaaagtaaagcccaggtccagatggtttcaaacaattgatgctatcaactatcagaatatatcaactatttaaaaatatatcaactatttaaataagaagtattaattcttcaaaactcttccaaaaaataaaagagaaaggagcatttttcaacttattctgtaaggtcagtatttccctaataccaaagccagacatagatataccagtatatatattttaaatctacagaccaatatcatttaagtagatagatgtgaaaaccctgaacagagtattaccaaagcaaatccagtcacatataaaaatgactatacatcaagacaaagtggaaatgatcccagaaatggaaagttgttttaacagctgaaaatcaattaatataatatactatatcttagaataaaggacagaaacacatgatagtctactgatgcagaaaagtcatttgataaaatccaacatcctttcatgaatttttgtttaaattcagtaaactaattatagacgataacttcctcagtctaacaaatggtatttttgaaaaactcatagctaaaattatatttaattttaaagactgaattttttttcctaagatcaagaatgagacaagaatgtatactctcactagttctattcagcattgtactagaggttcaggccagactgattaggcaagaaaatgaaaaaaaaaaaaaagaagaaaaacatccaaattagaaaggaaataaaactatctctatttgaggatgacatgattttttatataaaaaatcccaaagaatctacttagaacaattaaaactaaaaccaagttcagcaaaattgcagaatgcaaaaacaatatacaaaatcaattgtatttctacaaattagctgtgaaccatctgaaaataaaaccaataaaacaattttatttacagtagcatcaaaaagaataacatacatagcaatacatttaacaaaagaaatggaaaacgcactgaaaactataaagcattgaaagaaattaaaggtaaataaatggagagatatttcatgtcatggattgaataattaatataaataaaataccagtgttctctaaagtaatatacagattcagtacagtttcaatcaatatcccagctggcttctttcctgaaattgacaagctgatttcatatgaaaatttaaatgatgcagaatagccaaaacaatctttaagaagaagaaatttgatagattcacactgcccaatttctaaacttaatgtaaggcagtatataactggcctaagactaaacagatagctcattgggataaaattgaaagtccagatagatacctcgccatttatggtcaatggattttacaagagtgccaggacaacccaatgggaagaagtagtctctgagactactgagtatacatgcacatgcaaatgaatgaaattagacctctatctcacacatacataaaaatgtaccaaatagacctcaatgtaagaactaaaactataaaactgttaaaacatgggagaacaaaagagaagataacccacagaatggaagaaattattgcaaatcatgtctcttataagggtctagtattcaaattatttaaagagcttttacagctgaataagatgccgtgcgtggtggctcacacctgtaatcccagcattttgggaggccgaggtgggcagatcacgaggtcaggagttcgagaccatcctggctaacacagtgaaaccccatctctactaaaaatacaaaaaattagacgggcgtggtggcgggcgcctgtagtcccagctactcgggaggctgaggcaggagaatggcgtgaacccaggaggcagagcttgcagtgagcggagatcacgccactgcactccagcctgggcaacagagcgagactctgtctcaaaaaaacaaaaataaaaacaaaaaaccaacaactgaataagaaaaagaaatttaacctaattgaataataggtaaagcttataagtagatatttattcagcaaatatgtgtgaatgtccaataaaatcatgaaaaaatagttggcaacattagccagtaggcaatcaaagtcacaatgaaatacctcttcacacagacaagtatagctgtaatttaaaagaatgataataataaatgttggtgaggatgtggagatattaaaaccctcatgatttctgtttggaatgtaaaatggtatagctattttggaaaaaatatggcagctcctccaaattttaaagttggtgttttcataagattgaacaattttactcctaggtatatattcctaagaaaaataaaaacgtatccatagaaaaacttacacgtgaattttcatggaagcattatttataatagtcaaaaagtggaaacaacccaaatgtctatcaactgttaaatagatccgcaaaatgtggcacatccattactatttacatccaatgaaatattattcaataaaatgcataaaatactcatacatgctacaagatggatgaaccttgaaaataccatgctaagtgaaagaggccagattgaaaagaccacacgttatatgattccactgatatgaaatctctcgaataggaaactctgcagagacagaaagtaaattagtagttgcctaggctggggtgttggggagaaacagagaatgactgctagaggatatggaggtttttgtaggagggaataagaaggtgcacgggggaggggagtaaaaatactctaaaattgatcatggcaatgtttgcacatgcctgcaaatatactaaaagacatagaattttacactgtaattgggtctattacatggcatatggattatatcagaataaagatgtttaaaaattaatgatttgggaaaaaattggaaaccaaagatgagataagtcacctataaattatacatttatactgaagaattagttatatgtaaatataagatgaggatgatttagagaattaaaatctctattaagtgttagtcaattctgggttatgagtatattggagtttgctactttttcttcaagttgtagtttttaaaaaactttaaaaagtgaaaaataaaaaataaaacaggaaaggatttcactattactttatctcccaggatatttaaggtttggtctcattctctaaatgtacttaaaacaagaccgttggacttacattttgttaacataacaaaaatgtatttatcatttcagagatttccgcatattttgcaactggctcctcaatgacataccattttcaagaacattacactttaagtgaaaactccagctctctcgtttcttcattatacagagatgtaacattgaccagagaaatgatcacactgagcttccgaaccacacgatctccgagcttattgctgtatgtgagctctttctatgaggaatacctttcagttatcctcgccaacaatggtgaatatcttttgtgtaaagaaaaagagaaccctgagttagaaaaataggactgtaatgacatgggtcttttcagcagtcaaactacaaacgatgagagaaaactgtatgccctccaatgggtttggtttttcagtgcctcccttaatggttattataaaagctagcatttcaagattaaattaagatgcttttctcccattacatgtttgataatttaacggagttgatatgcagttatatttcttattattgataggatgactttaatagtacatgatgactcaaattggttttgcagttcattttgaaataagatatctagatacatgacatacattccctcctcattctaagcaaaatagaggagcatttatgtggatgttatagtgcaactatataaaagccaattcctataagcaacagataagtacagctgttctttatctcgtcagtggctgaaaaactagttatatcacttttatagaagaaaagtgtaatgacagcctctcaaacagtggtaattggggcattgcaaggttttcacagttgaacaagaagaccaagctttaagtttgttaggtacacagcacaaaaatttcatgtctagaaaaaaatctacaaaatctctgattaggctggacacggtggctcacgcctataatcccagcactttgggaggccaaggcgggtggatcacgaggtcaggacatcgagaccatcctggctaacacggtgaaaccccatctctactaaaaatacaaaaaatgagccgggcatggtggtgggcacctgtagtcccagctactcgggaggctgaggcaggagaatggcgtgaacccaggaggcggagcttgcagtgagccgagatagcgccactgcactccagcctgggcgacagagcgagactccacctcaaaaaaaaaaaaaaaaaaaaaaaaaatctccgattaacaggatcttagtataagctaaaagagaattacagataatgagggtacctctgtgtaggagaggggtatgtatattagaagatgtagatactatggaaaccttgtctcctgacaaaaccttttcttgtcctcatttttggattatggcagaagacttaaaataatctggctataaaaaaatctttatgcacatatcagtaatacattaaaatgagccttattaaaagttataattacaggaactgaatgttgatacaatattgcatagagcttcatcatttcataaatatcaaagtcataatgaatttagatctgagttctgagctcatatgcataatttaaaccttttcatttttaaatgaaaagctttggggagactgcttattaacaacacatttagtcttgacttttaaaatagcatcattggactcagagtctggcacaggaatagcatttaagtaatcactgttccaggaaagataactattgggtgcatctaaattgaggctaaatagattcaaaagtgctataagtaaataataataaaagtgctctagaatctgtatcaagagttttataaaataccactttaattttaaatgccatttatttttctttttaggaagtttgcagattaggtacaagctagatagacatcaaaatcctgatgcatttacctttgattttaaaaatatggctgatgggcaacttcaccaagtgaagattaacagagaagaagccgtggtcatggtagaggtaatcccacaaatgcaaaagtcaaactaactaatattattattttgagaacaaataatctaatgaaaaaatttgacaataaatattaatagaagagcaacccattcagtgctgctcttccataagtcaagaagaggccaaatatggccaggatctgggagagaggaggtggttgtttattctgtattgctttgttttgtttgtttagcaatgcaattctgtcaaaggtattattaatattttactatttaaaatatcaaaatatctttatttgttttactttactcaataggggaatgttctctagtttatcatagtgactactggtggaatctattcattgatattgcagtgggaacttgtcttattccgattataaaagaacaaatactttagcaacttaaaaacacggtttaaaagcacacaacatagttattaaaatgggaataagtaagaaaatagacctgagtcaccacagaggaagtaaattacacattgtcattggcattggaaggaaaatacactgtatagagaacagcagtgcttggttttatgtttcatattttctccacagaatgagtacgtatttaagtttaaaacagccagttccatctttttcatggattctgccaattatagatccttccattatgaagaagagtaaagccagcaagtaggtacatcgtggatagagtggtagctgatggcatcataggaattgcttataaaatagcttccccttctaaatgattaattatttgaaggtggcttcttgagcttttgtagtggtacttaaaagtgatttattttcatctttcctttcctcatcttcctttgcttccttatcattaaaattgtactttgtgttgatgtttgcttctcatgggacatctaataggttaaccagagcgcaaagaaacaagtcatcttgtcctcagggacagaattcaacgccgtcaaatctctcatattgggaaaggttttaggtaagtaggagaaagagctttttcccaaaaaatctaagtgtcatgtcacaaactctggaagcattcatcatgctgaaagaagctccttgtcttacttgaataataatttcacagtgagtgacaatcaaggtgcaaactgtactcttgcctgagtgtacatataatcatgagtaagtgctgcctgtgagatgtgcaagggcgttcctggaaaaatacctccacacttaacctctcacttggcaatcatgcataatgaatcacggtatttttctaaaccttcttgaaaagtgaaatgttatcaaagctgacacgaagttcacagattatgtatgtattaatcaacatcaactccggagaccatcattcaatgataaaactacatttgaggtgaacacaagagaaaaaactggtaatcttattacagcagatgaatacagttttatttctctctcaagccctgctttgcctgttgcttccatcctttttgactttagtatctaacaggaatggggaggcatattcataaatatctgttacgcaaggtagaaagttacagtaattgtctatcatattgtctatcataacctgttgtaaaagcacagttagctttacatttaataaaggaactgaggaaagtaatcttttttaaaaaaaacccatcttatgtaactcaattaagaaaatgaactatactttaatattaggatcaaaaagttgaataatatttattatatacatctttgtttccttccaaataaaggagaacatggaattgaaggtgttaatgttttcattcaaggatggtatattcaaaggcttgtaacttacggtataaaaatctacattgaaattcagcaacgaagtatatactcagaagcaattgatctcagaaaattataaatattcattttgcctgtccttggaggtagagataatcatcaaacattaataaaacactttatactttgaaaaactgtattttaggattggttctgctatacattttttgccactctcacatcatttagtaattataccaaaactacaactttatctttaaatttggaattatataggaagtgctttccttaacttatagtaaaatagaccaacaagttggctaatagagaagccactaattttacaaagaaagttacccaaaacactgtgttctaagttaccaatatatttctcttgagtccctgtaaatctttgattcatcccttcatttaaaaatatttggtgagcggctgggtgtggtggcttacgcctgtaatcccagcactttgggaggccgaggcgggcggatcacgaggtcaggagatccagaccatcctggctaacacggtgaaaccctgtctctactaaaaatacaaaaaaaattagccgggcacggtggcgggcgcctgtagtcccagctactcgggaggctgaggcaggagaatggcgtgaacctaggaggcggagcttgcagtgagcagagatcctgcactccagcctggatgacagagcgagactctgtcgcaaaaaaaaaaaaaaaaaaaaaaacttggtgagcatctgctatgaacagtttattaagcacggagaaagcctctgaatgagagaaacactatacctacccaccctcactacactcacatgttaataggtacataggctaatatatgagcaattctaataaaataatgctcatatccagcctaatttattattatgcaccctaacaatgccttagaaaaaaatggcccaaaatccatcataattaagatgctgtttctgagcacctcaatatgattttgccatttctgagtagtcttagtgaatgaagaccattcagattgattatcacaagatcaattcagagtaaacctatttaaatataagctttttagattctgaattttctatatagctttgaattttatccaagaggtagctttaaagaatgcaaacacctaaaatactttataattcagtaaagatgatccatcataaattaagatttgtttttagatactttggtattattggtattctttctgttttgctttgtgtgtgtacatgtgcacatgtatttaaacacttttgagatgagtatcactctgtcgcccaggctggagtgcagtggcgcaatctcggctcactgcaacctccgcctcccaggttcacacgattctcctgcctcagcctcctgagtagctgggactacaggcgtgtaccaccacgcctggctaatttttgtatttttagtagagacggggcttcatcatgttggtcaggctggtctcgaattcctgacctcgtgatccacccgcctcagtctcccaaagtgctgggattacaagtgtgagccaccgcgcccggccccttaaacactatcttaaaaattacatatatatatcaaaaatacagagtgcaaaaatggaagatgcctttttgctcccaaaaagtaaaaaaaattagcctgtaaacagttgcctatgaatacagctgagcttatataccttaggaggtatacattctaggctgaagaaaagaaaacccactgaaggactatatttcaaatagagctctaggtatgtaagaatgccaaatagttttggtaattaaatatttctggaaattgccttttgagttttgtaaggagatgtcacataagacatacagttttaacatttaaaattcatcaacttatgtattttatattacttctatactatggtgtttgtctcatttagaagaaatgttttatgttgggtctgggatttgattttacctgatttacaagctaggaagttaacagcttttaactgttttgtggatgctgtcctggtacagagacaaaggaccctattactcatggcacggcaagcctcgtgagcagcagttcatttgcattgttttcccttggccctgaagccttatggggcagtgatgggtgcagatgaaggctgcacctgcggccaggtttgcactgcagcagaggaacactgagtttggggaatccaccgattttgtaacaagcactaagcaagtctattctttgtcctggagggggtcatgaccttatccctcaatgttgcttgcttcaattataaccttgagaagtggcctgagtaaagtgctgtcagcatcttgcacttcttggcaaacccagcaaagcatgaggagacactcagagccaatggtggattgcctctttcaacattacagaataaaaacacccaaaaaccctataaaaagtcaagaagataggagattttgtggggtttttttcccaagaaagagcaatgattatatcaattagtcctttattggtaaaatgaggaggctgcactaagttatcttcaagattctcttcgatagaaaattctaagattgttctaacttggtccattaaccaggattcagtgggcatcacagatgtcttgaggtctttgaaagtataagtcaacaaaactaatgctgtccaatagaactttctgtgatgatgaaaacgtgtaaagtctgtgctgtcctatgtggtagtccccagacacacttgagataaatgagtttttaagcactagaaatgtggctagtataactgagggactaaattttacattttatttcattttaattgatttgagtttctttttttttttttttttgagatcgagtctcactctgtcatccaggctggagtacagtggcgtgaactcggctcactgcaagctctgcctcccgggttcacgccattctcctgcctcagcctcccaagtagctgagactacaggcacccaccaccatgcccggctaattttttttattttttattttttatttttatttttagtagagacggggtttcaccatgttagccaggatggtcttgatctcctgacctcatgatccgcctgcctcggcctcccaaagtgctgggattacaggcatgagccaccgtgcctggcctgatttgaatctcaatggtcacatgtggctagtgtctaccatattgcacagtgtagaagactgtccacttacttatctagtagttttttcctttagttcaaccaagtggcacccttttgtaaggatagacatctgtctatttggcatgacttcaatgggctgggaagacaaccctatctcaaatattttttttcccacaacgtcaagtgccaatatttcaaattctgtattagagatccattcttttgactcttctgccaaaatacacatgcccctgaaagtgttatcaaaagccatgaccaggaatttgtgcaaacatgaatttactcgggagcaggctttgatggaacagaatagagaattggaagggggctgggtgcaggaccccgaagttgagaaagcccagaaagggaggcagacaggtcaccatacatttttgattagagctatttagctaagagtagcaaaagtgaagggttttgaccatgttgccatgtcaaggtaatagacaggaaactgtatctacatgtcaccacagttaagagttgagttctactgaatattggttaactgataaacaataaatagtagtgctggctaaaatctgggagtacagaatcacgagtttcttcctggattgtggtgtgattgccaggtacacttcagagtgggcaaaggaactcctttctttcagattttccagcttaaacaaagtatatatgaccattttctaattaagtcatttattaaagatgtaagaaagttctactctgtttcatcagctccaaattaaacaattgctcaaggtttttattcagggttttaaagagaagtctggccaggcgcagtggctcatgcctgtaatcctgacactttgggaggccaaggtgggcagatcacaaggtcaagagatcgagaccgtcctggccaacatggtgaaatcccgtctctactaaaaatacacaaaaaaaattagctgggtgtggtggtgcatgcctgtagtcccaactacttgggaggctgaggcaggagaatcgcttgtacccaggaggcggaggttgcagtgagccgagattgcaccactgcactccagcctggggacagagtgagactccatctcaaaaaaaaaaaaaaaaaggtctgccctaaaattatgtgattcttctctaaactacagttacttaatgtaaaaccatcttgtatcatgtcaaaagataaaaatactcttgttaagatcgtgtggcagactttattcaggactatggcaataggtataggaattactggaatggggctttgcagttggggaaagagactgagctcaacttcaaatacaacaaggagaagtgtggattcgtagccaaggagcagagtggctggggtggggtgtctgagtggtaaactacaaaatgggagagtaattcttgctaaactgactcaccaggtttcctggtgatgccaggccagtgttgtcagacatcacctgtggggtggtgagagggatgagaaaggtgattagatattgagagtgatcagatattgagggtgggagatttgggttaaaagcaaattggcaggattcttgctaagctggacgatgaaagaccaaaggtcaggctggttgagcagagagcttagagtagcctgaccaacatctggtcatagggagaatctttgtccatcatgtcaaagttctttcttggaaaaaataaattatgtaaagatccttgaactggaaacatcatagaaaaatagaaatgtaagagaaattgtcattctggtcaggatctaaatgtactagagtaaaaccaaagaagagtaaaaagggaaaagtgagagaagaaaaagaaaaatttcccaagcctctcatttagggaagaactgttgtggggaaccccgcggtggtgtgggagggagggtggggagaaagaaccatgcaatcgctcatctcactgttgggaatgggggaaagttggaaaaagaggatcttgttttcatataacagtgtgaaggaatgattttgattgtgagggctagggaagttgagctctcaaactcataaaagggaaagcaggaaataagaaggaaactgattaaagcagcaaaataaaagaaaaaaagatgaaataatgtgaaataaatagtgtaagataaaaaataaaatcagatatagtggttattactctaaagacaaatggactaaattctgtcaaactaggtttaaaaacaacagttaaatgctcttagaatattgaaaatgaaggggcatgccaagaactagcaggcaacagctgataaatttaagaaatgcagcactactttcagataagattgaatttaagattggaatataatcgaatcttaaatgagataaagagggatattatctgatgacaaaagatacagtttattaagataatatgaaagtcatcatacaaaatagcaactatagtatgaaggatttccagagctctgccctcatctccaagagtcgcttttctgtaatcctccggattattggctgtgagcgccattaaaattttattttaatgctatattgtaaaaattaaatggcagaggatttcttaaatttatgccatgtaactgctttcctatgaagctctgttacttgcagagagccagccatctgcacttgaacaaatctgttaaaaacctgcctttcataaccctgacaatggaaatagttgcctaacaggtaaagattcagggtgacctctcctggagtgaaggaacgaggggatcggagggacctctcctggagtgaaggaacgagggtcgctgtcttgcagatgcggggtgtccctgcgcccccatctccgccgctgcgccctaactgtgtgttccccttctgtcctcagaggctgccggcgcggacccggacacaaggcgggcggcgactagtggcttcactggctgcctctcggcggtgcgcttcggccgcgctgctcccctgaaggcggcgctgcgccccagcggcccctcccgggtcaccgtccgcggccacgtggcccctatggcccgctgcgcggcgggggcggcgtccggctccccggcgcgggaactggctccccgactcgcggggggcgcaggtgtgtggccctccacccctgcgcacctgaaactgcgcttctctcaaatgtttttgaatttctcaaaagccttcttttctccgtctctgtcatccttctttttttcgttttttaaaatacatttttgtgatgttcttattttaattcacttttaattgacaaaagtttgctatgtgtaaattgtggcgtgattaaatcaagctattaaacatcattcttcctttccctgttgtaggtcgttctggaccagtggatgagggagagcccttggttaatgcagacagaagagactctgctgtcatgggaggtaacaaggccctgaatgacctggtgcttgtcattatcgctttagataatgataccattacttagcacaatgggaaatatatgtaagcatcaacactcaatggtgaggtcagaggggtgctatgtattgcggttggtggtggttttttgttttttgttctttgttttttttctatttgagacaagagcctcacgctgtcacccaggctggagtgcagtggtgagatctccactcactgcaacctctgcctcctgggttcaagcgattctcctgcctcagcctcctgaatagttagggttataagagtgtgccactatgcctggctaatttgttgtgtttttggtagacacagggtttctccgtattggccgtgctggtttcgaactcctggcctcaagtgatctgcccgcctcagcctcccaaagtgctgagatcacaggcgtgagccaccatgcccggccttcgttgattttctgaggcagtatttgctgatttcagcttccctgggggtgctcagcatgtaagaattctgctgaaacaattttttttgaagaacagttacaaagctaataatgaaaagttattaatttgaaaatagctgtattccctaggacatgcgggatatttgtcacggtaatgacaactgttggacggacctgaagtaattatgttcaaagcaatggaaacctcagctaattatcagagcatacactttatggtacttttcttcaatgacaaatagtatgatttagatactcccatgacaatgtttcacttatttaagaagtttttgtttgtttgtttgttttttgagacggagtctcgctgtgtcgcccaggctggagtgcagtgaagcaatctcgacttactgcaagctccgcttcccgggttcacgccattctcctgccgcagcctcctgagtagctgaaactacaggcgcccgccaccacgcccggctattttttgtatttttagtagaggcggggtttcaccctgttagccaggatggtctcgatctcctgacctcgtgatccacccgcctcggcctcccaaagtgctgggattacaggcgtgattatttaagaagttttaaaggcacacattatttaaagtgtattgttattttaaagtgtataattccctgtcattaaggacatttacaatgttgtgcagcagtagccattgtatgtttcacttttaatcatactttggaaagaactaatctaataggctaagaatgttttgtggttatttttaattgaagaaaagtgaagttaagcatagcttaaaaatatgttttggcaatgaaaactttttttctaaaatataatttatttagagctggtgcaaaaaataagcattcacctttccttgttaattaatgagtgaattattgaaatctttgtttgtttgagacggagtctcgctcgtcgcaaaggctggagtgcagtggcgccatcttggctcactgcaagctccgcctcccattctcctgcctcagccgcccaagtagctggggatacaggtgcccaccaccacgcacggctaattttttatatttttagtagagacggggtttcaccgtgttagccagaatggtctcgatctcctgacctcatgatccacctaccttggcctcccaaagtgctaggattacaggcatgagccaccatgcccggctgagttattgaaatcttaattgtattcttattctgcagactctccatagcacatacaagagtaaactagttgtgtttgtttccttcaaaatgacaggaaacaattttgacataataaagttctgactaaatttcagttgaggatattcacatttccatcactatctcaattctttttctcttagaaatcagtaaggtgtaaattaaaaatacatgacctgatgaacaaaaactgttttaaacagtttccagtgggattgtggtcaataatgcatatctaaaaggtatactttcgtgttcaattttaaatcaaatccaatcctaaatcaatcatgcctttttaggagatttttttcattgcaatgcaaaagcaatttcaacatgccgaacattttcacgctaggtttccaagtcctacagacgtttacacaatgtcagggttagtacccagcttttggtgagaaggaaatgggcaagttgatcatagaaccagctctttggaattgtattatattgctggtggtcaaatatcactggcaagattgacggagtaaacgtaaggaaacatcttagcagtgttctcttccgctgagaaattcttagcctgaacgaggggatgaaaaggagtctgtggaaggcttcccctgggctttcccaaaggcaatttgcattttctaatagggactggctgaagatataaattaatatttgtgtgaagtactttaaatgtacgatgtaggcagtaaaagcgtgggggaggaaatataatttctcctcatcattcctaactttgtagttgggacagacctctgattaacaagagaaaaacaagcaagtttactaaggcatgcggtccacagcacgtgggagaaacctcagtgaaactcaaagcgcagtggcttagaagtctggctcatcttcaacaatacatttgcggagaaatgacaggacaatggaaagcaattttaggtgtccgaaggcgagaaaccgtgggaagataaatatatgggaagaaactagtggagtacgtgtgtttgtacattcttctgctgacatccctgagctggtaagaatggtctccggtaaaagataatttacatcctgtctttagatgaaaagaggggaggatctagagagctcttcctccattggctgcttcttaattgcctttacttcaaaatatttgtcaaaaaggcatatttgggggtgacatattctgattaccttcagaagcttgtctttatacacatttatttcttttagggtagattttactttcatttgtcactaatatgattgcttcagtacacagcattctgtggcatggcttcatgctttagcactctggctctgaattaaagcctgaaacaatttataaagatactggtatccaggccttccattcatttattctgatttactgacttagtgtgcagctagagtcgagaatcatggacactgctaatggtttcaatattttaaaacattttgcccaggtctttcaaataatccacattccaggtaaaaaaaaaatgaataaatatgcctgcaatatttttggtaatagggattgattacatatatgcgaccctactgcgtttgaaaagtatattatcggccgcgcgcgttggctcacgcctgtaatcccagcactttgggaggccgaggcggacggatcatgaggtcaggagatcgagaccatcctagctaacacggtgaaaccccgtctctactaaaaatgcaaaaagttagccgggcgctgtggcgcgcgcctgtagtcccagctactcaggagcctgaggcaggagaatggcgtgaacctgggaggcggagcttgcagtgagccgagatcgcaccactgcactccagactgggcgacagagcaagactccgtctcagaaaaaaaagaaaagtgtattatcataaaagtatttgaaaacaatttcattaaaatgtacccatttcattgtactaacaataacatgtaatgatctatgatgatgcaaacactctatacttgtaaaatgatttaaaatttcccacttgttaactgaaggatgtacgcggtcttagagacatgtatgtctctattcttttaaatctgaaagcattatctaaaacccaatcatcatatacctgtagggaaaaagcctaacacagccatatccaaaagtcatagtccgtcagaagtatgttaaatgttataaaattacttgacctcagcatttctgagttttggtgttttcaatttataatataataggtggttggtttattttaaccaaacttaaaaagcaatgatgtctgcaaagcctctgattggaccaaaagtcaccatttatactctgacattgaggccaggcacggtaactcacacctgtaatcccaacaatttgggaggccaaggtgagaggatcactttagcccaggagttcgagaccagcctgggcaacatagcaacaccccatctctacaaagaataattgtaaaaagaaaaaaaaaaataagctgaacggtggagtgggcctatagtctcagctacttgggaggatcaaggctacagttagctgtgatcatgccactgcactccagcgtgggcgacagagtgagaccctctctctaaaaagaaaaaagaaaaaaaattatgatgttttattcttttctctccctaggtgtgatagcagtggtgatatttattttgctttgcatcactgccatagccatacgcatctatcaacagagaaagttacgcaaagaaaatgagtcaaaagtctcaaaaaaagaagagtgctaggacagctctaaacagtgagctcgatgtgcaaaacgcagtccatgaaaaccagaaagagtgagtcttctgattggcagctgtggctgtctctatcatcgtgactgtggacttccctgctgttgccatcagggtgcacacagcaggtgcagtgctgtcacctggctgaagatctgcagcctcagagcctctgggaggtccctttctccctcggtgaaacacagtcctccacatcaatttccaaacaatgaattagttatggccattcatcactgttcagtagtttccccgtccaaaggctctcttccaaaactgcagtttgatctgtgttaataattgtggggttttagatgagaaaatgactataaagctgtggccctactttattttttaaaaatgacagaacttttgttcagatgtaaaagacaaaattgcactttaatgttttttgttacttgaaaacatatctgggatccctttttttggtcctctgctgatatttataaaacaagaaatgcttcttggactaccttcactggcatttccatagtcctggaatccagagccaagtggcctatctaaaattcacagcccttttattctcctgtgtgatggttaatacaacacagttgaagcctggaaacactaccattatttttggtgtattgctttttctaattgactgtttttaatgattttgatacattttaatgttgaaattaatattgaatgttagctatgaaattttagtattgaattttataatggaacagaacattggtaggtaacaagatgcaagaggatgtcaatacaagattgtctgcctgtttttctttgtaatttgtaattacagtttttgtaacttgtgattatgtttttaactaaatttaccaccagatacaaacactacttcttacacagagttatcctttatttatatcattaagacgtgaatgaaacatcatcctaacttacttccccaagatattgagaggtcatatctgtttttctttatcattcatttctttttctaaaagttgttactgatatgcttttgatttcctatgactctattatgttgtacagaacatcttttcaatttattaaaaaaaatagcttaactgaagatcactaattccttttctaaattttgaactgctctaggcataaatatcattgtgtattatcctttcatctaatcacttttggaatgtaaactgaaggctgttcactccaagttaagttaacatttacatgatgtttattaaatctgccagtctgatcaaaggtttatgaccatggggccaaattcccatagattacccaaaattgaatatgtgcagttaactggaacatgtctcattaaggtttacatacacactaagacagcaaaggattggaattaactttatggagacagttccagggactaatattgaagcagtggttatttgataatgcatggaaccaccatttggattcaataaaccaattacataaaagcaatgatgctacgctcttcatattccagataccaactgcctaccaaggactaatgagatggtatatttcttccacatcagggcaagctgaaaatatattgattcagcgttactgttatgtaaatgaatttccatcttctcatatgtgttatttttgaaagaatgaatacactctctgtcttaaatccgctcttaacaaatgatctcttctcagaatactacatctgtattgagagtacagacagcccattggtcactgcaccttttgcaagacagcgaaacggatgcatcaaattgcattgatacatcatcaccatcaatcttttgcactgatttttagacttaatcttcttatttgaaaataaactcatttttaaataaaataaaaaatattttagggaaagctctataaaattaaaattacagaattatatgctttttaaaatttatgcaaaaatgtgcagacaaatgtattctgtattggtttatgtatcactttgcccttgtatattttgagattattaagatttgttgacttttttggtttgatatttatcatctgttaaatttttccttttaaattattaaatgcaaagtgcaagaaaaagagataaatatttactgattgctagatgtaaaaatatctatgaatatatatatttaaacttctgccagagagcaaccatctgacagtcaacttactaaaatctaaattgagtactttttactgttgcagagaattaagtcactaaacattatttagatatatagatgctagttgcaagtaacacccttttgtaatataaaagtaaaagcataataatttcccaacttttgtcttcaaattaaaaaagaaaatagcatataattaccattcttcatttgagaaagctgaagattctgatgcttaaaaacttcagaattctaatattaaaaatagagtggttcatgtgacattgaaggcttatctctgtaaaatagtgacactggtgagtggtattatctcaatatttttgtccaaattcaccttaggaaatcactgtaaatcttcattgtttcctaaaagtcattattacggcataaacttaacatactttgatagtagttagtactgatacgtgacatattctaccccgtgtctctgttactctgtctctattactgtgaaaagtcacagtaaatttaacattttcttccagactgtgtatgatctttcattgtaatagagacatggagtaggataagtcatgtattaacatataagatttttttaacctgctccctcagttttatagatgagacaaagataaggttgtaagagctaatctcttcaagtaggcagtactagtaagttgtcatgcgtggactgaactcctggcacttctttctcttaacttcaatccatagagaagcccaccttcctgccttcccagtattatttagcagaggagaaaatcatattaggctgtttgatactctgtttgcctagactgaccaataattctggatctttgttcacatcttctctgaaagaatatttgatgggaaatcttttttattttttaatttttgtgtacatactaggtgcatatatttatggagtacatgaaatgttttgatacaggcatgcactgtgaaataagcacatcatggagaatggggtatccatcccctcaacatttatcctttgtgttacaaacaacctgattacactctgtattttaaaatatgcagttaagtttttattgactatagtcaccctattgtgctatcatatagtaagttttactcattctttctactttttttgtacccattaacctatccccacctctgccccaccattatctcagctgtctactacttttttcagcctttactaaccatccttctactctatatccatgagttccgttgttttggtttttagatcccacaaataaatgagaacatggcaatgtttgtctttctatgcctggcctatttcacttaacataatgacctccagttccatccatgctgtcgcaagtgacaggatctcattctcttttatggctgaagagtactccattttgtatgtgaaccacattttcttcattcatctgttgatgaacacttagggtgtttccaaatcttagctgttataaacagtattgcaacaaataaaagagtgcagatggaaaattgattttgatggcttttttctttaataaaacattaatttcttcatgtataactggaaggcaaacaaatgatccatttgcttagtttattcttgaatccataatataagtgacagaaatggattattaaaatatacttgaatttggggaagaatgatatggacacattttaaatcaaaacatgatgaattggctgtttaacctactacctcattggccaatctggggcaagatgaaagtatttgtaaacactgttttggcaattatgtgtaaagagagaaccaattttttaattaaaaaattgaattctaagaattacagagcttttctattggtaaagacattaaatatcatagagtccaacgcttttctcttccttcacatcactcccaatggatgtagctcaggctaagttcattgctgatgtgttgtcagaacagccactaacggtttaagttggtatacttaagtgcaaatgtaaccttaagaaggttacataaagttgccattactaggagtagtagcagaatttattatggattaatcatatcgtcgggaaaatgtactgaagcactacttcctgtggtatttttttttacaaaatgataacatagtttattgcctataggttgattatgacctaaaattatatttttgcattttattgtgccgttatatattttaaaatgtgaggttcacatggttgcatttgctctgtgaataaaaatgtctaaaatgataagatgaacttttatattttgcgatatgaaaatttctaacttagctagcttgtgatggtacctaaaaatttaagaaagcccttaaaatagaacctctgtgactgcatgagcactttgtatgactcatatcacattttaactccttaagcaagccaatgaggtaaaacatataattgtccccatttttgcaaaattcacaaaggccttcactgctttgagaaaacgttacacagataattactgacaaaaatgggttagaatgcaggtcctgagatgtctagttcctgaccaattctacaggttgccttgctcccataatatgctccaatctacaatgttcatcttaatctgcagtgagtaaacataattgatagctaaatttacttcttgttccaaatctttaggatatgattcatgtgtgttatatacatacatatatatatgtgtatgtgtttatacttacatatatttttttttcttattttacttctggctaagatggagtaataggcagcatatttaccctctaaccctcctgcatgaaacaacctcaaaccagacaaaatatatgaaacaatggttttcagtacactggacatgaggcacggaatgtaatccctgaaagacaggaaacataagatgtgtgctgtgagtatcccagcttacaacttgacagaatttgagacagcagtgacaatggagatagatagcttaaggaagcctagcaagtctctgaatggagtagctgttgctgagagttcaggtacacgaaggtggctagagattgcaggatagagtaccggcgaggaaagagctgcattggagaaaactttgcaaatctggagagggtcgcccttcagtgtgtaacaaagtgcatgaaactacctgaggcaagggaaagaaacactcaaaagaattacagcggcatttatcaacctttaaaaaattattattgacctcaaggaatcttttaaaacatcttttctagtcacctctctatgaattttttaatttttattttattttattttattttattttattttagagacggagtcttgctctgtcgctcaggctggagtgcagtggcgcgatcctggctcactgcaagctccgcctccaggtttcatgccattctcctgcctcagcctcccgagtagctgggactacaggcacaagccaacacgcccagctaattttttttttttttttttttttgtatttttagtggaggcaaggtttcaccgtgttagccaggatggtctcgatctctggatctcatgatctgcccacctcagcctcctaaagcgctggtatcacaggcgtaagccactgcgccgggcctgaaattttaatatcgcacatgcactgcatatctctttagtactatatgtatatctgggctttacacaaaaagaatatttttcttctcttcacttctcccatccccccaaaaaaatctaatttctgtcattttggggacaatatcactctcactgagagtgcatgttcacatacaaccatgaatagaggtggttgccatgggctataccagaaatccccataattaatagggtattaggtagactattcataggggtcttgcctcagtcctggcaagtcctagaccacgtattactatggcggccccactaaacaaatcttcaaagatttggaaaaaaagatcaaaccgtttccaataactaattggcatctctgagcaaagttcacatgtatttccagtaacataaaactatccaacaccaggccgggcacagtggctcatgcctgtaatcccagcactttgggaggtcgaggcaggcagatcacgaggtcgggagatggagaccatcctgctaacaaggtggaaaccccatctctactaaacatacaaaaattagccgggcgtggtggtgggcgcctgaagtcccagctactcgggaggctggggcaggagaatggcgtgaacccaggaggcggtgtttgcagtgggccgagattgcgccattgcactccagcctgggcaacagagccagactccatcaaaaaaaaatccaacacccaacgaggtaaaatcacaatgtctggtatacaataaaaaattaccaagtgtgtgaagaggcagaaaaataggacctataatgaggataaaaatcaatctaaaatgacccagcacatacacagatgttagaattactaatgaaaaatattatgactatattccgtattttcaaagattaggatgtgacaagaaaaggcttaaattaaacttcgagagatgacaatgttaatgtatgagattaaaaaatacaatggatgtaattaatggcagatgagagttttcagaagaaaatattaataaacttgaatatatatagcagtagaaagcatccaaaatgaaacagagacagaaaaaaaacaaagaataatcagagtatcggtgatctgtgggacaacttcagttgcctaatctgtgtgtatttggagttctcaaaggagaaaagagagtggatggatagaaaaaaatatttttaaaaattaataggtaagcattttccacatttgatgcaaactataaacccacagacccagctcaacatccccaagtaggggtgctattaagaaaaccatatcacaacacatcctaagcaaatggatcaaaactcagtgtggtaaagagaaaaagacaagtcttatacagagaagaaaaacaaggatgataccagacttctttttggaagcaatgcaaggggaagggcagtggagaaacatctttcatgcttccagtgaaacatcttccaaccaaaagcagaaaactgtctctcctaggtttctatacccagcaaaaccgtctttcaagaaaggatgaaacaaagatatttttcagacatagaaaagttaaaagtaatatattatcagcaaacctggactatgagaacagtgtaaaagcctttcaggaagaaggaaaataaagaataatatctttgtgcagatagaaacatggatccacacaaagaaatgaagagcactggcaatagtaacaccataagtaaatatacaatacctgcccttattacttaaatatcttttaaagataattggctgtttagaaataatagcagtgtcatgtgagttctgcagcatgagtaaaagtaaaatatatgacaacaataacctagagagactaaatggaaatatagtttgtaaggttcttagactgtgtgtaaagttgtataatgcctattaaaagttggctattacaagttatctttaagttaaaacatctgtatggtgtaatccctaaagcaaatgctagagtaacaaaaacagtgataatattacaatattacacaataatatacaatgcagcgatgaaatagaataaattttcaaatgcttgaaagtagacaaaaaagatgagaaagaggacaaagaacaaatgggacaaatagaaagcaaatagcaagatataatataaaaatctgataaatttgaccttaaaattaacaactctccttttaaaatacattgttaagagaataagagtcaagctacagactgggagaaaatatttgcaacactttatttgaatgctgtaaatttttttcagaatatagttcataaagaactcttaacaactcaataattagcaaaaataaaatgaaaataatgaatataagaaaaaatgatgaaaagtgctacaccagtggacaaaaagcacacaaaaatgttcaatatcgttttgtcattaaggaaatgcaaattaaaaccacagtgagttattcttcccactaaaatggttatgattaaaaatattgtcagtaccacgtgttgttgagaatatggagcaattataattctcatacattattgttggaatgtaaaatgctacaaccacttaggaaaaattgtttaacattgttttatataattaagcatacatgaaacctatgacccaacaattccaatcctaggttgaaaagaaatgaaaacttatgcccattataagacttacacaagaacgtttatagcatctttacttataatatccccaaactgtaaactgcctaaaagaccttcaacaagaaaatggacaaacaatttgtgtggtattaataatgaaatactcttcagctataaaatggacaaaactactggtaactgcaacaaacatggctgaatctaaaaaaccttgtgttgaatgaataaatctagacactatagggtacattctgaagtcctagaacaagcgaaactaagatatagcagtagaaattgtatcagtagttacctgggttgaggtgggatgggagttgactgcagagaaacacaagggaagtttctggagtgatggaaatgttctatgtcttgattgactatggttacattggtgtggacatttgtcaaaactctgaatttcatatttggaatttgtatattttgtatataaattatacttcaataaatatgtacatgtatatatatgtgtatatataatacattttgatatgtcatgatgtctatcacttcacagcatattatatttctatcataccatatttacataatggaaaaagatgaaaaggatgctgtattttggggaaatcacaagagattatcacctttatttattttttatacaaatacatataaatctttcacagtacaatacaaatgtcaaaatgtggtattttcattgctctataaattcttatatgttctatatatgtaataaatgttaaaaacagtgtttatatgttgtatatgtttatttgttctatgtgtttatacgttcactgttctataaattctcatatattgtatactatacaatcaggtgatgagctgctcagtaaataagtgctgaacactctgcatccctcatcacgtcaagcatttcacatcccttttcctgtaggcttccacagtagacatttgacttgccaattacattttcatccatcattctggagaagcctggagaaacagctagacacaggggacatactctataccttgctcattgtgccttggaattatacatattgaaatattgtaaagatttgcttcatttgtatcaacatggctgtgaaattagatgtcaactctacctcacttccaacttttaggaggaatccagatagtttattagaaaatagaagtgcaaaaatgtttgctgtttgattctcagaccatagcctgagattagcagtattaaaaaaaaaatagcagacagaagaggcccaagtctctcccagctcctgggatgcatggaagcaatgggctgtgatgtcctactgaggtaaaagaagtagtgtttgttatagtcccacgagcagaagcagtaagaacttgaggtagggtgcacctaaaactgagaacaagggaaagaaagctgaagtaggaagtgtcaccagggagggactatgggtccttactatgcgaagagagaaaaggatttaattaggtccaacagaatataatgccatttcaaaaacattttctgttaggacagtttccagagactctaagtggttgttttttgtgtgatgatttttgagcttggtagaatttttctagtctgactggatcagttctagaaagctgctcagatgaatatgcaatgaatgctttctctcttcacatacttctcagttagaaggagaatatttcagtccaaaaggatgcaagaccttagttatatatgccacaatcagatcagtgattttaatttgcccaccctaaagaaatatgagtatataccactctaaagaaatctgtctttctaacatgtctatcactttcttcaatgattccatagcaaacagttaatgaaaaacaacaataatagcacatgtattaatcttcaccacttgtaattttccaaggaatttagacagatctattgcaaaaaaattcatcaattcttatgttctttccaaatagtttttgcactaaatgatattattcaacatttctccatgtctacctgtaccttcagaccctcactaaatccaattaaccaaaacccaaattggttagtgatgttaagcattttatgtcttatatgtcttctttttattttatgcttatatgtcttcttttgagaaacatctgttcatgtcctttgcccagtttttaatgggatttttttcttactgagttgtttgagttctttattaaaaaaatgctcagtatcacgaatcatcggagaaatgcaaatcaaaaccaaaatgagatatcatattacactagtcaagatggctattactaaaaagtcataaacaacagatgttgacaaggatgtggagacaaaggaactcttatacactgttggtggaactataaattagtaaaaactctaaggaaaacagtatggagatttctctaagaactaaaaatggaactaccattcgacccagcagtcccactactgggcatctacccaaaggaaaagaaatcattatattaaaaagacgcccacacttgtatgtttattgcggcactattcacaatagcaaagtcatggaatcaatctaagtgttgcttggataaagaaaacttgtggtaaatatacactatggaatactatgcagccataaaaagaataaaatcatgtccttttcagcaacatggatggagctgaaagccattattctaagtgaagtaactcagaaaattaaatactgcatgttcccacttacaagtgggacctaaacaaagaatacacatggacataaagatggaaataacagacataaaataggcctttttcggccgggcgcggtggctcaagcttgtaatcccaccactttgggaggccgaggcaggtggatcacgaggtcaggatatcgagaccatcctggctaacacggtgaaacactgtctctactaaaaatacaaaaaaaaaaaaaaaaaaaaaaaaatcagcctggcgtggtggcaggctcctgtagtcccagctactcgggaggctgaggcaggagaatggtgtgaaccccggaggcggagcttgcagtgagcagagatcgcgccactgcagtccagcctgggcgacagagcgagactccgtctcaaaaaaaaaaaaaataggcctttttctttaaccaatacaacatcactatttctactgcaagtgtttcaaaaacatctgtgctattttgaaatataccaagtttaaaactgtcacaagaaaaatgtctttgcggccgggcgtggtgggtcacacctgtaatcccagcactttgggaggccgaggcgagcggatcactaggtcaggagatcgagaccatcctggctaacatggtgaaaccccgtctctactaaaaatacaaaaaaaaaaaaaaaaattagccgggcggggtgatgggcgcctgtagtcccagctactctggaggctgaggcaggagaatggcgtgaaccctggaggcggagcttgcagtgagccaggatcacgccactgcactccagcctgggcgacagagcgagactccgtctcaaaaaaagaaagaaagaaagaaaagaaagaaagaaagaaaagaaagaaagaaagaaagaaagaaagaaagaaagaaagaaagaaagaaagaaagaaagaaagatgtctttgctatctttcccaggtctccagctgcctccacactggcgtaagaaacactggaggaaaaatgaccgcctcacagtagtttaagctgttcttttgcccatagatgtacacatttaaacttgctcctagctctccaagattgcttattcgctgatatgttgcaatgacaacaaaatacaacttctgtttgattaaaaataaaagcaagtaaaacatgtttttcctcactgggttctgagttgattaaatccagcttatcattgatgttttaaaattgaggttatattatatagtttaattttcaaaagagactttgatatatggaaaatgtaagccaaggaaaataaaaatatgaaaattcagaaataccattgctagctcatcacatatgtttatttaaatttggttagtatgctggagagaatttgggattgaattcaattctttgtgctatatacaaaataaatttactagcagttagatggaattggcttagaaacctaatcctatatgtaaatattataaaaatttttaattccaaagtagttcaataaaaagaactgggctttgaaatcaacatgctggataaatagacaactactgtagttaattctaaataagcatccttacagcaaagagatacacatttttacaaggctctttctctcaactttggaaataacaagtatctttaaattgccattgtcagtatctcttcagtagatgccccttggcagggtgtgctctgcacttctccgctgtgattatgtctagaagaattgcatcaggatggacaagaatggttgtgtggaaaaagaatttagatttgctgtgaaaaatggactccacaatggatcttctgggttgattagttaagcaattgaaacacgaaacccagtgatttgaaataacaaaacaaattgcctaatttagaaatataatgaaaacacatatattattcaaagacatgttgcaacaatagatggctagctgatgactagtttttagtatttgtaatatagggtgtatgtaatttctttttgaatttagcaaaatcccagcttttttatatggtatctgagtaaggaagataaacatctttttttttgaaatggagtctcgctctgtcacccaggctggagtgcagtggcgtgatcttggctcactgcaacctccacctcccaggttcaagcaactctcctgcctcagcctcccaagtagctgggatatctgtattggtcaggctggcctcaaactcctgacctcgttatccacccgcctcagcctcccaaagtgctgggaccacaggcgtgagccactgcgcccggccaacatctttttatagtttctgatttccaatgtacaattaaactcttggctattaggagcatctatacatcccccaactcagagtaaccactttagctattcttagccaatgaagccaaagaacacagaagactgtgctcctgttctagttcttttatgtaccttgttttaagtcttccttgttccccgctccctctcaccataaggacgtggctctgctgacttttctctttaaaactctctatcctaccctgctccattcacctcttttatactaattaaagcctcctcttccttctgatctcagcttaagagacactgtcttgaggcacctttcgttagccttccaaatctggctctttcataaaaccatcctacagatcattgttctttttcatcagcatggttgtctcaatttgatgactgatgtgatgatgtgacgggtgcacgtcttcagtgaactgtcggaaagcggagctcgtgtgcactgcagagtgtattcctgtgagtgtattcctgttcccttccaggtgcgtgtggatgacccagcagccaggtccagcactggcctaaggctccaaacttctacagttagaaaattggcaaagatactgatttaactttggcgcgtttgttaggcttcttcttcttctctctcttttttttttttttttttggataacactttaaataacatatgatagaaaatgagaagagtttatggaaaataattttattagtgtttgtgtcccttaatgacttaagccctaagtagagacttcataatttcaaactttcaaaaatgtcttgtaacatgcagtaaaatgtgtcttattcgtgagagtaatgtctattctaggcaactgttctcaatttccatggacagaggaaaaattagacgtacatatgttttatggggaggaatttggactaaacataagaaagaattacctggccaggaagttgttgttcactattacattaactcattttacaggaataaaggaaataacatgatttaggaggaatgtaacccagaaagagataatgaatcagaagccctccaaatttcctttgagatttgtttagcatatgattatgagatttggtgaaagtatgtcattcccagtaagtaggtgtaatttaaaatatgtaagaagttctacatatgtgcttggtaattttaagggttattgtatataatcattactgagatcactacacagctatgtcctgccagtaatccaaaaagaaaaatcattctagttgtcatcaattatataagataataaaaataaacttaaagtcttaggcaatattttagatattgctcagaagtacatttctttgtgttataattaatgaccttctatgtgtgattattcagattattgaaagtcttagtattaatcattcataataattaattttaaatatttgagtagtcagttctaaaataattgaaatcattaaaacctgaatgttattcaatcaacatgacttagaaataaaataatattattaaaataaggaattaaagactataaatttagacaatggggaaattaacagaaacacttcatgtctttgcctttatttggtaaaggatagactctttcatccaataacttttttaattaccataattttgaaaatgtgggactttttcttacatcttacacagtatgttgcttgtctggcaaattgaacacgtggagaaaagaaatatctttgtcaaaatgagcgctttatgtaggacactttacattatattataaaaatatattaataaataggtccatagtctgtagaatatataataaatattctgaattagttcttaagactaatgaacttcttttgtcctaattttttttttttttttttgagacggagtctcgttctgtcacccaggctggagtgcagtggcctgatcctggctcactgcaagctctgcctcccgggttcatgccattctcctgcctcagcctcccaagtagctgggactacaggtgcccgatgccacgcccagctaattttttgtatttatagtagagatgggatttcaccatgttagccaggatggcctcgatctcctgacctcgtgatccaccagcctcggcctcccaaagtgatgggattacaggcgtgagccaacgtgcccggccttgtcctaatatttttatctggcagatgctatacttaacacagcattggattcttaatgccatttgcaatctaaaataataacaccaaaccccagttttgaggtgaaattcgtataaatgaaggtatatggaatatttgaaatataactgctaatttcagcttattattaattatatatagttattttaaagaagagctgagactaataatttatcatctcaactaagatgaaggatgttttaaattctgctaccaccaaagtaaagttttctgatttgccatcttcgactaggctcctccttgtcttcaaattatacccattatgatagtccccttgtggaaagggactggattttactttctctaaattgctaacatctagacagtggtgtaccacatttaaatagcattcagtaaatagataaatgcatgcattaataaaacattaatatgtctccatttttggcaaatatctaatagaaatgtggaagataagaggaagaaatctaccctttggaacaaatataattggaaataatagtctttggatatatttatatggtaatcataaaatctcaggaattgtcttaaatgatttgcatagattaagtcagtaaatcctcacagcaactttgtgaagtgagttcctaatattcccattttataaatgaacagactgaagcagaattagtttaaataacttccctagggtcatttgtaatcaaacaatcaatgggcttgctacccgatgtgcatagaggccaataccatggcacaggcttgagaaaagagaagctgtattgctggttgactgtcaagagacaggagaaaatgctcaaatctgtctccctgagctgggggctgagttgggttttataggaatagggtaatgaagtgttatctgattgggtcttgtgatgagatgatgctgggaggcatgatctgactgaatcctgccatggggtaccacaagggctccatttgattggatcctggatcttgccatgcagtgtcccctttttaatccagtcccacttcttgggctgagcacttaagtcccgcccatcattgcaagtttggttcatttgggcatgttcaggttatgggaacttcagcctgggagtccatggcaactgaaaaactattcataacttttttacataaaagttgaagaaccagactggttttgtgtggttacacattcacttaataaatgactgagctggaatttgaactcaggcagtctggctcttgtctgactccagcgcccaatctcttagccaatatgcactattgcctgtgatagagatattatttttggttattgggataatgacagccaagggaatctatagagtattattccacaaaaataattctaaatacggccaggtacggtggctcacgcctgtaatcccagcactttaggaggccgaggcgggtggatcatgaggtcaggagatcaagaccatcctggctaacactgtgaaaccctgtctctactaaaaatacaaaaaattagccgggtgtggtggtgggcacctgtagtctcagctacttgggaggctgaggcagaagaatggcgtgaacccaggaggcggagcttgcagtgagtggagatcgcgccactgcattccagcctgggcgacagagggagactccgtctcaaaaaataataataataatagttctaaacacattaaatttctctataggataacttattattttcttaatgcttgacataatttatgccaaataagctcagtggttaagcaaaaatattcagatattaagaaatatcataaatcatttaatgctgtattaaatacatataatttaattgtccaaaagtattttcctgagtgaaaaaatgatggtgcaaattttggatattataagacaacttgaagaagagtagagtgcagaaagaagttatattttaggtgggctagaataacataacatttatgcaatagccccaatttgtgatataacacttcataaaaatgttcaacagtttacaagtgctttatctgaaaacaatggagaattaatagcataaactgggaaacttactttatgattaacaaagtttttttaatgaaaatgattaaaagtagactaaattgttttaagtatttctttttcattcagcattcaattgccaagtcatttcattcacagtttttaaggatgttctgaaaattctggcataagacccaggagatgaaattatttgccaaatgttgatgtattatgggaaaaaatgactctgtttacaactgtagccatgtgaaaattaaagttatttaatcccaatttcaattagccaattatgagacaaaagcaaagaactagtgaaatactacaaaacacttttttgatatattatacaattaagttatcattttgcaccaatggataagaatagggttgccataggggttcatcctaatgctaggaagcagaccataaaatctaaaattactggtagaatttatagagaattgactctgacattaagatgtaacacaatttaattgagtagcacaaatataattgtcttgcctcatggctaagtatctctgtagaactgcaattttaaaaaatgaaacccagccaacaaaggcaagtaaaaagtccataagaattatgaactctgtcaaagtgaatacaatagaagactctcagtcataattctttaaatccttctaattccttgatattcaatatctttaattgccataaggccctgaggttgctccctcttagctattaagctgacctcctactaatatgtagctctttgctgcttctccctcttggtctttattttctacaagctgacctctcagcccttttcaaatgaaaattgacccattgatcctatgctcttagaaaaccttcatgtacttcaaccccttctcctggtcctatatatcaaaaggccaagttctaggggtctgtagtctctaatagtgtgatgatatggctaccctgagaagcaacatctcatccaggaaaccctgatcagcatttttctctgcaagtggcgtcgcaggattgtgaattgtaaacagataaaaggattcttagtggtacctctgtcaagctcattacacattccagaatcaatcaagtctcctgctagcatttgaagaatatcaccaaaaaattggtagctgcgttgtttcctttggacatgcaagtagataactatcagtaactaccaataataacagccagtcagctcaggctgctgtaataaaatagcatagattgggccgggcgcggtggccgggcgcggtggctcacacatgtaatcccagcacttttggaggccctggcgggcagatcacgaggtcaggagatcaagaccatcctggctaacacggtgaaacccggtctctactaaaaaaaatacaaaaaaaattagccgggcgtggtggcgggcacctgtagtcccagctactcaggaggctgaggcaggagaatggcgtgaacctgggaggcggagcttacagtgagctgagatcgcaccgctgcactccagcctggatgacagagcagaactatgtctcaaaaaaaaaaagaaaaagaaaaagaaaaagaaaaaatagcatagattggatggcttaaaccacagacatttatatctcacagttctggaggcagagaagcctacaatcaaggtgctagttcatggtcaggcctggcccctcgcttgtggtcagcctccttcccattgggcatcacgtggccttccctgagtgtgtgggggatggcaagcgataagaagatctctggctcctcgtcctataaggacactaatctcctcatgagggcctccttccaggatctaacctaaacctcatgacctgtcagaggccccatcgccaaataccatcatattagtggctagggtttcaacttaggagttttagagggacacagcgttcggctcataacaaactgtaagtacagtcagcttcactagatcacattttctattttgagagcccattttgaaaattttaaaagctttgagattttgaatatgatcaaaagtactgagaacaaagaaaattcatttggaaagacaattggtagtctgctcacaaatgaataatctgggacacttaataatagatctgagttttgttctacgttaatgaataatgtaggtcctggcatcatggagaataattgcactttgcttctgcaaactcctaataagtgttctgccaacaggcaggaaagtagggttttctaccgcaatgaaatctgcagctttatgtctttaatccctgtggtttcataggaaggcagttctttctataggataaaacttgaagaacatgactgcattcagatttaagacaaaaaaaaaacctaaaatggaaagagtattaaaactatgtcaaagcatatgatattgatgcctcagtgttccccagtgttcctgagttcaacagaaagttctagtaaggttgacagatttccatctcaagagtctgccttgtcactcttcccagggaagagttttgcatagaagattggacacatgcaaaaacaacccagaattacatgtgtgtggcaggaagaggggacaatgtccctggaggttacatccaacaaatgcaggatagcaatcagtggacaggaagattctgagacacgttccatgggctgtctcagagagtccccagagggattagctacatagcaaataataccccacagtggtgacttttcacattttaatttgccaatgcgtttattgaatccttttatctgtgtcctcctaatatgctctgggaaagaggttgaggttgcaaatccccacaaccccgtttgagtttttgatggaacagctgctgtccacttctgatcaactgaggccctagaaaaggcatgtaagtcctactccctcacacttctgtagtgtcacgtgtatttgtccttataaacctgaatcaatctggaaattcattgccaaacataagggttccaggaagtctaactttatcaaaaggactttaatgaaattaataaaaagtagaaacttttaaaaatattgatctgtaaactgcttaggacaaaatatgtataaaactaaactgaactattaaactttacattaaaatctagggagtaataaacatcatttactatttaatttctcaaatggaagtgacatattgtcattgattcgcaacagtgagtgtggtatcagaatcgtttctggaatcttttcaaactatacctccctgctggaaattctgttatatcctcaagttgtgtttcagaaggcagaaactatttccacagtgaggcactatttcggatatatcatccctcaagaggaatatgtacagggaaaagagaatatgtacacttgataatgaatatatgttgtctgatttaaaaagtgtgcaggttattaagttggtaagttaaagataatatatttatccattatttaatatgttagtaaaggtaattatttcaaaattagagttaaaaagtttaaatttatcacctatttgagtatgtttaacatacacacacacacatgtatatgtatatatataattatatcaagattaacagcttataaaaatcatttcaaaattttggtcttcaaatataagttgtgtgttttggtcaggatcttcaatcatttatggcaaaggtttctcacttctaagacttcctcttgctttttttgtttaaagtatcatcacctataataggtatccaaaactaatgtctaacttttgctgtaattcctagttttctctaaaattctgggtcttcctttttccttttcttttgttttcttttcttcttttctcttctcttctttttcttcctgtctcccattcttcttttttttgttgttgtttttgttttataaatttaagttatgaatttatgggaataaagctgttaaatgttgttcgtatctaaaggtctttggggtttctcagatagctactggataacgctctactcacattattcaagaagaaatttgtaaagtaattagatatgtttgatactgtctatattctgattatctcaaccactgtatgaggtcactagatcccatgccccagagcctctgtgctgtgatttagatgcccaaaagactgtgtgtttgttaagcgaacattacaacaacccccaagttaggcactcctttttttttttctaattcttccaacttttattttaggttcagggggtatatatgcaggtttgatacatggggaaattgtgtgtcatgggggtttgatgtgcatattatttcatcactggagcaataaacatagtacctgataagtagtttctcaatcctcaccctactttcaccttccgccctcaaataggtcctgctatgtcttgtcccctgctgtgtgtccatgcataatcaatgtttagcttccacttataagtgataacatttggtatttggttttctgttgctgtgttaattcacttaggataatggcctctagctgcattcatgttgctgcaaagaacatgatttcattcttttttatggctgcgtagtattccatggtgtatatgtaccatgttttcaactgctgttggtcatttaggttgtttccatgtctttgctattgtgaatagtgctgcagtgaacatagatgagtgtgtatctttatgacagaatgacttacagttcttgaggtacatacccagtaatgggattgctggatagaatggtagctctgttttaagttctttgataaattgtcaaactgttttctacagtggctgaactaatttacattcccaccagcagtatgtaagtgttcctttcctgcacgaccttgccagcatctgttattttctgactttttagtaatagccattctgactgacgtgagacggcatctcatcgtggttttgtatttctctaatgattactgatgtagagcgttttcttcatatgcttgttggccatgtgtatgtcttcttcagaaaagtgtctgttcacgtcttttgcccactatttaatggagttgtttggttttggcttgtacatttgtttaagatccttatagattctcggtattagacctttgttaggttcacagtttgcaaatattttctctcattctgcaggttgcctgtttattctgatgttagtttctttttctgttcagaaactctttagtttaattaggtcccatttgtcaatttttgtttttgttacaatggtttttggcatcttaatcatgaaatctttgtcaggcctatgtccagaatggtagttcctaggttttcttctggggttttcatagttttaggttttacatgtaagtctttaattcatcttgagttgatttttttatatagggtaaggaaggagtccagtttcaatcttctgcatatgggtagccaattatcccagaacaatttattgaatagggagtcttttccacacttcttgcttttgtcaactttgttgaagatcagatagttttacatgtgtggctttatttctgggttttctattctgctacgttgatatatgtgtctgtttctgtaccagtgtcaagttgtttttgttactttagcttgatagtatcatttgaagttgggaaatgtgatgcccccggcttttttctttctgcttaggattgccttgggctcttttttggttccatatgaattttagaatagtttttcctagttccctgaagaatgcctttggaagcttgatagaaatagtaattaatctgtaaattgccttgggcagtatggccattctaacaaaggtgattcttcctatccattagcatggaatgttttcatatttgtgtcctctctgatttttttcagcaacgtttttaattcttgttatagagatctttcacctccctggttagctgtattcctaggtaatttttggtgtgagtattgtaaatgtgattgcaatcttgatttgcctctcaccttggatgttgttggtatgtagaaatgctacagatttttgtggaatgattttgtatcctgaaattttgctgaagttgtatatcagatcaatgagctattgggcagagactatgggtttttctaggtgtaaaatcatatcatctgcaaagagagatagtttgacttcctgtcttcctatttgaatgccttttatttctttctcttgcttaattgctttggctaagacttccaggactgtgcagaataggtgtgatgtgagtgggccaccttgtcttctttcagttctcaagggaaatgcctccaccttttgcttgttcagtatgatgttggctgtaggtttgtcatagatagctcttaaattttgagttatgttccttcaatatctagtttgttgagggtttttaacatgacggactgttgaattttatcaaaagccttttctgtgtctgttgagatgatcatacagtttctgttttcagttctgtttatgtgatgaatcacatttattgatttgcatatgttgaaccagcgttgtacccaagaaataaaggctgcttgattgtggtagattagctttttgatgtgctgctggacttgatttgctagaattttgttgaggatttttgcatctgtagttcaacatggatattggcctgaagttttctttttttgttgtgtctctgccaggtttcagtgtcagaatgatgctggcctaataaatgagttagagagaagttcttccttctcaatttttgggagtaatttcagcaggaatggtaccagtcttctttgtacatctgcctgaatttggctgtgaatttgtctgatccagggatttttctggttggcagactttttatcactgattcaattttggaccttgttattggtctttcagggttcaatttcatcctggctcaatcttgggaggctgcatgatttcaggaatttatccatttcttttaggttttctagtttatgtgcatacaggtgtttgcagtagtctctgagagttgtttgtatttctgtggagtcagtggtaatgccctctttgtcatttctgactgtgtttatttgaatcttttcccttttttctttattattctagctatggggctatcaatcttatttattatttcaagtaaccaactgttggttgcattgatctttgtatgattttattcacatcgaatttcattcatttcagacctgattttgctcatttcttttcttctactagctttggtattggtttgctcttatttttctagttccactaggtgtgatgttaggttttaatctgagatcttactaactttttaatgtgggcattcagcactataaactttcctcttaacattactttagctggggccaggcgcggtggctcaaacccgtaatcccagcactttgggaggccgaggcaggcagatcacaaggtcaggagatcgagaccatcctggctaacatggtgaatacaaaaatacaaaaaaattagccgggtgtggtggcgggtgcctgtggtcccagcgattcgggaggctgaggcaggataatggcatgaacccaggaggtggagcttgcagtgagaagagatggcgccactgcactccagcgagactccgtctcaaaaaaaaaaaaattactttagctgattcacagagattctggaatattgtatctttgttttcgttagtttcaaggagtttcttgacttctgtcttcgtttcattgtttacccaaaagtcattcaggagcagattgtttaattttcatgtaattttatggttttaagatattgtcttcatattgatttttacttttattgcactgtggtccaagagtgtggttggtatgattttggtttttttttaatttgttgagaattgttttatggttaatcatgcgggaagttttttagtaagggccatgtgcagatgaaaaaatatatatagtctgctgttgagtggagcattctggaaatgtctgttaggtccatttgatcaagtgttgagttcaggtcatgaatatctttgttttctgccttgatgatctgtttaatactgtcaatggggtgttgaagtctcccactattattgtgtggttatctaagttttttcgtaggtctctaagaatttgttttatcaatctgagtgctcagtattgggtgcgtttatatttaggattgttaagtcttcttgttgaattgaactctttatcattatgtgatgcctttctttgtcttctttttggttgttattggtataaactctgttttatctgaaattagaatagcaaccttgcttgtttttgctttatatttgcttgatagatttttctttattcttttactttgagcctatgggtgtcattgcatgtgagatgggtctcttgaaaactgcatgtcattgggtcttgctttattcaattgccactctgtgccttttaagtgtggcctttagcccttttacatttaaggttaatattgatatgtgcggatttgatcctgtcatcatgttggtagttggttgttatgcagactggattacatagttgctttatgtcggtggtctatgtacttaagtgtgtttttgtggttgctggtaatagtcttctgttcccatgtttagcacacccttaaggatctcttgtaaggtaagtctgatggtagtgaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattcattatcagcgaattagtgtaacgagggtgttttgttagaggctgtggttgcatttaaaaattagaataggaacaacgacttgtaaaaattcaacactttattttatttttgagacagtctcactgtgttgtccaggctggagtgcagtggcttgatctcagctcactgcaacctccccctccagggttcaagccattctcttgcctcagcctcccgagtagctgggattacagatttgtgccaccatacctggctaatttttgtatttttagtagacaaggggtttcaccatgttggccaggctggtcttgaactgccaacctcaggtgatcctcccccctcagcctcccaaattgctgggagtacaggcgtgatataacattttaacattttaaactaccacttactacattcactgtgtctgtgatttaatatatctttttcagtggccacaaaattataaaatggatacagaatagtctcttcaaaaaattaaggaagttctttttttttctttttcttttctttactttttttttttttttttttttttttttttttttttttggtttgagacggagtcttgctctgtcgcccaggctagagtgcagtggcacaatcttggctcactgcaacctctgcctcccgggtttaaggaattctctgcttcagcctcccgagtagctgggattacaggcgcccgccaccacgcccagctaattttttttgtatttttagtagagacgaagtttcaccatcttggccagactggtcttgaattcctgacctcagcccgcctcggcctcccaaagtgctgggattacaggcgtgagccacagcgcccggccggaagttctttcttcttgaagggattataaatataattcatactggcatgacacttttactaatatagattgacttttcgcttcaaataacccattcgtacatcgaaattaattttggtcagtatgtgtgtgtgtggatgtatgtgtatgtggatgtgtggatgtatgtgtgtgtggatgtgtggatgtaaatggcagtaaagggtaaaagggaaggtggagaaaagggagatggtctaacattttccacacatttttaaatacacaaaatgtgtatttaacacaatacacatacaataaaatatgtagtaaaacaatggtgtggtgaaaacaaaacattgcgaactagaaaaaagacttagccgctggtcctgtcggatccgccccgcggcggcgccctccagccctaagctccacgcagttcaacaagggtccctcctacaggctcttggcggacgtccaaaacaggcttctgcccaaatatgactcccagaaggaggcagagctccgcagctggatcaagggattcactggcctctccatccgccccgacttccagaagggcctgaaggacgggattatcttatgcacactcgtgaacaaactgcagccgggctcagtccccaagatcaacggcttccgtgtagaactggcactagctagaaaacctctccaacttcctcaaggccatggtcagctacggcatgatcccgtggacctatttgaggccaacgacctgtttgagagtgggaacaatatgcaggtgcgggtgtctcttctcgccctggcagggaaggccaagactaaggggctgcagagcggggttggacgtccgtgacaagtactcagagaagcagaacttcgactggcccatgaaggccagccagtgcgtcatccagctgcagattaccaacaaatgtgccagccagtcaggcatgaccgcatatggcacgaggaggcatctctacgaccccaagaaccgcatcctgccccccatggacaactcgaccatcagcctccagatgggtacaaacaagtgcgccagccaggtgggcatgacggctcccgggacccagcggcacatctatgacaccaagttgggaatcgacaagtgtgagaactcctccatgtccctgaagatgggctacacgcaggttgccaatcacagcggccaggtctttggcctaggccggcaaatatacgaaaccaagtactagccgggtggcccagtggcccacggggctccctccgccggcaacagcccagggccaggggaggccccttactaccaggaggagaccggctactgaggctcccagcacgctctctccacgcatcgtctccccgtctgggtgttgggtttttctgtgttctcatcttttttttttttaacctgttcagtgctgccagtcaaccgaaggtctgtgagtggcagcgtgggatcaggcagcagggttttttcccccaccttcccttgctttggttccttctcaggactgagccaccgggctgtgggggaagggatcaaggccgtatcctgatgcgtgtagggtgaaggtccccgctggcacttccaggctgtgggctgagctgtgttggggagaagagacctgggcatggagggaaccagtccgcgaaggtttctggttgcctctcctcttcccctttttgtcagccgatcagtttgtggtttctgtacctgcaaaagtttcaggaagtattaacaaaagaaagaaaatttttttcttctccgaggaatgaggcggagacagtggagagggtgctgggaaatgagtcccctgggagaggaggcccagccatgatgctaaaatatctcaggctcctgagtggctggatttccctaggaccctcagaccaacagacctcagaccctcaaacctatgctggggcccggtgaggaaactgagacccgtacaagttagtggaattctgagatgccaggattaagtctgacccctctccatcctagctcccccacccccgtggccctcagtaggttttttgtttgtttttgtttttgtttttgtttttgagatgcagtctcactctgtcgcccatgctgaagcacagtggagtaatctcgccgcactgcacctcggcctcccagcttaagcgattctcctgcctcagcctccagagtagctgggactacaggcgcccaccaccacgcctgcctaattttttggatttttagtaaagacaggatttcaccatgttggccaggctggtcgggaactctttccctcatgtgatccgcctgtttcgtcctcccaaagtgttgggttgacaggcgtgagccaccgtgcccaggccctcagtaggtcttaaggagccccggccctccttctccccttctgggcctgaccaggtctactgctctatctcccccggccccaggccacgccaagtactgcacagagccctccacccaggggccctgtgctatgagataatgtgaaataccgactgtggaccaaacgcaataaaacctctgtttttaagaagaaaatgaaaagacttaaaattggcattttaagactttattatatattattaaatatatattaaatataaatgttatacactttagcgcctctatctcccagtctctgattaggagcttaactttcctaagcctcaattagtaaacacttctggcctagccacattgacccgcctctctcctaacatcatccagtacatttcggaagcgcatgcaaaactctcccaccttctgtttcaacagatatgtcaactgatacaattatacaataattgtataagataatattagatttaatctcacaatcacactcagcttgattactaacccttcttttacatcttgctcacctaaatttatctacattttctgtgaattgaaatagcttagaaatgtatgccatctgtgtattatagtgtaagttattgtaatatagaaatatggactttctttaactcccatttgctgcctaggaaataccaatattttttgagcatggcaagtgtttccaagcattcagaagtggagagtgtaggaaatccactgcagaatgaggtctgcttgtcatcctctcagtctcaactgctctccctccttcatctctctctgtttcattgatgagtatagaagatcaggcatttttatatgaagtgaaaattgatggaactaaggtgttgatttgaatatccaaccgaccatttactgagtgtccattacaagttaaattgtgttgtagagaacagctcaggaaatgaatgcttgacattgatgtacataacaaaaatacaaacataccattaaaaaatcagacctcttatgagcatccagattctcatgtaagttttgtgaagctctttcaaaatgagaatgtaaaatttcaaaaaaaatcattttaacaagtcattcttgagacagaaaagtggaattagaagatcatatatggttgtttcactagctcaaatcttaagtacagtttttagtccattgacagccatatgattcttattttatatgctgttattcattagaaactacaaattttaaaaaatattcatgtctcattctatgaatcaatctaaaaattgcattcatttggttatatttcttcattttacctggccttgaatacttctttcctgcccagcattaaatttaattaatgtctaatttgtttacttggtttagttacttttggccacgttcagtacacttgttatgaagcaggcatgtaggaatgttgacaagtttatggtcctcactcttccaaatcccaaatggcggcaccccaacagacacataccacaatgtaaacacatacacacacacacaatccacacccacccatactcacccacctacacacagacacacacacactccagtggatcaacacataaaacactccaaaggcaaagacattatccatcagggacctcttagtgcgctacacacttctgtaaattatcaggactcctcaattgaggtgagtctacagagatttcaaaggctatttgagtgctaagctatctaactagtggttggacactatttaaataatgcattaaacacaactcttgaggctctgaagaatttctgtgctttccaatgaaccaggagttacaaggtcctgaaaagcacaagtgtgttacatcctttaatagataaagcaaagcagattttaatgtgaatatgctttatatttacttctattcgtgttaatttttctttgcctgtaatatacatttttatataatggggaataagaaacatcttaggaaaaggaaaacaaaaaaataaaatttctctgtttaccctgtgccttggtccagtaaccctgcactgcacatatacactttaaattggtgtcttggggaaccacttcggtatttcattttaatagcgcatcctggagaatatatttgagtggttcacatattacaaatgatttaaattttgacccatatagaaataagttttcaaaaatacgtctgaagcctggatactgtaaaaatgtttatcatcatagaataataaaaggctagccattagttactcagaaattgttcagtaaatctaagacaacttagacataaatacttatgagtgaatatagttcatcattaatgtttgtaaaaattaatgctgtcttttatggttgagaaaaactagtaatgtaaatttgatagagataaatgacataaactttacataaagcaagagaataatagatgtgtaaaaatgttttatagataagattttaagatgaaattgtgctgaacaacatgaatcaaatatgttttgcatactacatctgcagctacaacatcacagccttttaagtatttcattaacttcaaaatgtaacttattgctgaaacaatctgatttaatgaattgggataacgggtaatgattggtgtcagctgaaagcaatgctacacttttaaagttagatttctttgtgtattaatacaaacaccagagaagatggtcaataaagtaattactgtacaatgcctatcataatacttaaacctggaagaaaatcagtaaatgttaagtgaatagaattggtgaattgcttccattttatacaattttttgttcattttagggcttaccaaaacttgcagctctgaataaggcccaattatttactccttcaaataaaacaagactgcaagaataagtgtgaatgctttgttttgttttgtttttcactgaaatattccagtctgtagctgctccaaatcacactgatctttctagagtctgatacaggtcctggtctcaaggccagtgttaccataatcaccatcttttgtgcttcaaggttgagccctcctaatttacctgcatgaaattggaaaagtcccgtttcatactttaagcaacctagatgactctttcactgaaagtggtattcttcttgcttttttttttttttttgcagcaaatgatgtcaacttctacctacacctgacatctcaattaatttttgacattttcttcttcacatttccatttcaaatcaccaagtattgtcagattttaccttctatttcttgaatgaatttttctctttctatcttcattgccatcatggattccagcccatcactctctcacctgggctatggtgagcacctctaaagtgctctccctgattctctctccaaaaatggttctgtgctatatctggaatgattacttgaaatgtaaatacaatttgcattgtaaattgctttgcttaaaaactcccaaagacttcacattagtactaggataaatagcaagagtccaaaaatgggttcaagcagtacaaaatttgtttcctttctctttcccccctcttgtggcatgaacattgttgaactaaatgattcagatgtatttcttcttgtctcctggactttgatcttcttactcatatgcttttcccactaccatcccagatttatataattagctcttactgggttttttttgtttgttttttttgagatggagtcttgctctgttgcccaggctggagtgcagtggtgcgatctcggctcactacaagctccacctcccaggttcatgccattctcctgccttagcctccaaagtagctgggactacaggcgcctgccacctcacctggctaattttttttttttttgtatttttagtagagacagggtttcacggtgttagccaggatggtctcgatctcctgacctcgtgattcacctgcctcagcctcccaaagtgctgggattacaggcgtgagccaccacacccagccagctcttactcttattttagtttgctcttcatcttccccaccaagggaaaccttacctgatatccctaaatatgaaaggctttcataacagtgcatagcttttctctgtatttataatattgtttttaggtttttatatttttattactatttataatagatacatctgagcatgctctttgataataagtctaataaagttttgatgcatttagtaattcagtacaaaattgttttctataagccatgattctagagattgaggggaaagtgcagtggtaatctgtcccaaatggaaggacaaatagccaagcaatgttgacctacccattcacctctcaaaaacagggttaagatattgattctcctgttttcaggatgaagcagggacagggagtttcttgttatcctctcaactcactctttttatggaaaaagtaattaatctgataaatgacacaaaagattttgatgttcattaacaaggtggtgattccaagaagttgaaataaaaagacttcagagcccatctctcttaatcactatctttggtctcttgaggatgcttgtgcacaaaatagggagcacccatgtaagagctgcataggcaggctcagtccagcgactggtttcataaatccaacttttccaagcatgatggaatgtcagaatcccatgagccaaaagttttatgatgagagaggaagaatgatattttactccccaatctaattttaaaattaaattttaataaagttaacaaacctgaatacacacacacacatgcatatacccacgcatatgcacgcaggcttcttgcattcttttttttgtttaatcattcaggagaaatggttggattttgtattttctatctaccaatacttgcacaaactctggctgcaaaacttttgttggtcaaacattagcatttgggaaaccacatccctgctgagagatagaagatcttgatacagccttaactacatcatcagtagacatgggactgtttttaaccagaaggaggcaaatgtcttccagatggttgtgtagctggttttaacagtagcctgcagtggctttttgacagacataaaccttactagttattattaggtttcagagcattagtatgaaattttaatttgcttatgttagggatgagaaggtagcactatcctagatgccctaaatattgctccttgtcactttttccacacggaattcagaggtaatctggggactgtgtctaaaatgctcttatattcatgtgtttgccatgggtttctgaagctttcattctgaacatggtctcaagttggctcttgagggctaatttcattacacatgatcataggcataaatttaaatttgtggaggattgttttgtacaccccacatgaaggggtgaccttcccctccacacctgtgggtgtttctcatttggtgggatgagagactgagaaaagaaagagacacagagacaaagtatagagaaagaaacatgggcccagggtaccggcactcagcatatggaggatccacgctggcaccagtctctgagttccctcagtatttattgatcattatctctaccatctcagagagggggatgtggcagggcaatagggtaatagtggggagagggtcagcaggaaaacatgtgaacaaatgtctgtgtgccataaacaaggttagaagaggtgctgtgctttgaggtgcatgtacataaacatctcggtgcattaaagggcagtattgcggccagcatgtctcacctccagccttaaggcagttttctccttatctcagttgatggaacatacaatcgggttttacactgagacattccattgcccagggacaagcaggagacagatgccttcctcttatctcaactgcaaagaggccttcctcttttactaatcctcctcagcacagaccctttatgggtgtctggctgggggatggtcaggtctttctcttcccacaaggccatatctcagactatcacttggggagaaaccttgaacaatacctggctttcctaggcagaggtccctgcagccttccgtagtgtgtagtgtattttgtccctgggtacttgagattagagagtggtgatgacttttaacaagcaaactgccttcaagcacttgtttaacaaagcacatcctgcatagccctaaatccattaaaccttgagtcaacacagtgcatgtctctgccagcacagggttgggggtagggttacagattaacagcatctcaaggcagaagaatttttcttagtacagaacaatatggagtctcttatgtctacttctttctacatagacacagtaacagtctgatctctctttcttttccccacaccacagaatctggattcactaccaagagactgtagcatttatcaaaaagaagataaagagaaataagagttcttgttgtctagggaatatatcatcttctttaggtaatgcttattaatgctcctcaaaatagctagagcattcaagctttgtaacgagttcacaatgagagaagtagcttctactagaaattaaatgttacttctttcattgagtaactattgctacaagaatatgtttgctgaataaattagcacatttattgacataattgatttgcatactgtggcagcacttcatggagcaaaccttaagtcccatgaaaaattgaatagaattatttgacggctaagtatcatcggaaaagcctggctctagttctcaggaagcaatctggttgattatgtgttttcagtgtgtagtcataaaacaactgtatatcactagtgtacattagacactttgtgcactctacatatattttctcatttgatccttcaatacatgcataagagaagaaatatacgtagatttaattgctccactagggtcaaagaccaaaaacctcattacaatgccaatgttagaaattcttcttccaattaaaataaagctaccaaagacaattgctcctgccataatgagaaaatattggatgaacttaaaaaaattattatttttttgtttaaagccatcaaaaaactgtgtgcctaaagtttcaatgaactaaatttcagagaaaaacaagcccttccttggtgatcacagattaacaacagagcccatctctgggacatttgctggatctggggccttgagtaggtagaagaacaagcctacaatgtgcagaaacagctggaacattgggaataagcaaaataatctacagggaattgcaagagggactgaaaactagaaagatcatgtgttctcctcgcacttacttattttcacttaagagacaggttctcattctgtcacccaggctatggtgcagtggaataaccattgctcactgcagcctcaaactcctccctcaggtgatcctcctgcttcaacctgtccagtacatggaactacaggtgcacgacatcatgcttggctaatttttaattttttgtgtgtggacacaaaaaccaactaggttgcccaggctggtctagaactcttggcctcaagtgttcttcctgccttgacccccacccactccaaacactgggattacaggtgtgagtcaccacatctggcctcccctggcatttagatactaaactgttggaaaaatgagtaaaaaataaatataagtagcattttgagtattttcttcccgtacacccatggattgtttagtgtatcttactacttcacataggagaccattcctgcatcaaactatgtaaactaagtatttaaatttgatttttgccctacaataggctctatgctaaagctcattatatttgattttgacaatctgtttttataccacagttgcaaaaaattaatcacattctttacttcatgagactatcattattgtttcctacaagtttctctggttttacttgtttcatttttaaattccttatcccttgtcacagacaggcatgctaatgtgtttgatataggttctttactcttaaagaattcttacaagataagaaggttgttttctgagtgtgtgtatgtgtatatacatgagtgtatacattttgcttaaagagtattgtgctataaatctaattttatttctaattttttcacagagcataacatccttcatacattcccacattgctgtaggttatttttggttgtttattcccctgtagctgctgcatagttttcaataaaatgaatcaaccacattttccctatccagtcttgtagtagaattcacactgatatcctgctactgaaatattcacttccttatggtatccttatgaaaacactttttggtcatgtgtcacaatttgtcaggggctgtgttagtctctttgtattgctatgaagacatacccaatcctgggttatttatttatttattttttaataaaagaggtttatcttggttcagggttctgcagactgcacaggaagcaatgatatctgctctgggtgaggcctcaagaagcttaaaatcatggcagaaggtgaaggggagccagtgtgtcacatggtcagacagggagtaagagagagaagggggcagtcccaggctatttctaacaatcagttctctcatgaactcactgagaacaactcactcaagtggattgtgctaaaccaagcttgtccaacccacagcttgtgggctgaatgcaggtcagaacagctttgaatgtggcccaaatttgtcaactttgttaaaacaaaagagagtttgtgtatgtgtgtgtgtgtgtggggggggtctttattgatttatttatgtatttatttattttagctcatcagctatttttagtgtattttatgtgtggctcaagaaaattcttcttccaatgtggtccagggaagccaaaaggttggacattcctgtgctaaactattcataaggcatccaccccatgatccaatacctctcactgggccccacctccaacatgggggatcacatttcggcatgagatttggaggggacacacatccaaactatatcaggtatatgtacccatcattgagacaggttgtagagtatgcatactttcaaatgggtcctgtcatgttattttctgaaatggttaaaaccatttaatttcccatccattgcccataaaggttgttttcctcatatcctcatcactcaatgttatctaggattcttatactttctaagcaagtggtgaaaatacagatctcattttatttgtgtacatttgcatttgtcagattgttaacaatgtattgaattttttggcccatttttctattgagtttactatcttctttgttcatctgaatatcaatcatattcactttgccctaagcagtgtcaacattttctattactctgtcatatatctgataatttcatatgccaacatttactgaaatgagtctttatgatttttatacttcttctagagtttatgtatttaattaaatttgttggtttagtatatattttattaaactgtaacaacagtcccaaatctatgttttgctgggttcattcagatttagaactcagataactttttggaggataaattctttttatcataatgaagaatggctatcataatgcaatatgattacttctgccaatgtttattgttttatagtctactttgtttctgtggtcaggaggacaagacctgaatggccttgaccaactcagctttctgtacctcctagttctcagaataattttagaatgctccaagaagacaatatcctgagatgagtagaaactgtctgggacagtctgggctctgtccttattgttcctagaacaggatattactgcagcccttaaactcaaagagccaaggtgcatgtggggtgtgaaacctagggtggagcactcatgggttcctcagtgcagtacacagtggggcatgtgcagaggagactccgtcaaccctgggcaacttttctgacctcaagggtcaggcttgccatagaacttaatggttttgctgattcttcctgctcctctgtgagtaataaatttggtttgcctgacttactgtgtgagcattcttctgtttctggcagcttggtttatataaaaaacctcctactagacctatgaatctatgcaatgtggaagtgtcatagaggtaaataagaagcaacttaactgagctaaaaactaacatgcataacaaggggccactgcaccaaggagcaaaatgatcctgccaaaaagtcacatgtgaccattccagacatactgtggaagaagaaggatgctgaaactcacagagatctgaagatcttacccaagccaacaggaggctaataaagcaagagaattccactgtactttgattcgagaatacaagcttcatctcagagaagagcaatgcaatggccccagcgatcagaccagagagaccctctgccacagagaaagcagaggtctagagaacagcatgaagacaataagagacttcagattcactttccctttgccttgaggccacagaaagcccaaagcatctgaacatcttcctggaggcatttaactaaaagagagctattgaaagttgaagaaaaatgtgaatcaagaagctaaatttaaagatatattactttctccaaccctcccccaccaattaaccataggatgagtctagtgagataaagcatatcatttatacaaaatacaaaagttatatgttctttatgtgagcagaaatatgttcaagctttactcaataaaggtattttgtttcactactagaaatggtaattttcacttggtcattactttattttataattatctctatttaaattagtatcagctcactcctgggtatccccctagaggaaaagaagtcatatgaaaaagacacatgtatgcacattcatagcagcacaattcacagttgcaaaaatgtgtaacaaggttaaatgtctatcagccaatgagtggacaaagcaaatgtgttatagatacaccatggaatactactcagccctaaaaaggaatcaaataatgacacttgcagcaacctggatggagttagagatgattattctaagtgaagtaactcaggaataaaaaacaaatattatatgttctcacttataagtgggagctaagctatgagagagtgaaggcataagaatgatttaatagactttggggactcagagggaaggttaggggggtgagggataaaagactacacattggctacaatgtacactactcgagtaatgcgtacaccaacatctcagaaatcaccactaagtaacttttccatgtaaccaaaaaccacctgtttcccaaaaactattgcaataaagtaatatatatgaaaacaatcaacatgatagtcttgaagtgcaacattcactgggtttcatatgggagaaaaacagctaaaatcaaacacatggacaggcagtcagaacaatgtccatcatatacatagtaaaattaatacaaggacaaacattcatgagtggagtccatttgaattagactgtagtgaagacatgtgccttagggcacacataactcatgttagggagaaaatgtataattttactcaatgtgaaaacatcttcagaaataactcaggccatgctgtccagatgcagtcctgttctgtagagatgaagaataagaatcatcaaagtggaaaaacctctgtcccttctccaaattcttgtccacacaggagtagtactactggagagaaaagccatacatgtcccaaatgaaggaaagcctttacgttatcagtcatttcttatgagacatatgaaacttcacactggagagaaaccttatgaatgtaacaaaagtgagaaaggctttagatattccctacaccttaataaacatttaagaaagaacattctggagaagccctatggatgtaaggaatgtgggaaagccttcaagcaaggctcaaaacatgcacatataaggagtcacactgggagaaaccctataaatgtgataaatgtgaaaaagactttgcaaagtcaccagaattaaaagccatcttaagattcacaatagtgagaagccctgtgagtgaaaggcagggaaatcatcattaatttttcaccgtactgaacatgtgaggaggacatactggaagggagctcaatgagttaacacgcttgagaacatctttcctgaactctcctatcttacagaagtgtgaaaagaaaccctctgaaggtaaagtctatggaaagcctttcatcttcattcatcgtgagtagatatttgttctcacactggagagaagctatgaaagtaaggaatatgaaaaaagcctcagtgttgtctcagactcatagttcatacaagaactcacacagcagagactgcttatggaagtaaaaaatgcagaaaatacctctttaaacactatccctcctttatacatgattccacaccctggagggagactacaattgaataaatataagaaagctttcagttccagctcttcacttattgggcatgaatgagcacagggtaggactgaagcacagtaaacgttaacaattattgcctttagcattgtcttatcccccaattagaactcaaattcataattttgtagtttttcctttcttaaaaaatgttataagatgacagatatctgtcttagcaacctttccgctctgccaccttaatgttgctatgtagtagctttgttacaattcatttacatacacatagtttcattttcaatgggaagcccttctgagctccattcaatttagatttagaattcgtatgctccatgacaccttttttgtcagtttgtttttgttggtcacaatttgactgcattatggtcccattatgtggttttaatggtactgatttggtgtacctgttatgactttcattttggtctaatgtggccaatgctgtccatttccctgctatatccattattctcatcttcttcactaagggaacatagattcactttttccaaggagcactgtttaaatgtctttatttatttatttatgcatattttattattttacaatttttttttgaaaaatggtctcactctgtctcccaggctggagtgcagtggcatgatcagagctcactgcagccttgaactcctgggctcatgtgatctcccagctcagactcctgagtaggtaggactgcaggcataacaggtgtgcaccaccacaaccagcttttgttttgttttgtttttgtagagactgggtctctttatgttgcctggactggtttcaaattcctgtgctcaagtgattctcccacattggcctcccaaattgctggaattacaggcatgagccaccatgcctggccctggttaatgtctttaaatgagtttcccagtttttctcgtaactgtagtgagcaaattttatagtcctggccaatgtgaaatgcagaattcactgctttggatttctgaaaatctgtttggaaaggggagagttattgttcctcttttttgttgaccaagttccctttgctctctctgcttgctgctgtctggaaataggatgaaatgccctgagttggatttagcaacttgaagaccattggaacgattgtccctacaacaaaaccttcaatctacaagatttctccctccccaatggcatgttgtgtatccctggctgccctggactatttctggacttgtttcatgaaactaacccctagtagaactaagaaacattttaggagagaagtttataacagattaaatgataaacctaaaaaatgaataaaacatattataaaaataaagaggatagacaaaacgggcttgcagatgctgactggccacactcatccttggcgcttgcccccatggatgcctcactcactgtgacacttggagagctggcagccatcactcgaaaatcagaacacagtggcctctactgcagcatcagggaacaaaaactaagcctgtcagctctcaagaagcatacttatgtgtatatatatataaatatatatatatgtatatatatatgacataaatttattcagggactttgagttatctcatgctaaacagataaaatgaattaaaactagtgcaaagttatggcaacagtactccccattatttatgcagggcgttgaaaattggcacacatcacagatccttaagtcattctctgaatcaggaggagaaaagagaacagagagagctcactatatgtgccagtcactggactgagtgctgcgcctacaggatcccacttgatgcttgcaataaccctgcaagataaaggtaaaaactcacacaaacacactcacacacacaaaaactcacacacacactctcacgcatacatacacacacataaactcacacatacacacgcatgctcaagcacacactagaaactacagaacaaaaaagcattgacaactaatagaagtatagtgctggccaagcaaagtggctcgtgcctataatctcggcactttaggccaggagttcaagacaagcctgggcaacatagcaagacaccatctgcacaaaacattttcttaaataaacatcatttttaaaaagaggtataatgcctacaggctcagggaagcaatacccctatggctgtatggtaagcagcaggcaaggctatttttcagaccaaagtggtagtgactccagggttcctttgcacacttagccaggagactagctagctcagcactgcctgggttcactttacccttctacagttctaaagctctggcaggtgggacctaagcatcacagaaagtgctattatgaaggactctcttgactgcaagtgactgaaacgtaactggatccagcggaacattgaattatttggctttacttactaaaaatgtacatgagttagatgggcttctgtctcagtgggatcaggggtcaactaatataaaccaaggctcattctgtcccttcatttcctgtgtcagctctgcttttcaggcaggctgttttgagagagcagcaaaaatggccccataaagttcacatcacttacttccttacaaatagatatgccaataaaaagaaagcacctcattcccagcagtttcatcaaaagttcagggatgacttccatgagcccagcttggatcacatgaccactcctgaatcaattaccctgccgatctgattgcccagggtgggtcagccttcccaaatcacatggactagtattgaaagagaggtcctcccatgaaaaaaaaaaaaaaaaaaaaaaaggaagagtagtggcagaggaatatgagtggggggggcctcatctctatataaaaagtatgagcgtacttgtgctcttttgtacattcatttgtatagtcactggggaaaaaatgagaaaaacccaaacacggctttctatatgcctctgtgctttgttttcaacactgagctgtgagaaatctagttattaaaacaaaactttgaaaaaatataacaatttgggacaatggggacacttagctgatgcagcacaggtgagcagttcttcttttgtgcccaagaggacacaattcccaggaggctgcatgtggtctcctaggacaagcctgtgggcacccactggctgcagttccacctttccttccctggactctcaggaagacatgagttctggattcagctgaattgagctcaagttcaggctctgtgactcactggctctgtaattctgggtaagtctcttgctctccttgagtctcatatcctccttggtaaaatggagaggtagagctattgttagattttgaaggcaaggcgagggttaaagaaagacagagaaagacagttggcggcttcaacagcaacacctttattactagcaaaaccctgcagaggaggaaaccagcttactgccagcaccaactgcctctcacaggctggggtgatcatgggactgggaaggaggggtctgggctgtagagcttgctgcccggcaggatatggcaaggatgttcctgcagtcaggctgttgggcctttgcccgggagggtgcgataaggatgtttctacagtcaggtgatcaggaaggatgcttctcacggcccgagttcccaaggaatgtttcattctgaccagggtgtgcaaaatggctgcaggtttacaaaatggtacaggttagactaacagcaacatctcccaggtagacagttctataaagtaaacttcccttgagcacctacactgtaccagacatggtgctaggacccaggccacaggaggaataggacagatgaggcccctgccatcctggtgctcatgcctgatgaaggaagctaacaggtcgcaagaccaggtcatgtggtggtggtaatgaaagacattaccagagtgagatgagctagaaagaaactgaaggagctgttccaaacacagtgacagggagagacccctccaagaggtgacttttgagtagaaacctgagatatgtggagaggccatggagaaggaccagcccctgaagccatcccaggattaaagacccagcagcaggagggcaatagaatggcctgacctgtgcatccttcatgcttccttcctcagtggtgcccaaacagaaacatgggacaattctgtgcaggtccatggagggagcaggaagcagccgcagtgaagagccatggtggggatgaaatctggcccaacagtaaagctagaagcaggtgctgcttaccaatgaccgcaacacaggtcatgaaggataaccagtccctgaaggcatgtccagggccagaccagctggttgggctgccagcatcttagtagagatcccaggggatcagatgagctggttagggggagaaaaaaacaggaaaccttcaaaaagttccagaggacccatgacacttagaatgaacttccccggagtgggatctgtttggcattgctggtcctaaagagttggtctcaccatccccacctgcccattgtcccaacagggaccccactcagggtggggtccacagaaacaatccctgtggaagggaaaagggtgtttcccatccaaaaccaagggaggacacccacaaaacaccactcataaggagcagagggccctgcagagagagacaggtttctgctgctcttttgggtatctgcttcccagaggggaaggggaccatgcaggatagaggggctaagtggaccctgggctgtggggctaggggagctgttgctggctcactgttggaggtgagccacaataggaggcttagaaccctgccctgcaacctctccaatctaataaggagatggtagtgtggttagtgggggcatccagatgcagtcaaagggcacagggagtgatgtgtcccctggccacctctttcagctgtagattctccctctgagttactggaacagcttctccatggccccatcagcctggagtgtggtgacagctcccagatgatgctaaccccagggccttgcaccttcctcatggttccccttggcccagcccacacgtttgtaaacagctttttcttaatgatctttcagccacttcgaggtccctgccagcacctgactgccacattccccaaagggaccagactcctcggcacagtagctgaggtttctataggcacagagaaaacactgtcccaactgttggaatggagctgggagtggaaaaaataatgttttttctcaatgcttagacttaccaattgcttcattttatcacatgaaggctgtgtggcactttgaagtagaattagtaatttacataattacaaattatgttttgtttttttttttttagatggagtcttgctctctcacccaggctggagtgcagtcgtgccatctcggctcactgccagctccacctcccgggttcatgccagtctcctgcctcagcctcccaagtagctgggactataggtgccaaccatcatgcccagctaattttttgtgtttttactagagacggggtttcaccaagttagccaggatggtctggatctcctgacctcgtgatcttcccgcctcggcctcccaaagtgctgggattacaggcataagccgctgcgcctggctacaaattatgttcttaaaagaagctgctcagtgccatgcctaacacaagatggaattccacgatgagatatgtgtgaagacagggtgccatggttacaaacaaggactccaggtgcagactgtttggttcaaacctggaccagcggtatgaatttttgcaactctctgtattgctctttgcctcagttttttcatataacaactagaagtaaaaacaaggttattgtgaaaattaaatgaattaaagtaagcggagtgcctacaacacccccaggcacacggtcagcactgagcatgtttttcattactactcttaatgaggtaagaatgagaaaacaggcgccagccatgagcctggggtttatctggcaaaggcatcagagaccccacttttaacatcctccattcattcatttgaccctgataaggaaggagtctcatgagagaggagcaagcctccaccttggggccagacatctcatgatcaaagttgaactctaccactgttcagctgggtgactttgggcaagtgactttccctctctgatcctcatgtccctttttgataaaaacagcaaaatgtcaggcctatggggattcaaggagccaaaataaaaatgtgtgtcttagtctgaatttcctggaagtagatcctgaggcaaagattcaaatacaaaaattttgtttggagataactctaggatattaattcgactgccagttcttccttagggtgctaatcccaggaaacatcagtggaggagtggggaactgagacaggaaaggaatgcagcagttaaagggaccttcatcaagaaagtttccactgtggcagccaggactcagccctgccaggtacctctgagagacagcacagaacatgtgcttcagagtcgtcatacccagagcaagggaccaggggtatttattcaccaatacccaccagtcactcctcagggatcctcccaagggcatgattcctccagaatgtcctgcctgcgctgcaagggtcagacctgggattgagggcaggacccctgacagcgcttccagcaatgagcagaacgacagcttgatgtgtacagtttcagtcacccagtaactccaacacacacacacacacacacacacattcacacaccacactccaacaccaacaaagtatatacgtacatacacatacatgcatacatgactgttacccacttagatcctagtgactccatgggatagacgataaggtgggaatcagaggaaagagtaaaattaaggcgagtgaaagtcttaagaacaaaatgcaaatttaggctgaaaatgaagggggaggaggtgtggtctcgacaccaaatgcctgctgggtggcacatgctctacacacactgtcactaattctccaagcagcctcatggagtaaaagaaattcctctcaatgtacagatgacagaaacatagttcagaaaagaaaactgattttactaatgtctcagcaagttagtgggtgacatggagtcccagatctttctgtccacaaagcctacaaattctcccttgttaggcaggctgggtaccaggccctgcttctgggctctgcttcttttcctgctaggctaaaccggcagaactgacagagacatcatcccccttctccacctggagcagagccaatgagaggggctggggaacagccatgaggcctggcacccaccattaaatgtcttcagaattgccatccctcagaactcttgcaccacgaggtggcagcactcccagtgtctgggtgtcttctgaggggtaccaggatccagtagaggccactggctgtgctgtcatatcctaagtggcagccaggcaggcttgggtctcttggctgcttcagcaccagaggttggacagtgcccatgcactgagtccctcaggagaatgggagggaaaggaagggcagaatggagtgacgtagggtccatccaccatgtccctggatggagagacccctgttcccacagtagtccacaccaggaccacgattggcactcacgaagatgccagcctccatgtatatgtccttgtctgacaactcctccttattttcatcctggagacaagaaccctgaacacagtagctctgagggcacctgagtgtaacccgagacagtccctgaagtcctttcatccaagcaggatccctcccttgccatctccagacctgccccacaaactccctccctggtctcctggctcttgttcactccttccaggcagccttccacagtcatctctaaaacatatatgactgtccctcctttatccagcaccttccatggctccccagagccctccaggtcaagttcaagttcttcgatcagacactagatctcaagctgcattctaccttttgaattaagatcccggagaagcccaccttgctcagcacaaacgcatcactgaagtcgaaaatcttgaacgtggccttggcattgaggaagtcatcaacaccctggctagtgagggtgcagtgccgctccaggatgatggtgtctaaagttgtgccccaggtcgcaggccctgcagaagcatctcccctcaggagtgaggtagtacaggaagtctgtgcacaggcagatctgctggtgctcttacactatgagggcactgagctccaagatggtggcaatatattcactgggattcctgcacggtgaggttggagagaggaagcatctccataacacatatgaaaccctggaagcacttcccagccagaaactcaggaccacgttatatgcagatacgggtgccctctgagcacacttgtctctctgtctcccactctgagctgcctcctggccccacatgccccagcctggccaagggcttagcccagtgggtgttcagtccatggtgttgactgctccctgggccaagagaacccttggtgctctgtgactcctcctgtggaacccctacctctgccttgggacctcccaattcccatggaagcccccacagctctggattgccccacctgccctgggatcctccagtcccataggccttactcgatgccttagtcctcccagaacatgacacgtttctccgaatgtggctgatatccagggccatctgtagatgtttgctggggacctcttgctgttttcctttatggtctgtagggcagggccaagaggagaaaccagcccaatctcagaatggacaaaaggctcactgccctaacggcaaccaccaaacagtcagcagtgcttctggatggaaaagaggtttcattctgcagaaagctccttgtttggcttctttctgaagccagggaggggtaccaagaccagcttacctgcggtgcctacattagcatctgtgcctaggatgtgtgatgggctcccactgcagggttgacattccctccagctggagacctaggttcctgacaccacctggcgtgtttgtcctgctctggatgatggtggaaaggctgtatctggtattttcctaggtccttggttttcaccttctagacatccagcaggagtgaccatacccagccccacacctgaaataggactcccttgtagagcagctgagacatctacagacagaagagtgctctggtgagacaggccacagcagtccccggggaggatcgggggctggaggattctggaggtttccagccttgggctctgtggttcctcaaagagtttaggtttacctaggactaggcctcccctcccatgattcaaagagtgggtgagtgctatgcatcaggaactctgatctggacctattttttcatttaggtcaccaagagacaacccctaacccccaagctagggatggtccaagctctggcatgaaattctcttccagcaatgtgatgcttgcagggacagggagaaaagctggtgaccaggcctgctgtcccccaggtaaggacagtgtgctacccaccctctgagaggcaggtggtgccaggtcactgcactgggtgcctgtacccctggctctacggacaccggtcatggaggtcctcccctctccacattaccttcttgctgctcctagatttcttctggtcattaagcactttgagccatttttttctgtgcagccgatctgatatttttgctatcagatgaaacatgacaaagtaagccaagccaccaggattcctggagggaactttggatgctgtgtcttgggatccagagccctgatgggactgaaccagaaggagccagggaaggacaaacactgggtctcaggccctatgacccaacggccattggtggcctgtcctcatggccccaagacaccctgtcctcaggccacagacaccatgggctttggtcaggtcccagcctcccagtagtgccctggcgccggtgggtgctgacccccaaaccacaatagcagttctgggttatgggtttggtaaaaccacctcagggagaattctggggttgggtttggcaggaaccacggggcctcccaggaatgatgtgtcactcctacttgccacaaaatgtgcacagaggctgtcccactgaccagcccatcctgctggacaggatggaggaagtcagggaaaaggcagggtggacatctggggtgcagggagaggcaggtgcatgctgggaggtcagaccctgcgagggctgtgggggcatcaggtggggtgggctccaggtgcaccctcaatgcactgggtgggtgtctcaggccaggctccctggaccctggttggctgatgtggtcacttcctgggggactgctgtcaagccctggccacccaccctgggcagcaccatcccatcccaggaccagacttcctgagtcctgagacaggacagtgctgtccaggcctgacagactgggaggacctgccaagtcctccatccctagaccagcctcccacacagcagggacagtctcttccatttaccttcagggcactgactgatccatgtcactctaaggcaaccaaggcagagctgaggacctgtgccaggctgggagccagtctcctccctaaatgggcctgaggaaagcacaatccctgtcccaatgcgccccaagtttcagcccaggagacacatagggaagggaggacggagcctctctgctggctgacacttgaaaagcgggacctgggagtagatggagcacagggctggcagggatgctccaggcccatggagagcttgggctgcaccaaggggctgccccttctgggctggaggctgtgtcctctgcaggatctgagaaagtccagtccagagatgggacactgctgccaagggtgggtggctgggcctgacagcagtcccccagggagtgaccacatcaccctaccagggtccagagagcctggactgagacctgcccagtgcactgagaatgcacctggagcccaccccacctgacgcccccacagccctcacagggtccgatctcccagcatgcacctgcctctccctgcacccctgctgcccaccctgcctgttccatggcttcctccatcctgtgcagcccatagactgtgaccatctctctagccactctggcccgtcctttacctttgttctttcagaatctctgaacaagatctcccaggtccatccaaacacctgctttgtccacttttgactgggccattggacaccactgggccatcccagctgtccatagggcccctgataacatgcatttcccctgacaacatgcatttcccctgacacctcccagcagtgctcagcagccccactgaccaggtccctgctgaccagatcccgcacatcaggtcctccctgaccacaccctcactgattaggcccccatcaccaggccccactaactagattcccgctgccaggcccacagtgtccaggaccccactgacaaggatttcactgacaaggcctcactgaccagggcctcactgacaagacctccctgacaaggcctcactgaccagggccttactgacaaggcctccctgaccacattccatcaatcatgaccccattgcctggccccacagatgaagccccactgaccaggtctccagggaacaggctgccagtgaccaggcccctactaaccaggcctgcggtgaccagatgcccctgaccagaaacctagtgactaggcaccactgaacaggcatgtaccgctcagacccccgttgcccaggtcaccccatagaccagtgctacaaaagccaccactgatcaagtcctctctgaccaggcccccactgattaggttccactgacctgaccaggctgccgtgaccagggtcccactgacaagggcctcactgatgaggacatgccctgctgactaggtcccatgtgaccaggcctccactgaatagcaccccttgaccgggtcaccagtgacccagcccattctgacaaggctaccaccaagccacagctgaccaggtctccactcaccaagccctgcagcccaggtttgcactgaccagacaccaaacatttgtctgccactaggtccccactcaacaagacctgcactactcgatccctctaatgagaccctctctaagcagaccctggctgaccattcccccagtaaataggcctcattgaccaagtcccaactgactagttcactgaccaggcccacactgaccaggcccttcctaatcataccagaaggccaagtggcaatgagatgtttcatatggcaggggtaggagcaagacacagagaggaaagaggtaccacaccctgttagacaaccagatcacatgagatctcactatcaggagatcagcatcaagaagatcctgcacccacaccaccgcccactgtttccaggcagaagcctcctgcagaggccaagcctcttgagaaatttccactatggcagtgcagaaggaaaatatgggcttggagcccccaaaaaggaggccaccatcctccatatcccagattcataggcccaccaacagctcacaccctcagtatggaaaagctacaggcactcaacaccagcccagcccatgagagcagccatggggctaaagcctgcaaagccacaggtgcactgccctagtagaggttttccatgagcctctgcctctgcagaaggctactcccccttcctagtaccccccaccctcctaccaccctactgacaacctactcctccccaccctacccctccttttcctaccaccccgaaccccctcccattcaagattaaatcacctaccaccaggccccaaaattaaggattacaattccatgtgagttttatacggacacacagccaatccatattatttgacccagataccccagaacctcatgtccttctcacacagcaaaacacagtcatgcattttcaaaagtttccaaaattcttaactcattccaaatataaaaaattcaaagtctcatctgagacaaggctacagtcccttcggcctatgagtccctgagttcaaaaggcatttcttttctttcaagatacaatgatagtaccagcattaagtaaggtttctcaatccaaagggaaaaaattccccagaaaaatacaaaaatgtcagtccaaaccccagcaggacaatattcactcaatctttaagctccataatcatcaagagaactcactatcacgcagacagtattaaggagatagtgtttcaccagttgtgaagaatccgtcccccctcatttttcacccccacccacaaaataatctctcctattgtccccactcccccacctccaacccccactcttctccatgattaaatcatctcccaccaggccccacctttaacattccccattataattccacgagagtattggtaggaacacagggccaaatcatattattctcacccaggtccccccacatctcatatccttgtcacactgcaaaatacaatgatgccttctctacagtcccccaaagtcttaactcactccagcatttactgaaatgtccaaagcccagtctcatctgagacaaggctgccatcccttctgctcgagcctctgaaatacaaagcaagttaactacttccaaggtacaatgattgtagagacattgggtaagcattcccagccaaaaggaagaaatttgtcagaaggaagcacaaaacacagatgggacttacagaccccatgcaagtcaaaaacccagcaggaaagtcattccatcctacagctccaaatcatcttttctgaaaggatctacatcccacatctagagcacaagagtggatggcgaggctcccaaggccttgggcagctcagcttctgtggctgtgcagggtctttccccacagctgccctcatgggctgggctggtggtcagtgcctgtggcttttccacactgagggtgcaagcagttggtgggtctatgaatctggggtctggaaaatggttcctccctgtatgggggcatcaaccctgtatgttccttctgcactgccctagtaaagatttcccatgaggctctgcctcttggaaaagcttcattccagctggacacccaggtttttccttacatactcttgagtctagataaaggctcccaagcctgtgcacctgctggcttaacactatgtggaagccaccaaggcttgcagcttgcaccctctgaagcagtgacccaagctgtaactgtgcatctttcagccatggctggagctggagctggagctgcagggatgcaggcggcactgtcctgaggatggacacagcagcgcgaccatgggactgacccaggaaaccattcttcggtcctagaactcagggcctgtgacagcaagctctgctgcaaaggtctctgaaatgccttcaaggcctttttaacattgtcttagctgttagcactgggctccattttatgcacatttctgaagccttcttgaattttcccactaaaaatcagcttttctttttgacctcttgggcaggctgcaaatcaaacttcaaagctctgcttctcatttaaatataagtttcaacttaaggtcatttattcggtcacacagaacaccacaggctgttcaatacagacaagatacctcttgagctttgctgcctagaagttcatttcaccagatataccctaaatcatcaccctcaagttcaaagtttcacaggtcaccagggcaggggcaccatccagccaagttctttgctaaggcaaaagaaaagtaaccttggcttctgctcccagtaagttgttcattttcatctgagaccttctaagcctggccttcactatccatccttcagtcacccttttaattataactatttaacacgtctctacaatagtcaaaactttcattcatctttctgtcttcttccaagccctccaaactgtgcagcctgtggttgttacccagcttctgaacctgcttctgaacttgcttctacattttcagctatcgttgtgacagcctggcagtgtggtaaaagaagaaaagtccattttcagggggaaaattcaagaaggcttcagatatttgcatataaaggaagccaaatgccaatagtaaaaacatcaggaaaaaaaccttgagggcatttcatagctccactctacagtacaaattttctgtagtattattttaaaaagaggtttaattggctcacggttctgcaggctgtaaagggaacatagtggcttctgcttctgggaggactcaggaagtctcctaccataccagaaggccaagcgacaatgagatgttccatatggcaggtgtaggaggaagacagagagaggaaagaggtgccacaccttgttatacaaccagatctcatgagaactcagtatcaggagatcagcatcaagaagattaaccattggtgaaggatccacccacaccaccccccactgtttccaggtagaagcctcctgcagaggcagagcctcttggagaacctctaccagggcagtgcagaaggaaaatgtaggcttggagcccacatacaggaggccaccatcctccagactgcagattcacagacccaccaacagcttgcactctcagagtggaaaagctacaggcactccacacaagcccagcccatgacagcagccatgggggctacaccctgcaaagccacaggtgcactgccctagtagagactttccatgagcctctgcttctgaagcaggttactcccccctcctagtacccaccaccctactaacaacctactcctcaccctacccacccctttccttccatccccggtccccctcccatccatgattaaatcacctccagccaggtcccacctccaacattaaggattacaattcacatgagttttggtaaagaaacacagccaaatcatattattctgacctgatcccctgcagtctcttgtccttctcacagagcaaaatatattcatgccttttcaaaactttccaaaagtcttaactcattccaacaataactcaaatgtaaaaaattcaacatctcatctgagacaagtctacagtaccttttgcctatgagtccctgaatttaaaaggatgttctttctttcaaggtacaataatggtacaggcattgggtaagctttttcaatccaaagggcagaaatttcccaggaaaataacacaaatgggaccacaggcccaatgcaagtccaaaacccaggaggccagtatccatttaatcttacagttctaaaatcatgaaaagaactcaccatcacaaggacagcaataaggagatagtgtttaatgatttgtgaaggatctgaccccccaccccaattttcacccctcacccccaccataattcccccattttccctacacccccatcttccaacccccactctgcaccgtgattaaatcatcttccaccaggacccacctttaacattccaattacaattccacatgagttttggtagggacacagctgaattttattattctttccctcactccccaaatctcatgtccttctcacattgcaaaatacaatgatgccttccctaaagtcccctaaaatcttatatcattccagcatttatacaaatgtccaaagcctaaagtctcatctgacacaaggctacagtcccttaggcccattagcctctgaaatataaagcaagttaactacttccaaggtacaatgcttgtacaggcattgggtaagcattcccagccaaaaggaagaattttgccagaaaaaaacaaaacacagataggacttactggccacatgaaactccaaacccagaaggccagtcattcaatcctacagctccaaaatcaccctttttgaaaccctgtcccacattcaggacacaggggtgtgagggctgggctcccaaggccttgggcagcttggcacctgtggctttgcagggtatatgccccaagggtgccctcatgggctgggctggtgatgagtgcctgtgacttttccacactgaggaaacaagttgttgcgggcgggggtctatgaatctggggtctgcatgatggtggtctccagtgtgggagttccaaccccatattttccttctgcactgccctagtagaagtttcatataaggctctgcctttttgggatgcttttgcctggacacccaggaatttccatacatcttccaaaatctatagagaggctcccaagcctctagtctcacactccgtccaccagtggcttaacactatgaggatgttaccaaggcttctagcctgcatcctctgaagcagtgacccgagctgtacctgtgcatctttcagtcatggctggagcttgagctgcagggatgcaggcagcagtgttctgaggctgcacataaaggaggctcatggaactggcccaggaaaccatgcttctctcctaggccccagggcccacaatagcaagggctgctgcaaaggtctctgaaatgccttcaaggccttttccctattatcttgtctattagcaccgggctccttttcatgcaagtttctgaagccttcctcaattttccccctgaaaatcagcttttctttttgaccacttggccaggctgcaaattttcctaaatttgagttctgagagatgggactcatttaatgtaagtcccatccagaggtcatttcctccatcacacataagagcacaggttgttccatggggacaggacgcctcttgagatttgctgcccagttcattccaccagatactcagtaagtcatcaacctcaagttcagtttcacagatctccagggcagggtcaccgtgcagccacattatttgttaaggcaaaacaaaagtcactttggcttctgttcccagtaagttcctcattttcatttgagaccttctaagtctggctttcactcaccattttcctgtgagccttctggtcacaagtatgtaacaattcttcacaaagatccaaactttccctcaacttcttgtctgcaaagccctccaaactctctgaactctgtctgctacccccttctgaacctgcttctacattatcagctttctttgctgcagcctggcaatgtagtaagggaagacaagtccattttcagggggaaaattcaagaagggttcagagacttgaatgaaaagaagctgagtgctgactcccaagacaatagggaaaaggccttgaagacatttaatagatccactttgcagtactaattttctctatgatcataaagaagaggtttacttggctcatgattctgcaggctataaggaagtatagtggcttctgcatctaagaggaatcaggaagcctcccaatcataccagaatgtcaaggggcaatgagatgattcatgtggcaggaggaggagcaagacagggagaggagagaggtcccacaccctattatacaaccagatctcatgagaactcactatcacaaagtcagcatcacaaagatggtgcttatccactggtgaaggattcgccccctacccccaactcccactatttccaggccgaagcctgaggcagaggcagagcctcttggaaaactctactagggaagtacggaagggaaatatgggcttggagcacccacacagatggccatcaacctccagaccccagattcatagacccaccaacagctcacaccttgtgtggaaaagctacaggcactcaacaccagcccagcccatgagagctgtggcaggagctaagccctgcaaagccacaggtgcattgccctagtagagggtttcccatgagcctctgcctctgcagcaggctgctcccccttcctcccacccaccaccctcacaccaccctactgccagcctactcctccccaccctaaccaacccttttccttccaccccaaccgcttccagtccatgattaaatcatctcctccaggccccaacttcaacatttggaattaaaattccacatgaatttttatagggacacacagccaaaccatattattctgaccctgctatcccagaatctcatgttcttatcacagagtaaaatacaatcatgccttttcaaaagttccaacagccttaactcattccaaatgtaaaaagttcaaagtctcacctgagacaaggctactgtcccttctgcatatgagtctctgaatttaaaagggatttcgtttctttcaaggtacaatgatggtacaggcattgtgtaagctttctcaatccaaagggaagaaatttaccataaaaatagcacaaatgggaccacaggcccaatgcaagtccaaaacccagcaggacagtattcactcaatctttaagctccataatcatcaagagaactcactatcatgtagatagcattaaggagatagtgattaaccatttgtgaagaatccacccccctaccctcatctttcacccccacccacaaaataatctcccccattctccccaaacccctacctccaacccccactcttctccatgattaaatcaccttccaccaggccccaactttaacattccccattacgattccacatgagtattggtagggacacagaaccaaatcatattattctggcctttggtccccaaatcttgtatccttgtcacactgcaaaatacaatgatgacttctctactgtcccccaatgacttaactcattccagcatttactgaaaagtccaaggacttacagaccccatgaagtcaaaaacccagcaggccagtcattgaatcctgcagctccaaatcatcttttctgaatctacatctcacatctagagcacaggcgtgtgatggctgggctcccaaggccttgggcaactctgcacctgtggatttgcatgatatatcccccacagctgccctcatgggctgggctgtgttgagtgcctgtggcttttccacactaagggtgccagctgttggtgcatctatgaatctggggtctggagaatggtgtctccatatttagggactccaaccccatattctccttctgtactgccctggtaaaggtgtgccatgaggctctgcctcttggaaaagcttctgcctgaacacccaggtttttccgtacatactctggagtctagacacaggcccccaagcctctagttttgtgctctgtgcagctgctggcttaacactatgtggaagacaccaaggcttggaacttgcacccctgcagcagggatgcaaactctacctgtgcatctttcagccatgactggagttggaaatggagctgcagggatgcaggcagcagtgtcctgaggctgcacatagagggggctcatggaactggcccaggaaaccatgcttccctcctaggccccagggcctgtgacagcaagggctgctgcaaaggtctctgaaatggcttcaaggtcttttccttattgtcttgcctattagcaccgggctccttttcgtgcaaattcctgaagccttcttgaattttcccactgaaaatcagcttttctttctgaccacttggcaaggccgcaagtttcccagacttttgagttccgtttctcatttaatataagagttgtgactcatttaatgtaagacccatccagaggtcatttcctcagtcacacataagggcacaggctgtttgatgcagacaggacacctcttgagctttgctgcccagaagttcattccaccagatactcactaagtcatcaccctcaagttcaaagtttcacatatctccagggcagggtcaatgttcagccacattctttgctacagcaaaacaaaactaaccttggctcctattcccagtaagttcctcatcttcatctgagaccttctaagtctgatctttactgtctattttcctgtgagccttctgatcacaagtatttaaccattctttacaaagatccaaatttcccctcaatttcttgtcttggaagccctccaaactctcctgaactcagtctgctaccctcttctgaacctgctcctgcattatcagctatctttgtcagagccgggcaatgtggtatggaagacaagtccattttcagggggaaaattcaaggaggattcagagacttgaatgaaaagaagctgagtgctgatcgccaagacattggggaaaaggccttgaagacacttaacagatcttctttgcattaaaaattctctcaatgatcaaaaagaaaagacgtttaattgttaatgattctgcaggctgtaaggaggcatactagtttctgcatctcagagggctcaggaagcctcccaatcacaccagaatgtcaaggggcaatgagatgtctcatatgccaggagaaggagcaagcatgagagagggaaaaggtgtcatgtcctattatacaaccagatctcatgaaaactcactatcaccaggtcaccatcatgaagatggttcctaaccattggtgaagggtctgcctcccacacccacctcccactgtttccaggcagcagcctgctgcagatgcagagttcttgggaaacctctactagggcagtgcagaaggaaaatatggacttggagcccccacacagggggctactaccctccagaccccagattcacagacccaccaacagctggcaccctcagtgaggaaaagctacaggccctcaataccagtcccgcgcatgagaacagctgagctaaaccctgcaaaccacaggtgcactgccctagtagagggttttccatgagtccctcactctgcagcaggctgctactccttcctactaccacccaccctcccaccaccctactaccgacccactcctcccaatcctacccatcccttttaccttccaccaccaccaacctcctgtccataattgagtcacccgcttcaacattagggattacaattctgcatgagattcatagggacacacagccaaaccatattattctgaccctgatatcccagaatctcatgtccttatcacagagcaaaatgcaatcatgacttttcaaaaatctccaaaagtcttaactcattccaaatgtaaaaaaattcaaagtctctcctgagacgaggctacagtctcttctgcctatgagtccctgaatttaaaatggagttcttttctttccaggtacaatgatggtacgggcattgggtaagctttctcagtccaaagggaagaaatttcccataaaagtaacacaaacgggcccacaggcccaacacaagtccaaaactcagcgggacaggattcactcaatctcacagctgcaaatatcatcaagagaactcactatcacgcaggcggcattaaggagatagggtttaaacatttgtgaaggatctgcccccctacccttaccttttacccccaccacaaaataatctcccccattctccccacacccctacctccaacccccactcttctccatgaataaatcacctcccaccaggccccacgtttaacattcaccattacaattccaaatgagtttggtagggatgcagagccaaatcgtattattctgaccctgaccccccgtatctcatgttgttctcacactgcaaaatacaatgatgcctactctacagtttcccaatgtcttagctcattccagcatttactgaaatgtccaaagtccaaagtctcttctgagacaagactgccatcccttctgcccctgagcctctgaaatacaaagcaagttaattacctccaaggtacgattgtccaggcattgagtaagaacctccacccgaaaggaagattttttgccagagggaagaacaaaacacaaacgggacttacaggttcccatgacattccaaaacccagcaggccagttattcaaacctacagctccaaaatcatcctttttaaatccttgtcccacatccagggcacaagggcatgagggctgggctcccaaggccttgggcagctctgcacctgtggctttgcagtgttcagcccccgcagctgccctcatgggctgggctagttttgagcacctgtagcttttccacaatgaggatgcaagatgttagtgagtctatgaatctgacatttcagaatggtgctccctgtgtggtggttccaaccctatatgttccttccatactgccctagtaaaggattcccatgaggctctgcctctttgaatagcttcaacctggacacccaggtttttctgtaaatcctctgtagtctacatgaaggattctgagcctctagtcttggcctttgtgcacctgctggctcaacagtatgtggaagccaccaaggcttgcagcttgcaccctctgaagcagtgacccatgatgtacctttgtatctgtcagccatggttggagctcgagcttcaggtatgcagccagcagtgtcccgaggatggacacagcagcagggccatgggactggataaggaaaccattctcttctcccaggcctgggggcctgtgacagcaagggttgctgcaaaagtctctgaagtgccttcaaggcctttttatcattgtcttggctattagcactcaattccattttatgcacatttctgaaatcttcttgaactttctcaccaaaaatcagcttttctttttgaccacttggccagcctgcaagttttccaaacttttaagctctccgtctcatttaaatataagtttcaccttgagttcatttctttggtcacatataagacctcagggtgtttggcacagaccagacatctcttgagctttgctgcctaaaagttcattccaccagatacattctaaatcatcactctcaagttcaaagtttcacagatctccaggttaagggcatcgtgcagtaatgttctttgctaaggcaaaacaaaaatgaccttggctcctcgtcccagcaagctcctcattttcatgtgagaccttctaagcctggccatcactgtccatcattctgtcatctttttaattataactatttaacaagtctctacactggtccaaacttttccacatcttcctgtcttcttccaacacctccaaactctccaacctctggccgttacacacttctcaacctgcttctacattttcagctatgtttgttgcagcctggcaatgtggtaaaagaagcaaagtctgtttcaggagaaaaattcaggcaggcttcagatatttgcctgaaaagaagctgagtgctcattgccaagaaaataaggaaaaggccgtgaaggcatttcatagctccatttcacagcactaattttctgtataatcagaaagaaaagaggttgaactggctcatggttctgcgtgctttaaataaatcatagaggcttctgcatctgggaggactcaggaagtctcccaatcataccagaagaccaagcaccaatggtatgttttatatggcagaagtagaaacaagacagagagaggaaaaaggtgccacaccctgttatacaaccagatttcctgagaactctctaacacaaggtcagcatcaagaatgcttaaccattggtggagccattggtgaaagatctgccccctaccacccacaacccccactgtttccaagcagaagcctgaggcagaggcagagccactaggaaaacctctactaggacagagcaggaaaaaaacaaaacacacaaaaaaaggcttggtggccccacacaagaggttaccatcctccagactctctaacctctggccattacccaattcagaactggcttctacattgtcagctatctgtgtcacagcctggccatgtggtaaaagaagaagggtccattatcaagggaaaaatcaagaaggcctccaatatttgcattaaaaaaaccagtgctaacagccaagagattgcgggaaaggcctagaaggcatttcatatcttcactttgcagcattaattttctgtatatacataaagaaaagaggtttaattgactcacagttcttcgggctgtaaagaaagcatagttgtttctgcttctaggaggactcaggaagactcacaaccataccagaaggccaagcggcaatgaaatgtttcatatagcaggagcagaagcacaacagcgagaggaaagaggtgccatatccttttttttttatgtaattacatatatttgtaatttctacattggttaaacatgaatattatttatatttgaataaagaattgaatgattatttactgtgtttactgtcttagtaagacacttcatatgttgtgattttcaatgtattaaatgtcaagatgccaactgtgatgcagtttgaggtttttattattttggaataccttgaatatgtttcttctggatggatgagtctgaagttagctaaaaaatgaagtgaaattctgttttttctctaacaccacgatttgcttttcaccaaagaactcttatgaaattatattgctgtaaacagaatacaaaaattgcctcaagttatacattgatactggactatcctgatattttgaagtgatatgaaaacttattggaatgaattgtattgtgctgccctgcctttcaattgttaccaaatgggagagtttgctctttgctgtagttgactttcctgtagtttagcaatcatgatttaaagttggggaaacttgacatgctaataacagatgactgaataagttagagcttttctgaatccagtaatatgagaaaatggttaactaatttaaattggtttcataaacttaattgtgtgtacaattcaacagaattattaattctgtttacattgtgattcaaagtagaagtagccaaatattcatgttatctaaagctatatcctgttatgcaacttgatctcatgagagctcactatgaggagatcagcatcacaaagatggtgcttaactattggtgaaggatctgccccccaccccgtatccacccctcactgtctccatgcagaagcctgagacagaggcagagcctcttggaaaacctctactagggcagtgcagaaggaaaatatgggtttggagcccctatgcaggaggccaccatcctccagaccccagattcatagatgcaccaacagcctgcaccctcagtatggaaaagctacaggcactaaacaccagcctagcccatgagagcagccatgggggctaaagccacaggtgcactgccctagtagaggtttcccatgagcctctgcctctgcagcaggctactcccctcccacaacatgccaccttcacaccaccctacagccaacctactcctccccacctaacccacctctttgtacttccaaccccacccctctcccatccatgaataaatcacctcccaccaggccccacatgcaacattcaggattacaattccacatgagtttaggtagggatacacagctaaaccatattattctgaccctgatcccctgaatatcatatccttctcacagagtaaaatacaatcatgccttttcaaaagttgctgaaagtctgaagtcatttcaacattaactcaaatgtaaaaagttcaacgtctcacctgagaaaaggctacagtcccttttgcctatgagtccctgaatttaaaagggagttcttttctttcaaggtacgatgatggtagaggcatggggcaagttttctcaatccaaagggtagaggtttgccaggaaaataacacaaatgagatgacagggccaatgcaagtccaaaacccagaaggccagtatccattcaatctcacagctccaaaaccatcacgagaactcaccatcgtgaggaaaacattaaggagatagtgtttaaccatttgtgagggatcctgcctccacccctacctttcacccctcacctccaccaaaatccacccatgctccccaatccccaccttccaacccccactgccctccatgattaaatcaccttcaacttggccccacttttaagatttccaattaaaattccagataagtttctgtagggacacacagccatatcttatcattctgtccctgcctacccagatttcacgtccttctcactttgcaaaatgaaatgatgcattacctgccatttccccaagccactatgctttttttacagcctgcagaactataagccaattaaacccctttttgttatgaacacacaaaaaattagtactgtgaagttaagctatgaaatgccttcagtgacttttccctgtcgtcttggataagacccccaaggtcttaactcattccagcatttactcaaatgtctgaagcccaaagtctcaactgagacaaagctgcagtctcttctgcccgagcctctgaaatacaaagcaggttaaccacttccaaggtacgattgtccaggcattgagtaagaatctccacccaaaaggaagatttttgccagagagaagaacaaaacacaaactggacttacaggtcccacgaaattctgaaactcagcaggccgcttattcaaacctacagctccaaagtcatcccttttaaatccttgtcccacatccagggcacaagggcgtgagggtgggctcccaaggccttgggcagctctgcacctatggctttgtagtgttcagcccccacagctgccctcatgggctgtgctggtgttgagtgcctgaagtttttaacccatggagggtacgaagcttttgatgggtctatgaatctggggtctgcacgatggtggcctccagtgtgggggctccaacctcatattttccttctgcactgcccaagtagaggtttcccatgagactctgcttttttggcagccttctgtctggacaccaggcattttcatacatcttctgaaatatatatggaggctcccaagtctctagactagtgctgtgtggactcactggcttaacactatgtagaagcaaccaaggcctatagcttgcaccctctgaggcagtgacccaagctgtacctgtgcatctttcagccaaggtcggagcaggagctggggctgctgggatgcaggcagcagtgtcctgaggctacacacagcagcagggccatggggctggcccaggaaaccattcttctctcctaggtcccaaggcctgtgacaggaagggctgctgcaaacatctctgaaatgcctccaagccttttccccacaattgtcttggctattagcactggcctccactttatgcaaatttctggagacttcatgaattttccccctgaaaatcagcttttctctttgaccacctggccaggctgcaaatgttccaaacttttgagctctgcttatcatttaaatatgagttccaacttgaggtcatttccttggtcacacataacagcacagactgtttgatgcagacaggatccctcttgtgctatggtgcctagaagttcatttcaccagatatgcactaaatcatcaccctcaagttcaaagtttcacagatctcaagggcaaggtcgccctgcagccacattctttgctacagcaaaacaaaagtaaccatggctcctgttcccagtaagttcctcattttcatctgagaccttgtaagcctggccttccctggccttccctggccttccttctgtcagcattttaatcacaattatttaacaagtctctacaatggtccaaactttccctcatcttcctgtcttttttcaagctctccaaactctccaacctctggtgttacccacctctgaaccgctttacattttcagctatctttgttgcagcctggcactcctgtctctcacctgtaaccccaaacacaatcccccccaactctccccaccctcccaataccctccaaccctccccttcccacacatccaacctccactctccaccaggggaaacttcaagaaggcttcagatatttgcattaaaaagaagcccagtgctaacagccaagacaatgaggaaaagtccttgaagatatttcatagctccactttgcagtacttattttctgtgtggtcataatgaaaaggggattcattggctcatgggtcttcaggctataaagaaagcatggtggcctctgcttctgggaagactcaggaagcctcccaatcataccagaaggaaagcagcaatgaaatgtttcatacggcaggagtaggagcaagactcacagaggaaagaggtgccaccgcctgttatacaaccagatctcatgataactcactatcactaagtcagcatcaagaagatggtgcttaaccactggtgaaggatccaccccaccaaaacacctccaccccctactgtttccagacagaagcctgctgcagaggcagagcctcttggaaatcctgttctgtggcagtgcagaaggaaaacaagggctttgagtcactctgcaggaggccaccatcctctagaccccagattcgtagacctaccaacagttcacactctcagtttggaaaagcgatagacactcaataccagcccagcccataagggcagccatggaggctaaagcctgcaaagccacaggtgcactgccctggtagaggttttccatgagcctctacctctgcagcaggctactcccccttcctactacccaccaccctccgaccaccctacagccagcatactgttccccaccctacccaccccttttttcttccacccccacacctcccatccatgattaaataatctcccaccaggccccacctccaacatttgggattaaaattccatgtgagtttttctagaggcacacagccaaatcatattatgctgaccttgacccccccaaatcccatgtccttctcacacagtaaaatacaatcacatcttttcaaaagtttccaaaagccttaactcattcccacactaactcaaatgtgaaaagttaaaagtctcatctgagaccaggctacagtctcttctgcctatgaggccctgaagttaaaagggcattcatttctttcaaggtacaatgatggtacaggtattgggtaagttttctcaatccaaagggaagaaatttccaagaaaaataacacaagtgggaccgcaggcccaatgcacatccaaaacccagcaggacactgttcattcaatctcacagctccaaaatcatgaatagaactcactctcagaagggcagcattaaggaaatggtgtttacccatttgtgaaggatccacccccacacctgccttttacccataaacccaaacacaatcccccccaactctccccacctccacaataccctccaactctccccatccctcccatccaacctccactctccaccatgattaaatcaccttccaccagcccccacctctaactttccccattaaaattccacatgagttttgggagaggtacagagccaaatcatattactctgtcccgggtcccccaaatctcatgtctttctcacattgcaaaatacaatgatgccttccctgcagtcccccaaatcttaactcattacagcatttactcaaatatccaaagcccaaagtcttatctgagataaatctacagtctcttctgccatgagtctgtgaattataaagcaacttaactacttccaagctacaatgattgtacaggcaatgggtaagcattctcaaccaatagaaaaaaaaattgctggaaagaagcacaaaacacagatgggattcataggatacataaatgtccaaaacccagcaggccaatcactcaatcctacagctccagaatcatcctttttgaatccctgtcccacatccatggcacaggggtgtgagggctgggcttcctaggacttgggcagatctgcagtggctttgcagtgttcagcccctgtagctgccatcatggacagggctggtgttgagtgcctgtagcttttccatactgagggtgcaagctgtttgtgggtctatgaatctggggtttggagaatgatgcctccctgtatgggggcttcaaccctatatgtcccttctttgctccccttgtagaggtttcccaggaggccctgcctcttggaaaagctgctttcctggacatccaggcatttctgtgcatcttctggagtctagacagaggctcccaagcctctagtctcttactctgtatatctgctggcttaacactatatggaaacaatcaaggcttggagccacctctgaagcagtaacccaagctgtacctgtgcatctttgagccatggctggagctggaaccgcagggatgcagccagcagtgtcctgaggatgcacacagcaatggggccatggagcttccccaggaaaccattcttctctgccaggccctagggcctgtgacagcaagggctgctgcagaggactgtgaaatgccttcgaggcctctttcccattgtcttggctatttgcactgggcttctttttatgcagatactctaagccttcttcaattttcccccggagaatcagcttttctttttgaccactgggccaggctgcagattttccaaactttaggtctccacttctcatttcaatagaagttccaacttgaagtcatttcttaggtcacacataagaacacaggctattcaatgcagacaggacacctcgctaggctgcctagatgttcattccaccagatacatcctaaatcatcacccccaaattcatagtttcatagatgtccagggcagggtcaccgtgcagccacgttctttgctaaggccaatcaaatgtaaccatggctcctgttcacaggaaattcctaattttcatctgagaccttttaagtctgaacttcagtgtttatccttctgtcagccttctgatcgcaagtatttaacaattctctacaatggtcaaattttcctcatcttgctgtcttccaagctttcccaactctcctgacctctgtcttttacccacttctgaacctggttctacattgtcagctatctttatcacaacctggcagtgtggtaaaagaagaaaagtccactttcagggggaaaattcatgaaggctccagatatttgcatgaaaagaagctgagtgctggtttccaagaaaaggggaaagggccttgaaggcacttcatagctccacttcatagcactaattttctgtatgatcataaagaaaagaggtttaattggctcatggttcagcaggatgtaaaggaggcagagcggcttctgcttctgggacatctcagggagcctcacaaccataccagaaggccaaggggcaaggagatgtttcacatggcaggagcagaagcaagactgagagaggaaagaggtgccacaccttgttatataaccagatctcataagaactcactgttactaggtcagcatcaagaagatggtgcttaaccattggtgaaggatctgcctcccacccccacctcccactgtttccaggcagcagcctgctgcagacacagagttcttgggaaacctctactagggcagtgcagaaggaaaatacggacttggagcccccacacagggctaccaccctccagaccccagattcagagacccaccaacagcttgcaccctcagtgtggatgagctacaggcactgaacactagtccagtccatgagagcagccatgggggctcaaacctgcaaagccacaggtgcactgccctagtaatggttttacatgaggctctgcctctgcagcatgctactcccccttcctactacccacgaccctcccaccaccctacagccagcctactcattcccaccctacccacccctttttccatccacacccacccctgcttatccatgattaaatcacttcctccctctccctcatctttctgtcatgctctaatccctccaaaccctcccaatctttgtttgctacccactactgagcctgcttctactttttcaggtatctctatagcaggttggctatgtagcaataacacaaaccccatttaaggggaaaaattcaagaagacttcagaaatttgcatataaagaagccctgtgctaatagccaagacaaagggaaaaaggccttgaagacatttcacagctctctctgcagttctaattttctctattattgtaaatgaaagaggtttaattgaatcatggttttgcaagctgtgaaggaagcatagtgtcttccgtttctgggaggaatcaagaagcctcctaattataccaaaagccaagacaatgagatatctcctaaggcaggagtaggaggaagacagagtgaggaaagaggttccacagccttttaaacaaccagatctcatgagaactcactcgctatcaggaggacagcatcaaggtgatggtcctttatcattcatggagaacctacccgcacccttttataactaaatctttttccacctaggccccacctctaacattagggagtataattccacatgggttttgatacggacacagagacaaaccatattattctgtccctgatcccatgaatatcatgtccttctcacattgcaaaatacaatcatgccttgccagaatgagtcttaactcatttcagcattaactcaaacttagaaagtccaaaatctcatctgagtcaaggctacagtctctttttcctatgagcctctgaaataaaaagcaagttcacagcttctaacgtataacgatggtacaggcattgtgtaagctttccatattcaaaaggaagaccttttccagaaagcttcttatttctatctgagacctcctcagcctggccttcactatccatgtttgtgccaggatttttatcacaaccatttaaccagtctctaagatagtccaaaaattttctcattgtcttcttttcagccctccaaactcttccaacctctgcccattacctagttccaaagctgcctccacattttcaggtatctttatagcaatgctgcaatcgtcatttgccattttctgtttgattcattttgaaaaagaggtttaattggctcatggttctgcagggtggacaggaagcacagggcttcttattctgggaggcctcagaaatctttcaatctttgcacaaggcaaagaaagagtgagttgtctcacatggcaagaggaaaacacgcagagtagggaggtgacatagagttttcagtagccagatctcacgagaagtcactcatgattgtgaggatggtacaaggggatggtgctgaaccattcatgagaaatttgccttcataaatcaattgccttataccaggatccaccttccacattaggaaatataattaaatatgagatttggtggggacacatattcgaattgcatcatcagtctttgagtataaagacatgcacagcaggctttatccagccaacttatttgggactctttatagggtttgtggtctacggcatatacactaaaatattcatacttcaaaaagcagtaaagtggtattatcattcttccaaaagttacattggtagtttaggcattcatggcatgatttagtttgtgtttgctactgtttctattctgtcaacatattaactgtttcctacacaattctgtattcagctggatttcagttgagcacaaaaccatccttgtgctaccacggatagctggcactagctccttgctagtgttattattctgtgtagaaagtatccttgaactgtaaacagtccacaatcaaatatctagtaattcaacactatcaattcctggatgatttttgaaaaaatagtatctctttttgcaagaaatgctgcatctgtgatttcatgtctctcattcaaattggatggaagtggtgaatttccactgaagtggtgaaagaattcctgttcctgtgattctgatgtcatcagcctctgcatctctatcttcccttctgccacatgttgcctgccttctgcgactttggtaagaacttgcttgtgtatgtggatgatgttcaggatgttggtctggtgtccctgagacagtactaacaggtccatgactgggtccaggttctgcctgggatgattggcaaagagctcactgacagtgttgaaggcatctgtggtgaagtggatgggctggtccagctccaaggcctggctgaggctgaagaactggcagccttctgatgctctttcttaaagcctgtcaccatcacctgcttgcatgtcaactcattggctgtgaagttaagctgagtgccctgttgtccatcttcttggtgaagcatttgaagctgtcaatcttgctctcccactcctaaagtttgagtgtcaccctggaggtgggctcagagccagggagaatctggcactcaccatctcatccttctcagccttcctcttgccctgtctccaggctgtctcttcagtgctggtgtggcacatcaggaagtgatggaagatgtggcactgtgcctgcacccagaagctggccgtgtggttcatctaccagactgggccctttctgcacttgaacatagaatcctcctcaagagggcctgtggtctgcctcttggcacccaagaagcccacagtgctgtaggagccctgatgcatggattggagccccgatgcatggattggagccccaaaggcagcgcaaaccctgctcctgagcctgctgctcatttcctctatgtggctccatttgcagcacagttgttgaactgaggcttgtgcatgccaggcaaggccaagttggctcaaagagcaaccagccacctctgcaagggtgtgccaggagcaggtggaccagccaccaacctcacttgcagtaaatcagttactctgccctggaggtagggccccagtgccatctgcttttcctcaggcctccactccatcagctgtcaggtggtggtcactcggggtgtgggaacctggccatccctgtttccttgagtcggtgaggttggtggctggtccacctgctcctggcaaacccttgcagaggtggctggttgctctgagccagcttggacttacttggcatgcacaggccccgggtactgacaagctgctccgagtgagcttgtcttgtcttgggccaaattctaagtctggccagggccacagaaggctgagtcccctgggtggtaaccctggctgctgcagggaggcccatggtgctcctcccctcccagggctcaggatgaggttcaactgggacaggaccctttaggtatgggacttgtgccccaggagggggcctctgtcacacaggttgggtaagatgtatggcatgctgctggcttccagggctgttgggatgacacattcacccttccctccagggacctcaaaatgaccagcttcccctttgagaatgacttcccaaggcctaggagccatctggggctgcagggcagctggctgcatgctgccctgacttcttccatgttgtgctggtcactacccaccaagggggtcagatgcaggcaccatgcagggcggttgtctctggacctgcgtcttggttatcatggagctggactgggcctgggtgagagggcctgatggggttgtcctgggtaatcacgggggtgactagaaaagatgcagaatggaattgctgcgaggatgaacgagatgactgtcagcacagaataggcatccggtgagtgttcagggattaccctcagtagctgcccagaggccaaaaccacccacctgatagcgactgtccccaagctaggaggaagagaagagagcaggtcccactcacctgagtctgatcagtcagctgtgttgagatgtgcctctcacctagaaaacggtccttcatgcagagccactcagacaccacagtgtgtctctaactgctccacaacacagaggcgatgggggctcagcaacagtaacattgtggggtgacacaacccaccacaatgggagcctgcatgggtcagcagggcccagagtcagtgtcctctatcccctgaactgacatgtgtggatgcagtgtgtttgtgcatgtgtgtgtgcctgtgtgtgtgtgtgcacatatgtgtgtgtgtgtttctcttgcttctctggccaggcctagcttctccactcacaggtgcacccaggtcatcactgagggctcatggccagcattagagcttctacaggtgctccccaatctctgccttccccacccatggtggtcctggggatgcagagagaggaggggcaccaggcacagcagagagggctggcaccccctctaggtagaacacaagtcatgtgtaaagttgtaggtctgccaagtggtgctggattcaacacatcttctcaccttctctttccagccaccctccaaggtgccctgactcaccttccctgcagatggaggcaaggagactccacagacaaaccccctgcctgaggtcacacagtggccagctggccaggttcctactgaccagccgcccaggaccagtttcccactgatgaggcctctaatgaccactcctccatttaccaattcccactgaccaagtccccactgaccatgtcttcctaaccaggctcacacttaataggcctcataggccagacctcactgaccaatttcccactgacctggtccccactgaccaggttcccactgacaagaccacaattgaccaggtcgctgctcacctgacccccactgaacaattttccatggatcagtccccagctgactgagccccctctgaccaggccctcactaacgaggctccaagccactaaggccccacactgaccaggcccctagtatactgtataggccccaccaaccagtttttcattgtttatgttccaacccatcaggcctcactaagaagaccatcactgaccaggtccccatgaactgggcttccaatgactaggtcaccaggtccccactgatgaggcctttactgaggaggccaccactaaccaggtcccaactgactaggtcctgatgaccaggtcatctctgagcatggtccactgaccaggcccctgagcagcatgctcaaagtctcattacaatgcccccctcagcccacagaccctccctccctgtatgtgtgcccagaggtcaggccctgggttttttttttgggacatggcttttcctccaagacagagggagagacagctggcctcaggctccaggtgcccagctccacactcaccccaaaagccctctgggccaatctcaaaggagatagtgaggtggcctggcactgcctggacatgccatgtagcctattcctgagtgtcagagtgggaggaaggcagggacatttggcagatgagacatcttgtgctgttgggcatcccagggccctacccacagagtcccgatctacagacacagcacagagactaatgcagaacccttgaggctgagccagggaccacatgaggattgtgcccagacagccagaaggccctttgctaatttcttggtacctcatggatgcggcagcggttgttctgttggggaccagtgatcacgtgctggggagggctcgcctgtgcttcctcagtggctccacctctgcttctaagaaaaatcactcattccatggctggagcagagaaaatacaacattagcttagaacatcttgttccagaaactaaaaaagtgctgacagagtaacgaagacaaataaaaaagacaagaagtcagcttgaaatgtctaccactggcctaatcttggggaattggagcacgagaatcatgagctttctcttctcagttatttattggttttacttctccatgtacagcaaagaagagaagaaaataatcatctggcaaccatcatagtaataattgttcaaacacaagtcatccatgaaatgctaaatctagtgggttctgaggagtaactggatatttacagagcctcaaagtatctccccacaaaacacggttcaactacaaaaagaaaattgtcacattagcatagacaagcctggcaggtactccttaactcccctaagtagtaaaagctgtaaaatgcaaagaagccttcgatgacatttactaaagtatcaatgatgacttggttgtttggctgtttaaacagctgacttttgggcaatttgagtacatcaaactcaataatactagtgttcatttgcaagatccacttaaaacttaaggaggctaatttcatccatgtccctacaaaggacatgaactcatcattttttatggctgcatagtattccatggtatatatgtgccacattttcttaaaccagtctatcattgttggacatttgggttggttccaagtctttgctattgtgaataatgtcgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgttttttggctgcataaatgtcttcttttgagaagtgtcttcattctcagtaaactatcgcaagaacaaaaaaccaaacaccacatattctcactcataggtgggaattgaacaatgagatcacatggacacaggaaggggaatatcacactctggggactgttgtggggtggggggaggggggagggatagcattgggagatatacctaatgctagatgacgagttagtgggtgcagcgcaccagcacggcacatgtatacatatgtaactaacctgcacaatgtgcacatgtaccctaaaacttaaagtataataaaaaaaaaagaaaagaaaaaacttgaggctaaaaaacatcatttaaattaccctataaattatcatcacacatgtgatacaaaaacatcctacttcagtaaagattgtaatgttatatattttatgaaaaacaattaaaatgttctgtaaacagcccagtaataaagttttataatcttttaaataataaaatttttccttaagactttatggttaaacattctcttcattagatgtggcttaccagtggattatagagaagtaagtagacgggagcaagtgttcaacacagcaacaactggaaagaaaaagaaagaattatgttctttacctaatacacttcagttaactaaatgtgagtttaaatactaaagagttgagaactttatcagagttagtaagaatgagaaatatctatgtacatttacaacacaaaattactattaaataatttacacatggcattaattctattgtgtttaaatatcagaggtttttcattcttcattcatgtaatcaacagccacgtgctaaggtactagaaccagcactggaattccaagatgaagatggcatggtccacctcccaatagtcatatgctataacctaaaaaaacagacaggtaggcaaggtccacatagtgtcatagataccatgacaggtatacagcagggcactactggaacacacaaaagggacatctatcccacttttatgtcaatgtcatgggctttctggtggaggagataacataggttgatacctgaaggacaaggaaaagcttgccagatagagggaagaggcgaaggccaagagcctgaggtgaggaagagccctgcggagttctactctcctccactttggtgctagagcaaagggtagagtgcggtaagtggcaaaaaacaaggctgagtaacttgacaagaatcacattgatgtgggtgtttttatttcatggtgaaaaatttggaacttttcctgagaacagatgtaagccaatgacacagtaaatgataggagatttaaaatgtcacctgtcaagtgactgcttatgaagggttattgcccagctaaggatttcaaaatgagtctgaggtctgttggccttcaatctgtaccaaaaccctgagaacttggtgatgcctttgttttctgagaatcgtttcagtgtgctggctgacagttccatgatgatggcaaaacttaagaaagtgtagagccagtaaaaaacagatgcatagacttcttgggaattttttaagctatggaacatgatgaatttatggtgcataagtacagtcttctctgtgaaagtttttgttttcacatcttgcattagatgtgtgtaagaaaaaaaatacttgacatagtatctactaaccaaacaatgaaaaggaatgccatttgttatttacacttaatttctaaaataaacctaaatgtaattaataaattttggcaacatacttctctttgtttctctagttatttgttctacacagtccagctccatctaaaataagtaaaaataataataatgtttaagttaaacaagaaacattatcatgcaaataatgtatcacttacaaaatgtggcctttagtatttttagtgactagacataacttgaagtttgcttaaatagaaaaataatcacataaatgaagtaaaatttctacttattttaagtttagataagaggatgcacctgtgtaatgctgtttaatcagacaaaaatacagttaatattggtctactgcatatacatgattttagaaaggtagtgttttattagtacaaaggttaaacaatggccaggtgtggtgactcatgcctgtaatcccagcacttggggaggccaaagcaggcagatcatgaggtcaggagatcgagaccatcctggccaacatggggaaaccctgtctctattaaaaatacaaaaattagctgggcatggtggtgcactcttgtagtcccagctactcaggaggctaagacaggagaattgcttgaagccaggaggtggaggttgcagtgagccaagattgcaccactgcactccagcctggtgatacagtgagaccttgtctcaaaaaaaaaaaaaaaattaaataattaaagtcatcttttgcaatgaatgcattgctttgaaattcttagcaaaactctgccctatatacaagtttaatccaatgtttttacatcaataaattttatcttaaaaagaaatttctattctctacttatagtaaacttttttaatagtaaatttttgtgtttttttgtttgtttctttttttctagtttgtattctaaattaaggtggtacctgtgtaggcttcttccaagagtatattgagggatgccgaggtttggagtacagtggaacccatcacacaggtagtaagcataggacccaataagtagttttccaaccctggcccactctgtccctcactgttcttatttcccagtgtctactgttcccaggtttatgacaatgtgcacccaatgtgcagctcccacataagtgaaaacatgagatatttggtttctgtgttagtttgcttaggatagtggattccagctgtatccatgttgctgcaaaggacatgattttgttcttttcttggctgcatagtattccatggtatgtatggaacattccaatctaccttggattttcaatctgccttggatgcacctggattgactccatgtctttgctgctttgaatagtgctgcaatgaacacacatgtgcaagcatctttttattacaatgatttattgtcctttaggtatacgcctagtatagtaatgggattgctgcatccaacggtcatccttagttcttaatttccaaactgctctccatagtagctgaactaatttacattgccacaaacggtgtgtgttcccttttctccactgcttccccaacatctttttttttttctttttacttttcaacaagttattctgactggtgtgaaatggtatctcactgatgttttgtttggcacttttctgatgattaacaatggtaagcatttgttaatatgtttgttggccacttacatgtgttattttgagaagtgtctgttcacgtcctttgcccatttttaatggtgttatttattttttgcttgttgatttgtttagatctcttatggattctggataataggcgtttgctgtatccatagtttgtgaatgttttcttccattctctacgctgtctgtttaatcctgtgatagtttctcatgctgtgcagaagctctttagcttaattagatcatacttatcaatttttgttattcttgcaattgcttttgaggacttagccataaattaattgagaagtatgaagtccagaagagtatttcctaggttttcttccaggatttttatagtcagagaatgtactcttacgtaagaaaagcataaacctttttttttttttttttttttgagacagagtctccatcacataggctatagtgcagtggtatgatcttggttcactgcaacctctgtctcccgggttcaggtgactctcccgcctcagcctcccgagtatctgagattacacatgcctgccaacatgccttgctaatttttgtatttttagtagagatgggtttcatcatgttggccaggctggtctcaaactcctgacctcaggtgatccacatgccttggcttcccaaaatgttgggattgtaagtgtgagccacggcacctggccaagcacaaagctttgaacataaaaatggaaatgaacattttagtgttttgtttaattcataaaatgcaattattttggattctactaaataataaacatctatatgtggtaaactgtttggatgccaatcattcagttgtgattatgggtggaaagagttgagatggtgcaactaaacttttttttaaattttttatattcaagatgaagtctcaccctgtcactcaggctggagttcagtggcacgatctcggctcactgcaacctccgcctcctgggttcaagcaattctctgcctcagcctccctagtagctgggattacaggtgctctccaccacacctggctaattttttttttctactttttgtactttcaccatcttggccaggctggtcttgaactcctgacattctgacacacctgcctcagcctcccaaagtgctgggattacagacatgagccaccacacctggctggtgcaaagaaactttaaaagtgacatgggctggacgtggtagctcatgcctgttatcccagcgctttgggaggctgaggcaggcagatcacaaggtcaggagtttgagaagagcctggccaatatggtgaaaccctgtctctactaaaaatacaaacattagctgggtgtaatggcaggtgcctgtagtctcagctacttgggaggctgaggcaggaaaatcgcttgaacctgggaggtggaggttgcagtgagccaagatggtgccacaacactccagcctgggcaatagagtgaaacactgtttcaatgaaaaaaaaagggggggctgtatgaaccacagctaaactataatcaattagagagtaagccaaagcatctcaaactatatcatcagttatcaggcaataatatgcaatttctaaaacctaacttaaatgcagcttttaaagacattttaaatgtgtcagtttagtcacatttattgaataaagttagtaaacgggtatctcttgaaaatgagagctccagggaattaaaaaatgtaaagtttccatttcctttctgtgttaacacagttaattatgatctttactaaacatgcataagtcaacagaactcagtatttcaccaaattaaaaacaagaattatattagagaaatgaaacccaaaagagaaatggtcatgtaactgaccacagtcaaggagttcttgcagttatttgaagtctgtgggcttgaaataggaattcttatgggtgtttggggaatatattttctgttgagtcctatactagtaagattttcaacacaaggtgactctgggtctcgccttgtaggaagagtgctgagaaaatatttcatctgctctttctccataaggagcttcatgctgatcactgctattttcttatttgatctgtaaagatagcaaagacacacgcttagtatttcatttttcctctgattcttaatgacttgcagtttttaaaaacttgccctgagagcaaactaaattatccactaaacagtgttttcacactgaagatgtgtgagagcatacctgttgtaagcaagtataattttaaaatcattctaaagaagcacctgtgtttctaaggtgatttatactgaacaagcagtacaaacaaagtagacagggaagagaaatggctatcagtgatatatggctcaacaggtaacacttgctgccttctaaaagggctctacttgtgagattctgaagattccattagaaatactcatatttaaagggtaacaatgtgagaaaagaatatgttgatttgcttgattataagaaccacttcactagaaataattgtatcaaaacatcatgttgtactccttaatgtaggttaagaaaactaaaatgaacaacaacaacaaaatctaggaatacttgtgtttagcaaacaaattttaggtttcgcccttgtgcatttcacccattatctaggaacaattaagcatttggcactgaggaataattcagaacaacaactcctgggggagaactagattggctggttggtgatcaaaaagaactaaagcatgtctgaaggcaattagcccccagcactgtgaccaaggcactggaggtggggctttttccttctgccttccacacaccccttcaggctgaacaaggttttgttttttttttatactttaagttttagggtacatgtgcacaacgtgcaggttagttacatatgtatacctgtgccatgttggtgtgctgcacccagtaactcatcatttaacattaggtatatctccaaatgttatccctcccccatccccccaccccacgacaggccccggtatgtgatgttccccacttcctttgtccatgtgttctcattgttcaattcccacctatgagtcctatgagtgagaacatacagtgtttggttttttgtccttgcgatagtttgctgagaatgatggtttccagctccatccatgtccctacaaaggacatgaactcattatttgttatggctgcacagtattccatggtgtatgtgtgccacatttccttaatccagtctatcattgttggatatttgtgttggttccaagtctttgctattgtgaatagtgctgcaataaacatacgtgtgcatgtgtctttatagcagcatggtttataatcctttgggtatatacccagtaatgggattgctgggtcaaatggtatttctagttatgttttaaccactttgtgaattacacttctttaaattccttgataagtattccctatttcacaaggatgcctttctgtaacatcttgaaaatgttacacaaatagtctttcttgaggcaccctctagtgataatactaaagatcacaataaaaaatgattgtgcccagagtagcagtaccacttgaaactttgggtttaggttgtgatctaccaaaaaataaattaaactcattaatatttctatttaggaaaattctgacaagcaattttataacaagatcacattattaattataatgcttcgaaaatacttagtgacaaaaactaacagatcaggttaactacatgagacttttcaggggaaaaaagccatacaaaagcaaaaaaaaaaaaaaagagagagagagaaagaaatgggacagaaactatccttgactaacattttaaaggtaagattatttactaacattattttctgaaattacattattagattagcattcacttcctactaatctcctgaagccatctcactaaaaattatgctttcaaaacaaattaatgagcttaattcattttctatgagtgtatgttttgacttactttgttaatttttttgacatggaattgttagctttcaatgctgctgcaaaggcttccttatattcttctaattcggttgtaatctcttcataagcagttttcatttctgagaatttacattccacatctttaagtgtgagttctttcttatttagtgaagccatattatccttgtttaactgctctaattgtttttcatattgtgcttgttcctaaaacaaaggaaaagaatacacttttaaaacaattataacctaattattatatgtttgttgcctttcattttgagtcagtgattcaaagagcgattgtgaatatgttagtaaaagaggctgaagcttaaaatatttatcagcaagatcaaaactaataactgaattcagaattgtctgatttataaaaatttgaaatcataattatgtattaatgtaatctgctcatataaaaagtaatagaatccattcataattttaaaaagtgattaatgaacaatgtagcttaagaccaattcaaaagtatcacataattttgaaatcacaattttcttatgccaactgatcttaatcatcaaatgactccacagtgagaatcattactctgaaagattgattttgttataataataatggaaatgtaaatatttaaaagaaaaaacagatgccatttttcttctagaactctacaaagcaaattgctacaagagaggcagaggaaacataatatattcataaccaaaatataatttgcggtgaaataaatgaaagcacattacagataaacttacctgatttaaaaaactaacctgtaaatggatttcttctattttttctactgcctgcattgccttttcatctagctccaatttatattcttgtagtttactaagttctaccctattgttttccatatgtgtcttaagatttaatatttcttctttcaacatctttttatcctcctcaagtttctcacattgctgttgtacttttttcatagataaaaactcctgttgaagaacttgattgtctttagccaaattgacacattttgaagataaagcttccttctctgccgtaagatcatcaaactgcatgaataaaataatatagcttgatgatgaaataggctgagaataatctaatacaaaaccaatagcaaattttgaaatgcatttacttgcaataaaatgtgatctgtaatgcagtggattcttcaaatgtgaacccttaaattactcagaattttaagaaaaaagttaaagctaccatgagtcacaaaaatatattatttgctatcatcatctttgccacagaacttttgcacttcatcttacttttatttttctgataattcatttttgttcctccttagatggcactaagttatctcttagtaaaaagtgtctaaccaccttccctcattatcattccccataatatgtcaaaaaaaagtttcagagatatcatattgagttatttaggccaaagtcaataaatggctctcagaataagactttgaaaataatataacactctatactaggcatggtggctcattcctgtaattgtagcaatttaaaagcctgtgccagaatgatcacttgaggccaggaatttgagatcagccagagcaacatagtgagacccccatgtctacaaaaaattttttttaaattagctgggcatggtggctcatgcctggagacccagctagttgggagactgaggcaaaaagatggcttgtacccagagttcagggctgcagtgaattatgaccacatcaccgcacttctgcctggatgacagacaaagaccatatctcaaaaaaacacaaaataatgaatcctgtaaataaggattctgatgccataagcctttccttaaaccgcaaatgtttcatgctaatttgaattgcattttaagaagtaatgattcttggggtaaaggtcatagaatacacacccagaaataaatccacatatttacagccaactgattttggacaaaggtgccaagaacatacactggggaaaggacagtctcttcaaatgaatggcactgggaaaactaaatatccatatggagaagaatgatactagcttcctatgtaacagcacataatgaaataaactcagaattgattgaagactgacatttaaggcctaaaattatgaaaccactctaagtaaatgtaggaaaaatgcttgaggacattagcctgcacaaagatttttatgggtaggacatcagaagcataggcaaaaaccaaatgatagacaaatggtattacattaagataaagagcttctgcccagcaaactgagtgaagagaaaaccagtggaatgggagaaaatattgtcaactattcatctaataagggactagtatccaaaatatacaagaaactcaaaaaacttgacagtaaaaaaaaatctgagttcaaaattgggcaaaatatctaactatacttttctttagaaaaaagaaatacaaatagccaataaataaatttaaaaatgctcagtatcactaatcctcagggaaataaaaatcaaatcttcaatgtgatacaatcttgcttcaatttgaataaaatgctatcattgaaaagacaaaaaaataacatatgctggtgaggttccagagaacagtaaactctaacatgctgttggtgggaaggtaaattagtgcagccactatagaaaacaacatgaggttttctcaaaaagctaataatgagactgccaagggatccggcaaacccactattgggtattcaggcaatagaaaagaaaacaatagatcaaaaagatacctgtactcatatgtttattgtagcactattcacaatagctgatgtatggaatcaacctgcatgtccataaccaaatgaatggacaaaaaactgtggcacacaaacacagtagaatactattcaccatataaaggaattcaatcctgttattcgtggccatgtggatcagtctgagggatggtatgttaagtgcagacacagaaagataaacactgcacgttctcactcatatgtgggagctaaagaaaaactgagggctgggcaacctggctattgcctgtaatttcctagcactttgaaagaccaaggcaggagaatcacttgaggccaaagttccagagcaccctggacaacataggtagatagctctacaaagtcaaaaatcagacaggtgcaatggtgcatgcccataatcctagctgctcaggaggctgaggtggaaggatcacatgagcccaagagtttgaggctgcagtgaggtatgaacaagccactgtctctagtctgggtgacgacagttgcccagagcccagactagactagcaaggccctgtctcttaacaacaacaaaaaagctcacagaggtaggggaggggaggatggttaatggatactgaattacagttagataagaggaaggagttctggtgttctgtggcattgtagggtgaatatggttaactatgatttattgtatatttttaaaaaggcagaagattttgaatgttcacaattcaaaaaatgaaaaatggttgaagtagtaaatgtgctagttagcttgatcattacacactatatacatgtatcaaaatatcactctattggccaaaattatgtatatacatgtcaattaaaacaaaagagaagctatatttatcccattaaaaaaacagaatatgggcaatccttactgacttccttctaatgaatagaatgcagtaaaagggatatcatgtggcttccctatctcagactgctttccctttgaactcagcccccagattgtgagtgagatcaggccagagagacagcctgggagtgtcagtgtcaatattcatgctgcctgctccaaccaaggttccagccaatggccagcatcaaccatcaaacacatgggtgagcaaagcttcagaggattccatttccccaactgatcagctattcctagggaagctgaggggagcagagatgacctgtcctggctaagcttttttcaaaccacaggttcatgaacaaaataaatgtttttcttttaaagccacaaaacactggataattgttagaaaaataagttttaaaaagagacaacaggaaacataacttatgcagagaaaagagtctcctttaaagtaggatctaataaatgttgagattaatttattgatggcaaacattattgagaagcagtagataaccaggagagagacataagctgctgaggaggaacatttcctaaaacccccttcaattatgaactctcataacaaggcaagggtgtctccttacaatttcccctcaagttaggaaataagactgcaaagaaagaagatgtatgatttgaaaaacaactagaaatacttggttagataaccaaaatcagacatttgcctgatttcagttaatgaaaattctaaaagaataagttttgagtatttattaatcaatctagtattcaattttcattttccttttctcaatgaggaaatgagaacattatggaatgatttttagtcttcacagaagtaaaataagcacagtatgctttgagtgttaagacatcaaatgcaatttctcctttatcttacttcaagcttgtttgtatggagaagttaagaccatcccatctctgtattataccacaatgcttctctacagcacacaacttggctctgaaatttcaaaagtcaaaatactaatctactatttgtctccaataaattgcctgaacattacctgattttgaagtgctgcactcctaagactttttcttggaatgagttaaactttatatcccaagaatcctctactgagctagaaagcagagctgtgcatctctgtttcagtaaaaggaggtcaatacagggaactgtggtttctgagaatgcaagatctgcaccaagtaaaggattagatgcagtgctacccaagagaaccagctaccaggtggaaagaggatctgcgaactacaacatgatgacttcacatgatttccactgaggaaagctggcagctcagacttctccttcctggatggtaaacatctctggaagattctatgaattataatgagttagcaaaacataatacactaaatattagactacatcagcagatcctgtgatgaaaacttactgaaaatataactatagagggaggcaatggaaaagagactaaaggtttgaatagagaaaaaaagagtgtcttgtaagcctgacttgccatgtcttagagaaagtaaggtataagctggccagagattcctttgaggcacaaaaggtgaagttaaagatattccactaaatttaatttttattatgatataagacaactggtaatatgcaacatgcttgaaaaaaacttctcattaaattcaatttggccttggcataagaatagatataaacaaactaagaattgataatctacaaataaacctgcaccttgacagtcaattgattttatacaaggttaacaaaagaacagaatgggaaaagaatagtcttttcaacaaatggtgctgcgacaactggatatccacatgcaaaaaataaataaagtaagaagaaaaccctggcataaatctttgtgactgcatttggcagtgttttcttagctatgactccaaaggaaaaatggattcaatgaacttcaaaattgaaaactgctgtgcttgagaagacagtatcaagaagtgaaaaggtaagatactgagtagaagaaagtatttgaaaagcatgtatctgataagggacttacatacgtaggatatataaagaacctttgcaattcataaataacaagataacccaatttaaaaaatgggcaaagaatttgagtagatatttctgcaaagaagatataaagatggataataagcacattaatagatgcttaatgtaattagtcattaggaaaaagtaaatcaaaaccacatgtggtatcacttcacaccacaggatgaaacctttattcaataaaaaagagaaaataagtgttaggaaaaatgtaaagaaattaaagcccttatccaatgctgctggggatgtaaagtggtgcagccactttggaaaacaaactggcagctcctcaaaaggttaagcatgaagttaccatacgacccagaaattccagtcatgagtatatactccagaaaatcaaaaacacatgcaagcacaaaaactcatacataaatgtttacagcagcattattaataagagtgaaaaagtggaaagaaccaaaacgtccatcacctttgggtgggaaagaacccaaaggtccatcacctggtgaatggataaataaactgtttgatgtatccatacaatggaatatcactctgcaataagaagaaactaagtactgatactgtattaggaggagacagcaaaatgcctaggcagataaggaagggtccctggagaatccccaacaagcctcacaagtgtttacaccagacgttatgtgcagataggggaacctggacttgtcttgcctggacgtgccggcagcagacccgaggcccacaagcactggggggatggggtggagtcaccaggaattcacgccttatgcagagcaggagcctggccacttcagctcctgtgctcctggtattcaattgtgaggtggaaacctgtttgcaggacgcccctctttgctgagagctttcctttcacttaataaattctgtcctcctcacccttcaatgtgtctgtgtgcttaatttttcctggtcatgagagaagaacccagattgagctgaactaaggagcaaaaaccctgcatcaatacctgctgcagcacagatgcagcatggaaaattatgctaagtgaaataagccagtcacagtagaccactggcttttcattttagaggcttataggcaaatctatacaaagaaggtgggtggttacctagggctgagggaggaagggaaaactagtgaagatagctaaatgatgtggggtttgtttttagggtgatgaaaatgttctacaattgattgtaatgatgactgcataactctctgaaaatactaaagttaataaattatatattttaaatgagtgaattgcatggtgtgttcattatttctcaataaacctgttaccccccaccccaaattaatttggtactagtgattttggtactagtgatctggagacaggtactgcttggtttcagatcactggccagggttcaaggcctaagagaatcaacagcatgtccttttcatagaaaaagagattgatattttaaaagctatccttttcattagtttcaagtctgtaaaattaaatgaaaaatctttcactgcttagagcactgacagatttatattgaggaataagaccttgttttccttggcctcaatttctatctaaagggtctgggaatcacacccttcaaactatcaaatctcatcagatgggttatattaactcttataatgtggcttcctttccaacctgattctggtgcagcatcacagagagaagaagctgaaggaaatcaaaatattttacccccaaatatatttttttgtcatattttgaaatggctgctgcagggccaagagattgaaatggcgctcattaacgtagcccaatctctccccttctaggtcttcccagatctggggaagattaactaagagcctgaggcatttaaagtctgaaaagatatatttaccctctattttctcaacatattttggcagaatttgggtttttccattatcaatattttccaaaattacatgatttttaataccaaaactgatttaaaattaccatatgttggaatataaattattctattataaagatacatgcatttgtatgttcattgcagcactattcacaacagtaaagccatggaatcaacccaggtgtccatcagtgatagatgggataaagaaaatgtggtacatatacaccatggaatactatggagccataaaaatgaatgagatcatgctttttgcagggatatggatgagctcaaagctgatatcttcagcaaactaatgcaggaagaaaaaaacaaacactgcatcttctcatttataagtgggagctgaatgatgagaacacatggactcggggaggggaacaacaaacactggggcctgttaaggtcaggagggagagcatcaagatcaatagctaatgcctgcagggcttaatatctaggtgatggattgataggtgcagcaaaccaacatgacacacgtttacctatataacaaacctgcacgtctcacacatgtaatctagaccttaagataaaataattttttaaaattaccttctgttttagcttcttaatcagaatatccattttcagttgatctgcttttaagtctccatggcaatcaaaatcttcatttccaaatacatttaacatatttattgtcatttccaggagtttcttatatctgcagaaatgtacagaattagtaagtcaagtatttttaagagtaaatatttaataattgtttaaacatctgttatggcatattgaagaaacaaatctataaactatgttcctttcagtttcaactgaacatagtttgaaagcattctatatgaaattataatcttagataaataatatgaagaacaattttatggcatatatggcaggtaaagtgatattatagccatacagtgtttttgttttgttttttgttttgttttgagatggaatttcactcttgttgcccaggacaaagtgcaatggtgtgatctcagctcactgcaacctctgcctcctggactcaagtgattcacctgtctcagcctcccaagtggctgggattacaggtgtgtaccacaaagcctggctcattttgtatttttagtagagacggggtttcactggtcagactggtcttgaactcttgacctcaaatgatccacccacattggcctcccaaagtgctgggattacgggtgtgagccaccacacctggcctaaccatacactttttgtaaataaactactcatatccatgttggtatgctaagtaaaatcatctattactaaatataagccataacccagagatgagtaaccaagataaaaaaagtaaaacacatacgtttaaaaagacacaaaagtacattttgatacccactgaccacagtctatcagaagaaaaaaaaagtacacacaaaaagcatcaaggagatcattcaatgtcgaaaaagagaagaaaacatctttaatatctgagttgaggagaaaaaggatacaggcagttttagaaaaaaggaaaggggcagagagatgtgtgacgatttaaagactttgaagaagagatctagacatctttgctgacataatgtcaacaaaatgaaagagatacaaaaccatgtagagaaaggcaatgacagaaaaatgttgattctaatcagaaaaccaaattaagtgctcagtaaataaatagaaaagtagctgtgttcagggcttcaaagacagattccatttttttaaaaaaaatctgtgatcaaaacatgaatgttcattttactttttaagttatacatatatttatatatatatgaaatttatttatgtaaaacaagtttaataacatgtatacttcatgtatacaacagaggtactcatgtacaatgagtaaatttccacattttatatctaaaagaaaaagcagaaacaaaatataagctacatatcaagataaatttgatgttaaagaatgacacaaacaggtctttaaaccatttgaatgcagcagaggatactacaaaaggaagaaaaaatgaccacagacagcaaaaaatatcttcagaaataaaaattcaaactagataatgaagagtgcactggacattatatgtccaaggtgtggtcattgttttcaaaatcattaaagaataagtggccgggcatggtggctcatgtcactttgggaggccgaggcgggcagatcacgaggtcaggaattcgagaccagcctgaccaacttggcaaaaccccgtctctaataaaaatacaaaaactagccaggtgtggtggcacatgcctgtaatgccagctactcaggaggctgaggcaggaaaattgcttggaggcataggttgcagtgagccaagaccgcgccattgtactccagcctgggaaacaaagccagactttttctcaaaaaaaaaaaaaaaaaaagaatattttggcattcaaaaaaaatttcaccttgccccagcagctcagctgactcccgcccccatgacacacatgtctaaaaagttgtgctgtgagtttctgaaatacattttaaaatagaattcatctaattatgaaaatgcaaacataaaatgaatttgtatctaggttttagtcaagtaaaattagagttaaatcaattaataaagggctaacatgttctacaatatgaaaaccatacccagttgcctcttcttctaattcatcatttttctttcttattcgattcacattatacttcagtgatggtattaactcaaaaagttttcttaattcttcattttcttttttaggcttaaaaaaagtgtttaaaattatttttgtaaaatctggagacgctcttttatctcaaaaatattatttctcataagtggatgagtaatatgtatttaggcaggtgtataaagtgcattttataaacctgatgccaataaggtcagatttcaataatagtcacttttcttaaaactgctaaaaatgattcaaattttcatcattatcttttccgaaatttaaactgccaacaatgtttgttacaaatgagggtttttacacacaaaatactaagggttagttaaaaaaaaaaaagagtagttatatttacattttagtttttaaagatgctctagaaatattgtttttaatagtttaagatattccaagttttcttaaattacatcttactaagacaaattttagaaaactcttatctagttcccattacatttttcatcctcatctgtcttcaggctgagctaaatactgtcattctaagtattcacccataggtttcagtttttccctttctcttaaccatttctctttaaataaagtttattttttctataataaacaaaaacaacttttgtctactttttgtggcttttctattatcctgtttctccccttccattggactctatgacacatggtctcattcagaaatcttttttcatcaattattgtgttttttatactgaaatctgatttttaataattccaataaaaaagtccaacggtcatcaagtactttatcctgctttactcagcagagcagtgaccaaatgctccctctgctcctctgaccccacttcctttctaaatgcagtgacctctgttcttcagccctatccctttctattcctctgaccccgcctcctttctaaatgcagcgacctctgttcttcagccctatccttttctggttgttttttgtttgtttgtttgttttgagatggagtctcccactgtcacccaggttggagtgcagtggcatgatctcggctcactgcaacctccacctcctggattcaagcgattctcctgcctcagcctcccaagtagctaggagtacaggcatgtgctaccacacccagctaattttgtgtattcttagtagagatggggtttcactatgttggtcagactggtcttgaactcctgacctcataatctgcctgccttggcctcccaaagtgctgggattatgggtgtgaccaccatgcccggcggctatttcactttttaaattctctcaggactcctaaaatctcaaaactttgacctagattccctaatctacatttccagctctgacctttttcttgaggtctcttccttctagtacacatattatagacaatattctccaccacatgctcatacattgctacttggtgcagattacttttgtagatagtgaatcttgtctattttatgttggttcttattgatgttaccttgagtatactgttattttctaatctcaaagggggactatctcactgttacgatactaaccagtatactttgtcctttttttcattctttcttcttttttggaccaatatactttgtcccttttttttctttttttgagatggagtcacactgtgtcatccaggctggagtgcagtggtgccatctcagcttactgcaacttctacctcctgggttcaagtgattctcctgcctctgcctcgcaagtagctgggactacaggtgcacaccaccacgcctggctaatttttgtattttcagtagagacagggtttcaccatgttggccaggctgtttttgaactcctgacctcaggtaatccacccctctcagcctctcaaagtgttgggattacagatgtgagccatggaacccagccctctttttctttgataatgaaaactttcccgtgagaatcagattatcaattgtttgcctttgttttcttttaaagaatttccttttccatagagatatggcatgatgaacatcttgttctaaagtttcttttgggggacacttaactatgtcattgggaagcttcagtaagtagagatctcccttcttcccattcaagattcttcatctcaaaatggtgtccaccaaatgtcttaatccaggtagtcccttgcttagaaattcatgaaataagaaccttctcgagaagttagaggctattgattgagacggtttaaagctgccccttattatatgttttactcccaaggtagacatcaaagtggctaataattctatgtctgatatctagctcacttctatgggaatctatacaacatgttttatttatgagacagagtctccctctgctacctaggctggagtgcagtggcttgatcactgctcactgcagcctcaatattccaagctcaaacgaccctcctaccacagcctcccaatgtagctgggactacaggcatgcaccaccatgcctcagctaagtgtttaaaaaatttcttttttttttttagagacagggtctcactatattgctctggctggtctcaaactcctgggctcaagcaatcctcctgcctcagccttccaaaaccaggtgtttaactggggactaacatgaagcacttagaagactacatggaacatagtgagctacataaaatatttgctattagcataataattttattgtatatcttaacaaaattgtgtattttacgcaggtggcatgccaatggaagtagtctcctatagctgcactgaatcattcttaacactgagagttgcagcaaatgggggacataatttataacttacttttctctctgtatgactcattaggcaatgactatctctgtactacaatgtaaatagcacctcctggatggaatagtacgtaactgacatgaccagcagagacaggctaaagacactgagctgaaaaccctggactctactgctaagtcaaggctcctgaatccgttccctctgagcaactgttgctgtggtgctgccttcacaagcactctgctgagcacacagattgaggggctgtgctatccttcatcagacaagctgcacccagaactgttcagctgacagactgggagcagtccagaaacacagtaatggctgcatagtgaaaaaaggccaatttatattctttttcatagagagaaaaacataaacacgtgattgaatgcatctcctgtattagactaattgggttagatttgatatttaattgctaaaaatatatttagaatataaccttactatgtcaaggtctcaaagcagaaataattggtatggtataaaggattgaattgtatgctacaaacttctaagctaaaatattttcaatgtatgcaaggataggtggcatacatattatatattattcccccattaagcaaatttataatgagagaaaattatcttccataaaaaaataaaagccatgtaaaattaaggactaagtttttcagcacagactagacaacgattgctaacacataaggtcaatgacagaacagtcagagaaagcttcatgaaaacaaaaaaattgtctgccaggtctgaatgaatgaggctagatgaacagaaactgagaaggcagaaaggatagcatgagcaagacaagtgctgaaatctgcccaattaactctgaggataaagtccaatggcagggaaataaaaacccgtgtccacataataacctgtaagtgaatgttcacagcagcatttttcataatagctaaaaagtggaaactaacctaaaggtccatcaactgatgaatgaatggaaaaccagtatagccatggaatagaatatcatttaactataagaagaaataaactacgaatgtgtgctaaaacatgcatgaattctgaaaacattatgctaagtgaaaaagccagtcacaaaggactacatattgtataactctatgtatatgaaatatgcagaacaggcaaacatatggagacaaaagtagacggtggttgcctactacaggggtaggtggagggacatggaggaaggctgcagtcatgcctaagagatgtggggtcacttttcagggtgatgaaaatgctgtgaacatactaatagacactgagttgtacattttaaatggttgaactgtctgatatgtgaatgacatctcagtgaatctttttaaaatccaaaggcaggatcaagataattttctcaactcttaatttttgatgtacatgctatatcaaatctaaatatttctacagttttacagtatattttaaataaaagatagataaagaaaatgcctaacttttcaaatagtttgtaaattaacctaaaacatgcacatttcaaagaatagtataatggcctttctgtacaagttaacctagaatctgtgaaacaaatagacacagattctgtgtccattcacaaaagtgaagaaataagacaattttctggaacattccatgaaacattctcctctgatttaatctggcctgcctcatcagagcaatacaaaaattacttaaaaatactgtttaacaggaaaaaagtcaattttctatgaggaatgatgtataattctcaacttttccaagggtacatattgtaagagaaaaggtatgcaatggtttttcaaaatggtagaatgaaagtcacaatataaaaaaataagtacattataaagatagtaaaatggaaatcattcattataatgaaaataaaaaatcaagcttctgccaaaattagtatcctaaaacacgttatataattcaactagctacagaataactgttgagatgttaaattccatacatacttgactttccacttgaaataatttcttctttgaggcctatgtctcatccaaattaatgtgacaacgtgatataccttccagtggagactctaacgtcgttaatttttttacactgtcagccacttcttgttgaagttgtctcacaaccacctgataaaatatttgttactgattttataaattgccttattattaaattatgttaataatgtttaattctaacatatctactttgaaaattatcaccacacatatcaattcatcttcttttaatcacatgtacacatttttatttattactgaattcagtgagggatgcagaatatgttctcttcctgccaaattggtattctcttacttacacaacagattcattccaacattcaatcatctctgaagctcaactcagcctcaaagttcctaacatattcaatcacctgttcaaatccttccaacagattcctatctcagaataaaagtaaaattccaatggcctttgaggccccaggtaaaaaggcctctacctccctctctgacttcaaagctcctacaactccctcctgtaattactccattcccactgtatgtgaagcctgccacccctcagtctgaaaatggagatttaatgcctaactcgtaaatcacagacagctacaagtatctttgtactgaacaaaattatattccaatgatagtcattgagccttgaaataaaaattatgagctaattattaatataaatattcaaagtaaactataaataccagtgggaagactaaaccaaatatagttttgctaagttttaccacatttatcctaaattacgattttataacaagtaggtgcctttaaaacattacgtggtcataaaaatacgtaatttgacatattttcagatttgttaaattaatatgaataataacaaagctataccaactaaaatacataaaaagctagttaaagcaaggtattacaagacacagcaatacacttcaattcatctggggaatctagaattaagtgtcgaagaaaatcacttaattaaattttaatttgaaaatacttcaggtgtaaacatttccatttataactacattatggtcttaacatgtggcaacgtaaagacattaaaattactatttcagcagtacagaactatctaccttaaaatatgactctgtgcctaataaaatttcataggtgacacaatgtcttttctcaaagtaaatcatctctcacctctatcttttatttcctagaaatgaggcatgtttctaagccgatatagtaaacacatttttcctttttttattaaaacagctttgttgaaatataatttacatactatagaatgtatctgttttaacttaaagttaaaagatttttagtacatttactgagttgtgcagccatctctacaatccaactttagagcatttccatcactgtaagattcctcatgcccattagcagtcactaccagcttccaaccccagccccttgcaaacattaatctactttttgtccctatacatttatcttttctggatgcttcatgtaaatggaattatacagtatggtaaacacactttttatctagatttttatattcaactaagttcaacatgtatccagaaccaaatgtttaaattttctttctagaagtttgaaaatatttatcttccttgatacttactactccttctgctttctctctctcatactgaaagagactttcttttaaatgatcacattcattcattagcttcttacttttctcttctagcacgagatctttctttccactctcaataaagcctctttgaatattagttactatctctttatgatcctctttctgatgaacgtcatctagttgctgtacaagccatgcattttcacgttggaggtgacatatcctctcttctacacagttccactttccagtggaattattcactttggcttctgcattttgatacatctctttcatttcctgtgtttgctgctgtgtatggcttaggtcgttttgtacagtttctaaagacaatgacttttttctgagactatctcatcttacggaacttatcttttaaggcattgaatttaatttgtgtttcagaaagttgttcagtaagaaactcattctcatcttttactttggaaatagcagaactcctttctacgtgtacagaaacatctcgtgttctctctaaagcaagttttaggtttctttctgttttcacactttcactgtgtttacttatagcagcagccagtctagactgataagattcaatgtcagcttccagtcttttcttgctttctttttccttcaacagttcggcattgagccttgtattctcagccttgagatcattaagctcttgttgataccggaatgctgtttctgttatcatttcctcattgagttttatgtacttttcaagggcaacatttgtttctttaacaattttaatgtccttaagatatttattttctttttccaagttgtcatttttcattgtacatatttcctgtctgagtatagcaatatctgccttcaaaatgcaattttcatccatcagacctttcatttcttcatgattatgaaaatcctaaataaaacaaaagaaagttttagctagtactcaataaaataacatatcatgattacctctgaagttaaagaataacctgcacatccgtacactaaaaagtttaccataagtggatatccacctggagaaaaagttgaagcaaaactttgaaccttatagagcataaattccagaaagttcagaaatgtatttagagtcaatgaatttataaaagtaaacacacacacgcacaccagagaatttttaagaatatcagaattggaaaagcctttccctgaattacaacaaactcaaaagcataaattaaagcattaacaaatttgactaaattaagatatatcaaaaaattgcatttacactttgatatctaacccatacaccaccctatagtaagaacttttgttcacacgtatttggacagataaaatttcccagagttattacagctctgtttcactgataacattctatttcagtttgactcttttaacacttttatagtcagttataagaattacattcactaaatcataaactagacattatactagtcattcctatatacattcattgatgaactcatctagttaccacaattttgaaaaagaaatgttaaaaatataagcaagctacaggattttccccaggacttctgactctacttctagttctccaacagatcacagttacttctgtggtgtaaatacgtcaatacgaaagaaaacttttatttcaaaacaccaatagtaaataagataaaatttatagagctcttcttagaatatcatgagattatttgtgattgcaataatttctgtttcctctttataatattaggtgcagtaatcaatatgaaataggggaaagtacaaggaaaaattttacctggaacaaaatttttatcaataggttatcactaagtatatattatggcatattattgttttcaaaagctctttgtaataaaataatatcctatgtggatgccaagatttataataaatattaataattgtacctgtaagtgtcatcattcatttttaaaaatgagataacatttctggttttagacctaaacaatatatattaaatcaagtggatattataagtaacagtgataagataaagtttaaaatatagaatttttaccaaagattgatttacccgatttggagtatttcttgcagtctttgatttcatctctagtgactgaacagttggttcaagttgttttgcgtcaacttctttcttatattgtttctctttcctttctaattcttctctattttttttgtacagcatattaacatttgttttttcttcattttcttgttttaaggtgcatctacagataaagacatttatcttaaaattcattttgttaaaaaataaagagttcatcctgtgatatacctctgcagatgttgtttattatcctaataaaatttctatattctggattatttttcctttgcagttctcagatatttaatttctcacttcaacatcttcaaaagaatgcatatacttgaaaagtagtaaggaaagaatattctgctaaagtttttgttactagtcacactaatatatattataaaaaaggataccggagataattcagtgaagttacaggttcaaaattacctttttaaatcacacagtcataattactccctaattaggaaagatcatttacaatcaactaaatttttaaagttactatttattgacaagcgtataagttcactagaaataaattttcatctttatgaaatattgcaggtgtttctccaaatgatttacagagtgagatgacaccttcagatgtctctcacacaaactatatctgcagatgactgtcatccaaaactaggctaaagagtctaacatctgtttccccacactttttataattctttcttaatactttcaattcaccttcttattacatatattttatatattcattaacctattgttcattatgtgtaatatataattaacgcccttaataagcgtgtgtatgtttacaccagttatgttttcctgtgaaatctagtcccagaagtggagttgttgagttaaagggatgtcaggctatttgaaattttgatacacagcactaagttacccttcagaaataatttaccaatttcctataccaacagtgtatgagaatgcctttttcctcacatttgccaacactaataattactttttaaatatcagcatgactttacaaaatatatcttattttatgttaatttgcatttttctgattaccaggcagggctaattacccctggtaaaaatataaaacttgttaatcataaggaatattagtccaactttgaattagtttatagcacaatgacaattatctcctgtgaaatactgctataggcggccaggcatggtggctcactcctgtaaacccagcactttgggaggctgaggtgggcagaacacctgaagtcaggagttcgagaccagcttggctaacatggtgaaatcctatttttactaaaaatacaaaaaattagctgggcatggtggcacatgcctgtaatcccagctactagggagactgagtcaggagaatcgcttgaacccaggaggcagaggttgcagtgagctgagatcacaccattgcactccagcttgggcaacaagagagaaactccatctcaaaaaaacaaaaacaaacaaaaaaaacccaaaaccaaacaacaaaaaaaaaaacaactgctataggcttacctatcatgctcttccttcagcttcttgggaaattgctgaggatacgttttcccaatctttctttgttgggttaatctgccagcagcagcagaagatgtactatcacatatattttctgaaagttgtattttttcacttttgtttgtattatttccttctttgacctttaataaaagtaatatgaataataattgttattattttattcaataaaaagaactttttccctgattttttttacttgattcaggttaactatcaccactttaatgataaaagtattttgtgcttactttaattttatcattatacataattattataattgtaagatactcttatcttatcatcgaaatttttgtcaaatctgctcatttctgtttgagggaatagaagaattttctaaaatttcaaaaagggctcttctccattttgtgcttttattcccatccactctttgctatctggtataaatttttatgctatctggctggcagaaacagagaaataaaaagacacaggcataacatatgtcttctgtctttactacctggattttacatgaaatagccagattaagaggatgtgaccttgtaggccttcaggaacagtaaagaagttttcccttttctgtactgagctactcttttccccactgccttttatctctcttttttttttttgaatcctgtgatatcaaaaaagtaaaggttctctttgaattatgggaaccaacgtttgccacaacaaaagaagcagagtgaaactgctgagtttctagtgcagaattctggaaaatgagatgcttcccagatttcactttcaattaccacaaaagtttataggtggaaaacatatggtacagttacctactttaaccccattatctactgataatgggagtcaaaccaaccaagacatattaaatgtttcatccagagctcttgaggtggcattcactagcatttcatggcaccatataacatgatacaattccatattgctgaattacataaattaccagatagatttatcaaattagtcagatatattaaaagtctaacttgagcaaagcaatttaatgcctcagagggtggaaaaaggcctcatctgcttttactttgaaagaagaaaatctctagatttttgtctatctttagaacaaaatgtacagaactcaactttctaccaaagagtcaaaggctaaatttttggctaagaaattatgcttcttatatgataaaattcatacatgccaaaacttaccatactttattaaacaacataatgtaaggtctgattcaacagaaatattgcagagtggtgattttttaaaatatgtgtaagtatatgtttgttttcaaaaatattggaaataaccatgatgggactgtaagttcaaacagtttgagctaagcagataaacttgcatgcatgaaaatacattaaacagactcatttggctgggaatattcgttgcaactctcaaggctagacgtgtttttgtggcttgtctcagtcattgcttccctcccattgtattcccattctatcattaaataaatgtaaatcatctctaaatgaatacagaaaaaagaatctagaatctagagcttgtttctttagcaatttctttatgttgatctggttcagaaggtcacatggtgtatggctgaattagtttcccagctcatacgccacttggaagactgatagtgagacataggttgattaatgaacaaacattatgagaacattctccagaaccattatttagatagcagaactaatctactttgacacataattacacatttagataaccccactgtaactgtacacatgagattttcttgaatagaaaatttgactaaatcaaatagttgataaagaggaaaaagaagcagcaagtgaagctctgtctttttgaagttggacttgcttttctccaaagccaggaactcaacttgtaacatgcctacctcattcttttttttaattattattatactttaagttctggtacatgtgcacaacatgcaggtttgttacatatctattcatgtgccatgttggtgaccttggaatatcttcccataagtcttctagctatatttttgatgttctctcactatgtggcaaagaataactcacattttataattcaagattcatgcttctgtagttgttagcactgggattgccatatagtggctgctggaataaacgctgtattggttttctgtttttgtaagtatctgtagcagcagaaatactgtggctttctatctgaatcatatgcttcatttctttggggtgggtaaacaacaaatcaaaaagactttctggatctctagactgaggccaatgcctaatgtccaatttccaattagtggtatctgggtttacattttttgccatttgcatgtcaaactcttaatcatctttcatttcaatcataattactgggttccttaattttttggtttctgtatcattacaaaaattttcatcatctgtgttagaaacaagctatgtgtctggtttgctatcatttttatagtctgatttattttcatttaaatgaagcttagaagatgactggtaactgtatttcagggacctggagtatgaatggaataaaaagacatttgacatgggcttcttctgttcaggcgctgcctggaatgccacagagttagaccctccagatgcatcttcctcctcacaatcagggacctgattcatcagattagagggcactccttttttgttcgtccctctttagagttactatgtaggagctcttcctcagggcaagcagtaattctggagttttcaaaactttcaccaatattcagcttgaacttgtttgtaatgaattttaaagaaagtcgtgaatatacagattattccctttatcacaattcttacccagttctggttcttgagacttttttttttcggcaggtgcaaaatggaaaacaagtttgcttgttttatttctcagatgtcttttctgtcagagtgcatgttttaaaattagctttaatcaagtataaacaaaaatactagaaaataattaaaatttaactgtgaaacttaatctatgtgttgccactcttaaattatgggattgtaactaaaaagtgaaaaataatttgccttggcttaacataggacagaaatatgaactggcaagctgaactcttagcatttgtttggattaaacttaatgcattatgtgtaaaatctaccagaaatgaattcaaagctgataggtagtattataaaatcttcctctcttacaaagattttacctcagcataccagaaaaagtgagcccctacagtacgtgtatatttctgaagattaactagagactaggcaaacactgaattattaagagccaaactgaacaccaataagaaagggaagcaaaattttaaattctaattctaataatatactatgatagtgttatgtatctagatggattatctgcttatatccacttctaatatattttaagttccactagtgatagtggatggattttttaaattttagtaacatttactatgtatttatgtcaaaataaagttattgtttgtaccctgacaccaaaggtcccattccacaaggtaggattctcttaataggcaactgggttgacttttatgaccccattcactccctgaacacagacacagaagtcaaatggtgaccacaaaacagaataaatctttaacctcggcactggtgaccagcaatataaaactgcaacatttgaaccactggcaatgatgactcctttaacactagtttaactcagtggccattgtggttaaactgttcataatttctattccttaataatatgacccaatatttcatgttaccttctgtattatgagtaaggttataaaaataaaagagcaagataattctgaaaatgtcttgcctcaattccaagggtaaagatagctatgagttactagagatagtaagaattaccagaataacgaatagttactagagatagtaagaatatcttaagtttcataactggttaaaatgttttaaaaattaaatataaaattatgatctatcggattctaaaggtatagtctaaaaggtcatgtcatttggactatgctttgttactaaagcaaaaaagcaaaacccaatattaaacaagaaacttaaattttcatatacctgtggttgcttcttttcacttctttcatgcctttcttgctcttcctctgaagccactggtaaggcttgttctgttgacaaattcattggtttagttcaaatgaactaagaacagttagataaagactatatataaaaataaatagagaataacatttctttgtattttatattttgagagtttcaatgaagcttaatgtttactgaaatatttagttctttaagaaatacttctaatcatccaaaacttcaacaaaccacttggggagacactagatatcaccaggttcaagccatatgaaatctcagggtcactcacaaattgttccacccaacataaatcaacataactgttagaaacaaaacaaaattttgaaatacagtcaaaatatacaatgtaacactttactatacttcataactatctttttaacaagacactaattgagttggcagttactaataatttgcaaaattattgttgtttataccttaattagtgtgcaccccattttttacatcgcaaatgttttcccctactattctgaaaaatttattttcatcttttaagactcagaaagtaggctgggcataatagctcacatctgtaatcccagcactttggaaggccaaaatgggagaattgctcaaggccaggagttttaagaccagcctgggaaccatagataaccttgactctataaaaaattggacaggtatggtgatatgtgcctgtagtcccagctactcaagaagcttaggtgagaagatccctcgagcccaggagtttgaggttgcagtgagtctcgatcacaccatcgcactccaccctgggtgatagagtaagaacttgtctccaacaacaaaaaaagaaaaaaaaaaggctcagaatgctgtgtgaagtcttccttgattctagctatctttctccacacacacaggtgtctgcttcattggagtcccttagtactttgtcaatttttccagtgtcactttaccacctgaactgcacatcatgtctttacatgttgatcccctttgctgctagactgtagaggacaatcttttgaatcatctttgtataaacagtcttaattttgctaaataattacttattgagttcctgctaagtgttaggcactggggtataaggaaggaaaataaaagctgtcagggatggctttcctaaagatcatgcatgagctgagacttagagagtaaggttagccagattaagtgaggcagagggcaggaaagggtgagcacatgccaggcagcaacaagagagggagagaagcctccaagagagtatgtatttctctgcaaaagaggaatggtgagggggccattaccagcagctcagtaattccagagaaaaaggcagatggggaaagggctacagatggagatttgggcagaaatcagtttccttttcttttctttttttgggacaacgtcttactctgtctcccagactggagtgcagtggcatgatctcggctcactgcaacccggcctcccaggttcaagcaattctcctgcctcagcctcccaagtagctgagattacaggtatgtgccattaccacctgctaatttttgtattctattagagatggggcttcgccttgttggccaggctggtcttgaactcctgacctcaaatgatccacctgcctcagtgtcccaaagtgctgggattatagacacgagccaccatgcccaacccagaaatcagtttctgaaatccttatacaaaactttaagatgcttggacataggtattcaggagtggttcacagatctatttgcattagagataattaactctaattattgtgaggagcataaaatcctgaggcatataaatcaatgaaggaagataaaatataaggcagtgttgcaaagatgatgcaggcctgaggagatgttttcagaaatatttaggatataagtatcagtggccattgtaagaatgaatttttattgaatgaataaatgtatatatctgggtccctggagaaatacactctgctcattactttacaaattttatcaaatgagaagtaaaataatatacataaactgtttcagttacttgtatttactttacactttttctgtttcagttttactgtgccaaggaaatgcatttgggttttgtggtggttgttgctgttgctgttgttgttgttgttgttgttgtttgagatggagtttcactctttctgcccaggctgaagtgcagtggtgcaatctcagctcaccacaactgctgcctcccaggttcaagtgattctcctgcctcagcctcccgagtagctggaattacaggtatgtgccaccatgcccagctaattttgtgtttttagtagagatgtgtttctccatgttggtcaggctggtctcaaactcccaacctcaggttatctgcccacctcagcctcccaaagtgctgggattacaggcacaagccaccgcgcccagccacatatggggattttgttttaaaagttctgtttcctggatctaccaagctcatgagaaaatagaagcaaacaagtcatttgcataggtaagaaactttggatttatactttgtcatcactactctagaagattatcatcatgttttgtaaaataaaatgttaattctagacataaggggaaagagaaattaaaactataggggtgaaaaaatattgcataatttattactgttgacctgaccatatgactgattaagggcactgaatttaacttgtatgtgaagtagaccccatattagctgcagttaatcaatagaccaggtattctagcagaattaaatttgatgctcctgtgttatctttaaatgatacagctcttctgaaaacccatacttatagtgcacgattatccattaagacaaggtgatggaatgtgtgaatacagctgaggagacaccacaaggcaaacgctcaatgtttcccattaatattggggaaatcaacattataatacagaaagccataggcattatttaatatttggttttggaaggtatttttagtgacactgcatacagttgtacctaataattgcaaaattacagatgtaaaaataaaacaaaggcacattgtgtttgagtaggaaatctgtagacgtctagctggttttctattccaggcccaaaattctaaatacaatcatggtacccgcacacaaatttatgttatataccaacttcagtgaaattactctttctcctcattctctttgttatttatatgttgctttccttaagggaagaatacaaatgccttgctaagaagcattctgtttggttgtaggctgcataaagggagtaaacacaaagtacatttgaccacaaaatgactttttaaaagccagaactatggtagcatgaagccaactgaggtaatctagaataaaattttctatgtttgtttcccttctttgctctctttctaccctaataactgtgattcacagaggcaatgaagagtataattccctgataaaaacacagctccaagattaatcctttctttaactatgaagttcgcgtgtccaaagtcttgtagttgctgtctgatttttgatcatgaatggtgatacagatatttatcaactcacaacttcccaaatctttgaaaagtcttactattgatggttcaactagtagaaacataatctaaaatatctgaaaataaagtttttattagaacgtaaatagtaatacaaattgtaataaggtttaaaagttctttcttcactgaagcagaaccatgatgtcctctaccccacaaacacactactccctcatggtctaatgtattttaaaagtcctgtaattgctattaactcagacaagtttacttaacttgttctaagcttctgttatttactacagtttactttatcactcaacaatctctattatatatgtgttttccatgagaaatttttttattaataattaggattcttcagggataagaaaatatttgaataactaagtttgtgcataaacacattaaggtcaaatacccatgacaatattgtgtgtttctgtgtactagagacaaaaacttcaaaaaaatttttaatgaatatacattaaaaactgctttcattaaactgagatgatcttccctcaatgcatgaataccttcagaattcacatagaccaaagaattgtataaaatataatagccttaaaaatcttatttgtacctggcacagtggctcctgcctgtaatcccagcatactggcaagctgaggcaggcagatcacctgagatcaggagtttgagagcagcctggccaacatggtgaaaccccatctctactaaaaatagagaatttagcagggtatggtagcacatgcaggtagtatcagctactcgaggggctgaggcaggagaattgcttgaacccgagaggcagaggtggtaatgagtcaagaccgagccactgcactgcagccttggtgacagagcaagactctgtctcaaaaacacaaacaaacaaaacacctaattgttcccacatcttaagtctatgttcacacaagatctgaagagtacacaacaccgtgagacaggacagacataaattttaaaaattatattcctggtttctgtaaaaataaaacggttgaatttaagcttttaagacaagtcaaggaaaagagcaaaaaatgcaaaagtgaaacttgaaaggtcattttcccatcaagggctcatgatccactggacattcacaaactatattgttcaaaacattagttctgaattttgatctgagtatccctggagttgcagtttcattcaaagatgtccaagaggtcaaataagacaatatcatttgctattttcagttttcttttctgagaacagcacaacaaacttcttcagagaaatgaattgtcctaacttcataggctaaaggctcatgagtcacagttctaagagcatttataaaatatggtggtgcatgcttgtattctgaacttttcaactttaaactctcatatagtaaatattaatagatacaaactgattaaagaaaagcccacttaatctgacatttttatttttctttctttcttcatttgtcagcaacaggagtgtctaactaaatgtggtaaagtggtataagggaatacaatgaaaagtgtaaaatgaattaaaccagagataatcatatcaatgtggatacatctggaaaatataatacaaaatacaccaaagaaagtggcagaaaggtatgtaaagtgtacaaccactcacataccattttgggacacaaataaaaaattctgcatattatttctgagcatcacaatgtagttaaagatttcaaaagggcattgaaatgaaaaacaaccaacttatgatgtcagtagcctctatgcaatcatgttttaaaaaccttaacaccaaaaagtctcaaaatcaccgttttaaaagactgtgtctaccagttataaatgaatcactttcctcatttttaatagtcaaagatgccacaaacacacacatacacacagctatatatacacctacacacacagtcttgctcattagaacatctgattggcttcagatcatcagtgtagtaatactagcagcaagcctctaaagttaaaacagaacctgacatgttaataagtaaagctttcctctaggtaaagatcagaactccaagtagcacttaactcactggaaatatcttagagtctcaaaattcactgctttgaatccctgacaggtataaaaattttatactgaaaacttcatgctattcaaaacattaaaagagaaacatctgagttaaagcttacatttttaaaatcttttttatgcttctaaatttatttttattcaaatatggataccaacaataacatttatgtcaatgccttccattcaattttgaacaaatagaattaggaataagaataatgtgagtacttccaatcattgaatgtacttatttccagtattccattaaatgtacctgctctcaatgtctgtacatcctttctttgtactgctcctttcacagcaggatcttccacttcagtgctaggctgaatgggttttaaaagaaaatgattcataaatcatatatattttatacaacatggagttagtgattcaaaaatatacataattaattaccttcaaggaaggatgttttgcaggaggccctacaaagcaaaggggatatgtcatcaattatatgtaagtatgacagggccaaccaaacattcatgcagtggtactatcgagctgaattctcatgcctggctataaaaataattacttaaggttttgaggtttcttcttggcttcttttcattgcctaggatggcaacatgacagaaacataatgaggaaaataggaatataggattcctaaaatgcacagtttacatttcagcagtgagattatgtttcaaatgcctatacctaaaatagaaaagcatggatatcaccgtgaacacgtggactgatgaggagaaaagggaccattaaacagaggagcaaatcaaacctgagggaatcgacgtcaaagctgatggtgaatgtacagagtattttaactcaacacatcagaggcattgctgccagcatgccacaaacaaattccccttgtcttgtcactgaggaaatacacagttgggatgacagttcaggtgaatgtgtgattcacctctcatcaaagaaagtgttctacattgatcagctagtatacacacttatgaaatgacagctaatcaaactactcatttttcccatgatcacatgggctactgcagcacctacatttctcctgtcccctcatttggccttgagttagagctccttgatccactcatgcaaggtggtccataaaacacaaaaaataaaccatgtcgaataagcttccaatatcaaaatatttatcaaaaaagaaaacactgaattaccacagacttgctggatacgaatacatatttatatttcaaaatcagtgcagtatttattgaaaaagagaattttggtattcacagaatgaattttataatatgattgcttctaaaattaactaactttggtgtattatcttacactgtaaaggacttttataaaacagctatcatatcaaagaactggctgtctcaaaaaaaattagccaaagcatctatatgcaacttaatcacatcttattcactcatgtcagtgaaacttctctctctgaggcctgacagttatcaagtgaaatgagctgctgtggtttaccccaactctagcactccctcctgcctccagtactctccacagcaataacctcttttgtgagactgggcatatgctgaagcaactggaagtgagttgtctcaagtttacttggtttcaactcccaagaccccagcaaatgtctttctttcctccctccgtgtcctttcacaatccctcttcctttgaaaaagtgatttttagaactgtcatcctgatgcttcccttcctaactgctttttatggataattgtgaccacttttttcatctgtattcagcagtagtatacacctgtaatctctctgttttcatctcattctccttcccctgtggctagaatcatgctcagaaataaaaggaaattaatgctttccctggattctgttattttttaaattgctctccaatggttctttttccagagttctctaaaggaaggctattcctttgctattcagagctgtgtccaaggaccagcaccaaaatcacctgagtactcatgagaaatgcagactcccatacctgctgaatcagaatgtgcaccttccagaagcttctcaactcattcatgacaatttgaatgccctgttctacactgatgtgcttccatattggtttaccctaattgcccttttggcctcgcctcaatttcttccctattatgtacctcaatttaatactacattataagccataatgtttctaatgaacttttaatcaggcaataacttctcaaattaatttcttctccataaatcacccaacactattcaattacgtttatttggcctatatgatactatcctatgaggttacaacattttctataaaaaaaaattatagccatacatggctgaccatttttggtgatgttcatctatggtagataaaacacaggtctgtgtggtgaggtgcctcaatccttaatgcctccccagtagtgaggatgacagcaagagaaggaaaatgttactctaattctctggcacattttggtactggaagctcactttatcttctttcctgtttctaacaccatgttcttccttcttctacagatcaatttgcctttactatcctctattacttacctctgcatatgcttttttatttattccatgtacactccgctctcctcattctttctttctctttattcatttcctcttccctctctcctgacttgcctcaggtcttagagtatcttaaaatggaactcacaactcagctcctttagtggtactcccaatagaatcaactgctgacccttggttacagacacaacttatcaccatttcacttctcctttacttattatacagttaataggacactttctttagctattacactctattagtgctcatattttcaaagaaacattccatcagatgacttttttttttgtttgtttttttctgagatggagtctcgctctgtcgcccagggtggaacgcagtggtggtatctctgctcactgtaagctccgcctcccgggttcaagccattctcctgcctcagcctcctgagtagctgcgactacaggtgcccacaacaacacctggctagttttttgtatttttagtagagatggggtttcaccatgttatccaggatggtctggatctcctgacctcgtgagccgcctgcctcggcctcccaaagtgctgggattacaggcgtgagccaccgcacccagcctccatcaaatgactttttaaataaaatatggttctcaccttctccttgtccatcgactattctgtttcctttttcatgcgaaggtccaggtaaaggctctgacactttctcggggacacactgctaaggtaatatcaagaattagtttccattttaaaattataatgagttgcatcaagagtttcttatcaatctctttttatgaaactgggtctcactctgtcaacccagggctagaatgcaggagcctgattatggctcactgtggtctcaaactcctgacctcaagcaatcttcccacctcaacttcctgaatagctggaactacaggtgcgtaccatcatgccatgctaatgtttttattgttatctttgtagagacaagccctcattaaactgcccaggctggtctcaaactcctgggctcaagtaaatcttccacttctgcctcccaaagtgttgagataagcagtgtgcaccaccacacccagccctaatcaatttctttaaatcaatctcaatgttgcccaggcatggtggctcacacctgtaatctcagccctttgcaaggccaaggtgggcggattgcttgagttcaggagtttgagaccagcctgggcaacataatgagaacacatctctactcaaaaaataccaaaaggagtcaggcatgatggtgtgtgcctgtagtcccagctgcttgggaagctgatgtgggaggatcacttgagcctgagaggtggatactgcagtgagccaagatcatgccactacactgcagcctgggcaacagagcaagaccctgactccccaaaaatttcaatttaaaatgtgagaacgaagagagatacaaacaaaaaacaagcctaattggtcaatgaaatatgagcttaaaccaagaaagaaaagaaacaacatgaagtacaataaagtacatggggaaatagatctataacagagccttttgctttttcatatccctgataatactaattaatatttatgctacaattagttttttgtaagtacttctgtgatagagtttattactataagacattcaattagctaaatatggtcatcgaccactacctgaaagaacattattataacagagagaaaaaactagaactttcaatcaactttccacccagaaaaaaattggtcaccagaattctaaagagtaatgtatggcagacacatgaaaaaatgatcatcatcactggccatcagagaaatgcaaatcaaaaccacaatgagataccatctcacaccagttacaatgatgatcattaaaaagtcagaaacccacaggtgctggagaggatgtggagaaataggagtacttttacactgttggtgggactgtaaactagttcatcctttgaggaagatagtatggtgattcctcaaggatctagaactagaaataccatttgacccagccatcccattactgggtatatacccaaaggattataaatcatgctgcttaaagacacatgcacacgtatgtttattgcggcactatttacaatagcaaagacttggaaccaacccaaatgtccatcaatgatagactggattaagaaaatgtggcacatatacaccatggaatactatgcagccataaaaaaggatgagctcatgtcctttgtagggacatggatgaagctggaaaccatcattctgagcaaactgtcacaaggacagaaaaccaaacaccacatattctcactcataggtggaaattgaataatgagaacacttggacacaggatggggaacatcacacactggggcctgtcgtggggtggaggaagggggaagggatagcattaggagatatacctaatgtaaatgatgagttaatgggtgcagcacaccaacatggcacgtgtatacacatgtaacaaacccacacattgtgcacatgtaccctagaacttacagtataataataataaagagtaatgtatggcttgaaaaggtatatttaatagaacatgagttggagctaataaaaagcttaagaaatgttaatctaaaatctcaatgttaagattccagttgaatgatactagaaaatatattgtaaccctctttgctactgatgacctatttctattttatttcctttttaattatggcataatttctcaacataacatatcaaaacttatacacccttaaatattaaaaaaatacaatgtaagcaatattttaaatacaatatttaattattagatacattaggtttattatattacttataacattccattatataaaaattcatttgtctatttattcagattaaacaactgttaaggctgaatgtcttatgcctgtaacccagcactttgagaggctgaggcaggcagaacacttgagcccaacagttaaagaccagcctgggcaacaaggcaaaaccctgtctctacaaaactcagctgagcatggtgacacaggtctatggtgacatagctctattgtttcaactactgggatggctgaggtgtgaggatcacctgagcccaggaaatggagatcagagtgagccaaggtctcaccagtgccctccagcctgggggacagagtgaaaccccatctcaaaaaacaacaagtaaaatgcttcttacatggaagactgtattctaggtactccaggatacacacaaatatgtttactgacctccagtagcttatggtatgcaggagcttccaatgattatttaaacaactaaatagaaaaccttctgaaattcaaaatttcagaatatgatatgaggactttgagtggttattttattttttaagatgtagccttgctctgtcacccaggctggagtgcaatggtgcgatcttggctcactgcaacctctgcctcccgggttcaagcgattctcccaccttggcctcctgagcagctgggattacaggcatgcaccatcacgcctggttaatgtttctgcttttgttttgttttgttttgtttttggttttttttagaaacagggtttcaccacattggccaggctgatcttgaactcctgacctcaggtgatctaccgacctcggcctccaaaactgctgggattacaggtgagtctccatgcctggtgaagtaaatattttaaataaactacaatgacaaaattatgatgataaagtcttaccatccattggtattaagagtctctgcttctagaactggttatttgcagcaaaatacatgttattcaattagatgaagtgccttatataaactcttcatggacaactcataaaccacacaaaaattcctttgcaatacacattttgagaacataaatttaaatttctatatttccaaaatttatatttttaaatcagatacgttgttgcccaggctgttctcaaactcctgggttcaagcaatcttcctgcctcaaattcccaagtagcagggactacaggtgtataccaccacactcagttatttttctacaatttttaattttttttgtctttctacagaaccaataatataagtagaaaaacaatctctcataaaaacaatatgataccaaaattataagtttccaagaacaaaagctatatgctatgtgcttaatatttttgccactaaaaatcaccaggaggatcccatgattactgcaaataatttgatccactgaagatttatacaggcataaatattaagaaagtcacactcgtatgatttaaaagtcaaagtattagtatttatccaaataaaccttaaccaaatttcatatttcctctattggagaaagcatttcctaatgtgattttcctgtcactactaattttccagttcatttttttcagctcccaccctgtcacagtacttatcaatctttgttagttaccaaagttaaacacattttttgaatcaactagccatatgtatgtttttctctgaccaactttccattaccaccataaaacaatgataggtaaaccactgctaaatttgaaaagtaaatactatggaaaagtacattcagagtgagaaaattaattttacaagagaccactttaccttagtagcaatattcaagtctttgtcatccgatgcaggcaatgaatccacatgcagttcatggaaaatgcttgagagcgaaaatacacaacaaaaatgagcaagttgatttctttacaatttttttaactgccagtttatatccagcttcccctcaaaaaaggaaaccataatctggggaaaggtcagcaatctatatattaaatagtgattcttgatataattaaaatatgtcctctgttctaaaaatagattttagttacctatttctgcctccacctgtctaaatctataaaatattcaatgaaaactaaccttgagctttataacaaatagtgacagtcaataaattggcagagcatgacaatgatttgccctcacaaattatctgtcctgaagctgaacttaaaattcaattaatggacgacataaattttgttacctaaactggaagaaaactgataacctaaaacaaggtagaaagatccactgtctcttttccatgatctgtctctggataaaagactaatctgcatcacttcaaaatggcagtcttgattcctcagcatggaacccacttaggaaggtcctattgctttcctttgccctaaatcagtacaggaaagcccctacaatatttgaaatgtatgaaacctaaatgtacagaagtcaaataacaaaggtgtatgttcttattgagaatacttttcccagaaagattgaaatattaacaattataaaatcccattattttcaccctataggtcctacctcattcaggtccacataaactagcaagcccttaaaacttttcataggcatgcagacacccaaggagagagactgccagaaaaaaacagagtcctggtagttgtacctctatttccctaagcactctctaagtatctgtcttcctatgggctcccacttccagattccacttctgcagggctccacagaagtctccaatctttaaatcttcagtctatgaaagcacagattcctgaaaggatggcctcaaatgaccaggagtaggagctctctatatccctgctcctgaaaaacaagctaactggagtctccatcacctgcccccaactagacacactaccaactacccaactgaactccatgactgatttgccagccaatcatgcccctgaaccagcccacatggacatgggaaggacatcagtgaatcgggaaaagaggcagaggtgaggagacacctgtactgggccacagatctatgtagttcagcaatctccagccccttagtactccaggggctctaagccaccactttgtaagtcagaatggaagtagatgacaccacatttctatctgctgcagacgctcctcccagtgtctcaaaatgttttagcatctttcagtaaaaatcttcaagtttgtcagtccttgatttaaaaaaaagcagcaaactttttagagctcccttgaaccttctattttaacatgccttcatagataattcccaacatcttgtgtccttcatttttataatttatctttatcaaacttgtcataaaccccaatattttgatctcttatggaagagtctgtactcctatccaatccagtgttgtttatcttcaaacttggacttcccctgctcattccattcttatctacttccattgggttccccagctaattccattctcattctacccacagactcactcccgtttgtattattaaaacacacgccaataggatataaaaagaagcaagagtactgggctttaacatgagtcaaatctcatttctgccaattcctatgtctaaaaaaaagcatcctaatctctttgagcctcacattctctatctagagaatcatttgaccagaatgttcaacacaggtaaaaatactagaaggtattttaattcattccaagattccttaaaattctgtaattctatgtcctcttgattctttctatagaaaaacttagaatacatagccagcagagtttgaaaaaataatagaacaaaagaaataccaagaaaagtagagaagaaagttttaaaaaatgaaggcaagattatagaaaagtcacggaaaaagcaacaagactaaaaaatgtattatggaagtaagcagaaatacttgcctaaatggaaaaccaaactgggaagtcaaataatttgtctctaagacttgcctaaacttgcttttgtaaaacttacacccctatggccaaagctaagtaagatctgccctagagcctttgatggtaaaaataagatactggttaccactgaaattgtcaaatttattaggacaaactcttggactaaccacattctaatgataaacttaaatgagagttcaaggtatttaaactctcattaatttagacattaatcaaattaatcaatctgactaatctgattcagacctataccttgatccaagggctgcacagatatctgtcaatctatgctgaggagcaagagacaggatttggaaagcaggcaggctgatggtcaaactgtaggccagctactttgttaactatgggatcatgaggcaattaatcagctctaatccatagttgtttatttaataaacagtaggttataggaacacagatgttgtgatggctttatgagatgataaatgcatagaacatattaggatgtctagcccagaatacaacactcaacagatattcgtttcttccatctatattttcttagttaacataattttttaaatctataaaatcctacctgactgcagattcatcagaacttccaacatctattaaagaaaaaggtaaaatgcattttaaatcaataacaaatgtacagaatattaaaagcataagtatgcacagtgatgcatccctctaatccaaactacttgggaggctgaggcaggaggatcacttgaggaacccagaagtttgagaccagcttgggaaacatagtaagactctaccttcataaaaaaattgcgcacacttgtgtgtatgctttagatcctgttttttgttgttgttgtttttgtttttgtttggtttggttttttaaagcataagactgatgctttgttacaaagcattcctttgggagcatgcctgggaccttattagaattaacattcgttatacatattggtaggtaattaatgctgtaagaactcttccctttgtatttattagatgcaaagaagaataaatttattaaaatttggtatctacaagtgaactgcagtatgcaagtcaacctagccaaaccctatgaggttgagtaaaaatggtattgttagcagaacaggtgtgatgagtcaacagtgtcaaagagcatgatttctggaccaaaatatgaggcgccattaaaacagagtatacagtagtaccccttatccactatatgtgcagaaagacaagcttgacacatttttctctgctgtcacaccacagcaacaatcatcaacaaagaaggcttctgtgaccaaatgtgtggagggtttttccccaccaacaagcaagcaatcattccggctgatgacacaattcaattctcacaccctatctgctggtaacatcagattcaatttaatttataaattaaactttagcatagatatgtatgtatagggaaaaacagtttgtgattcagtactatttatggtttcatacatccactgggggtcttggaatgtatctcccacagttaagggggagctactgcacttattttgttataacacaacacagcctctctagctcttcagttcaaactgctcagtttagaataaaacaccctaacaccagatgtcagcaaaacataggaatcagaccagaaacaggaatccttgcaaagactttccagccgctagtggaaaagagctcaaaagagatcaatgtattactctggctactactctttggggaaggtgctgggtggtttacttagttgtagctatttgctctgccctacatatagcaaggcccaaattcacctgctattttacctcccacagaaaacccgctggaaagatcactcctttaagagcttatccgctaggaaccacacctcacattcagagagaagctgaagaaacaccagggaggtgtggcaggctgctgggcagtactatatgatgtgaaaaatatatagaaagaaaaccatcaatgcccttttactaccagaatgttccagtgcttgcccttctccctagtaggggaaaaaaattctttttcacctcacagaaagcaaaactctcttgctatccctcatgacagaatctagttgtaggtgagtcacatcatcataatacaggctgttgtcaacctcatccctcaaaggaagaggatcagtgaggaacctatgtatttacctatagcattcactgtccggtcttatttccaaccgaaggtaagtatgaaagactttgtgattccagttttataaagtacaaccccttgcacttgtccccttccattgctagagagtctatctggacccacctcacagagcaagatgctccagtttgtgctgtgtggtacagcatggtgtccttttccacaaccctttctattatgtgccacatatctatacaaatcatgttttctaagtatgtaaagcatatgtcatcagaatatatcattctttacaatgataaagaagcaaaagaaaaacaaaaggacaaagaagatcttaaatgactacattcaactgccatggagctttaattttttaactattcaaaaagatatccactgtattattccaactatgtgactcttctgaaaaaatgaaactatgaagacagagtaaacatcaatggttgccaagagttgctagggagaaagggagagatgaacaggcatagcatagagaattcttagggctgtgaaactgttctgttgataatattacagtaatagatacatgtcatgtcattatacacttgtccaaattcacagaatgtacagcatcaagagtgaagcctgatgtaaactatgaactttgaatgattataatgtgtcaatgtaagttcatcagttgtaacaaatgtaccactctctggtggaaaatagtaataatgggggaggctatgcaggtgtgggaggcatgggatatatgaaaaatctctgtaccttcctctcaattttgctgtgaacctaaaactgctctaagaaataaggttattgatttaaaaaagatattcagctgggctcagtggcttatgcctgtaatctcagcactttgggaggcaaaggtgggtggatcacctgaggtcaggagttcaagaccggcctggccaacatggcaaaacctcgtctctaataaaaatacaaaaattagctgggcatggtggctggcacctgtaatttcagctactcaggaggctgaggcaggagaatcgcttgagcctagaaggcggaggttgcagttaactgagattgcaccactgcactgcagcctgtgagacagagtgagactccatctcaaaaaacaaaaagatattcactgtctatgcatcccaggatctccagaacaacaattaaataaataaataaataaataaataaataaatggctgggggcagtggctcatgcctgtaatcccagcactttgagaggccaaggtaggtggataacctgaggtcaggagttcgagaccagcctgactaacatggtgaaaccccatctctactaaatacaaaaaattagccagacatgattgtgcatgcctgtagttccaggtacctaggaggctgaggcaggagaatcatttgaaactgggaggtggaggttgcaatgagccaagattgtgtcattgccctgcagcctgggtaacaagagcaaaactccgtctcaaaaaaataagtaaataaaataaaaaataaagatattcactgaacctgttactatgatatatttaagcaagacacggtgaccctaaaaattagagatcattgaagaccaaagtaacaacatgcggtcattacttctcaaattgaactatataaaatatataaaataaataaatttaattgcatgcttaggtaagaaaatattgataaaaataattgaatattttatcttatttcataattctaaacagggatttagcacaatatgaaaactagactattcatgtaatcaaaataaaagacaatttttattctaattttaactcaaattattttgcttatttaatttaacaattttactgaaaggttaatgagataaataggacagattataattacctaacattgctatggtaacttatatacaaatagctgttcatcaccaaaagtcaaaaaggtaacaagcactgcaacttaagatggatcacacaacagaaattagtaccaagttaccttatcttataatattatgttattaaaatgaaattttaaaacaacaccaaaaattaagttggggttacaagtgttgtgcagaaaagatttcatatagcaggcaagaggctgccatccttagaaaggcctgcatgcaaggctggcccttagctggtgtttaggaaattggaaatgggagggtttccaccattccctgagaagagtggctcactgtgtctaaagtgcttatagaaagtgtattactctaaacagctgctttccttgcaagagtctggaatttgggtacatgtgagggagagtaacctccatagaaaaacttgggcacttagtctctaatgagactctggtactggtagacatcactgcacatatgttgtcaaaatgtgagcctgggagaattaagcagatcccgggaactccacaggacagaactcctggaggcttgtgccttgtttcctccagaattgaccacatgcacctttttcctctactaattttgcttgtccccttccttgttatcaattaaagatctgagtatgactatttcctgagtcctgtgagtccttctaatgaaccaccaaacctggggtggtcttgggaaaccttgacacaaattcattgtgtaagatttgtattaagttgatatgatacgtgtaactgtaatcagatggttatttcacagaataactttacctcatctgtttttcttttctttttttgccttgatatttgacttggagattcttgtatttctatatctatccaattgaataaagccatagaaggaataaatgaaaaaataatgtcagaaaataatgtgaaataagcagcaatcctcttttatctgaataaaaaatagagaatctgggtgattggcaatatgttctacaatatgaaagtttctagaaacaaaaatgaaaaagtggtcaattttctgcaactcaactgggcttcattccttttcataataattttgaaggccaggtgcagtggctcacacttgtaaatccgagcattttgggaggttgaggcaggaggatcacttgagcccagaagttccagaccggcctcggcaatatagtgagacctcatctattaaacaaacaaacaaaaaaaacccttaaaaagaaaattagccaagtgtggtagtacatgcctatagtcccagctacttgggaggctaaggtgaaaggatcatttaaggccagcaagcagaagttgcagtgagccaagatggcaccactgcacaccagtactgacaacagagggagaccctgtattaaaaataaataaacaaataaataattgtgtatcaggccagatgtaaccacacaaaactgtagtcccagctactcaggaggatgaggtaggaggactgcttgagcccaggagttcaaggctacggtgagctatgatttcaccaatgaatagacactgtattctagcctaggcaacatagagagacaccatctcctatgataataataattgattaattgtgcatcattcaagtaaattgtataactggagaaaaacatatgactattgaatatactattatagtctactactgaccatagagttcctgtttacttgcttctaatctttttcttcatttctcataaaactaaaaacatgatttaaacccattaaaggcagttcatcacaaaacaagtcaaaaagtcaaaagaattgaatccaaacagtaggatgcattatccaccgctctctgtgaacagttggatttggtcattaagaatcagcaggacttttaactttgtgtctgtgggcacacgtgtgtgcacatgtgcacgtgtgtatgtgtatgtatgtaaactatgacagataaaatcattttgcttgtgtatgaatatgtaatataacttgtgctcctcacaaaggaattgcttttccatcttctgtgctcagtagctgtcttcaaaaaataatctcctatttgtatgggtgcacactggttcagttctacagttcttattgccatttatttatggtaccagaaagggattgctgagttcctggttctaaagatagttactttcttagtgacacaaatcaatatgtaatacagttcacccttgaacagcaagggtttcaactgcagggattcacttatatgcagattttcctctgcctctgcaacagagagacagcaagatccacctctcctcttcctcctcagcctaatcaacctgaagatcatgaagacctttgtcaggactacttatgctttatgaaaagtcaatatgtttttcctgatgatttcctttctaacagcttcatttctctagcttattttattgtacgaacacagtatataataatgcagcacaaacaaaataggtgttcatcaactgtttatgttatcaggaaggcttccagtcaattgtgggctattagtagctaaggtgaaggaatcaaaagttatactcagattttcaactgcacagggatcagagtccctcacccccacattattcatgggtcaactgtagttatttgtttactaaatataaacaatttattataaaaatgaaatcaaagatccatttgtataacaagtccaatttgttataatgtgactatagaggaaacatacaacatactaacttaaaaatcttttttcttatttatgcaaaaatattatataggattttagggatcataattaaataaatgaatgttttcagacaataatgtttgagattataaattagctacaactaccttcttaaataaatctgaatttcaaactaaagaagttaaattttaaaaattaatttacatatgtatatacatatatacacattcaatttacacatatttttaaactggtcttttttgactgaaactaccttaatcttacatcttactttgtattttcttatcaagagtaggaccaccaagagaagtaagaaattcgcaatcagaagtcttacctgatttctccgttttaagtgtcttctttttatgttccaaaatttgttgttgaattctatgtatacaaaagtaataaataaaattgctatttttataatgaaataaaaaatattcaccaaacatattaaattccaaaacactttcaagcaatatcagacctaatatcagaattttaatgtcccatacacttcaaatttgtaaaccttacaagcttattaagcttataattaaagaagaaaagaaagtgaagtactcataaatggaggaagcacagctcagtaaatgaactctagtgagctggatatcatgcaaagtgtcctgcactcagagtaagtccttgctctgtaaccaaaatacctcgctctgtaggtattttgtcttcagacaagttgcttctcttaggctccatggtttattccaaaaaataaggattctgctaccttacttcactaggttgtttggaagatgtaatgagattacacgtttaaatgttcagagaaatagtaaagcaatggaataatttattcttgaactttattgctgaaaccattttggaatcccaaataatgctcggtgtgtgtttttctgtaagttctaatactcaaatgttgcagttttcagaaaatgttattaagtgctaattttggttattacttgtattcattgtggcttgtaattcagggcattttacctaattcataacttattactaaatttctatatatataaatttagtgagctcatcactgagctcatcaatcacaccaagggcagaaaaccaataggtgtcaaaacctggcttggacaactaccactccttctctacctcctcaaactctgagccagcagatctgtgcttggctgctggatctccatggtcctctccaactaacagacaagacaaaaccctgctttgattgtttttcagttccatgaaggaaatgcaagttgacattttctcatttccaagacatgtactaacaacatgtaacatccccttattactcagctctgttcccatttcagagatcaccatacatcaatagtttcatagcgataatcacaatttcaatattgcgtgtcacctgttttggttttgctcacactgcttcctcggagctactcaacaaatagtcaaatggccttcctgggactaggcaaaatacggaatgttttctgaatttgtgtgccatccctaggcagtagccatgcttatctgctctgtattgatccaattttaaaatatgtgctgttgaaataagtacaaagccctgtttgatacatggatattcatgagtcatggatgaggcttagctctattaaatccaactcacttacttcagattcagagaattttattgaatggcttcttgtgaggtagaattttaaaatatattgaaaacttgaggaagagctgcaagtagcccaggagattttcatgattatagagacacattacttgaggggccaactgcaagctggttcccactactcagtggaaagataacatggaacattccgctatctaaccaaagctgctgcacaggatataaaaaagcctcaaggtacagatctgatagcaaaagagacagggaactctgatctcttcctgcaacattatttgaacatccctgactattgagaacaatcccaacactgggtaaaggaaagacaaacatggctctcaaaggataacataccatgaaggcctaggcaaagtctagctaagatgtgggctccaaataaggtttttagtgtagggtgagcatcaacttgctcaatatttgtgtggataaagctaagaggcctagctgccagagcagggtgctgggaacaatgactgagcacaagtacataaactaataaacaccatagctttgacctctatatatgaatcaccatgaaaactgaggggtctgaatcagtgaaggcatcctggtggcaaaggtcaatcattatcagattgcaggaccggttataatggcaatagtacagcaagtgagtccatggaaacaacagaatgattagaatggccttttttccccttcttctgacttgtaaagaaagattgccttccttggacttaggaaaccccttagcttcttggaaaattcaaagaaggaagacacaggagagagccccaggggacaatacaagattttctgttaaactggacattacaagactcaataactaattagaaaagtcaggccaggcatggtggctagcactttcagaggccgaggcagggggattacttgacctcaaaagttcaagaccagccagggcaacagagtgagaccttgtctctacaaaaaaaaaaaaaaaaaaaaaaggaaaggaaaggaaaagaaatcaaagacatggctctttttatcccatgcatggggattatacttagaataaaatgaataacattgagatccctagggataaaggtctcaaaaatccagaaaaaatctcgcactctacttctaactaatctagacttctgcttgatttctggctaaaaggtagactaactcttcgctatttcaaactatctgaaccaaactatgaactctcacctaatgtataagatggagtagttgcaattattttaaacttcaatttagcattaactggccttttaacataaacacttactttgtcaaatgatgagaaatagcgtaatcttctgcatctcgtccacacatgtcttgagcgaagataatattttgcttaagaaggatattgacaatacctggtgagtcatagtatacagcaagtatgagagctgacctaaaataacaaagaaataactccactcaagaactttaataaagacttttttaaaaagctagtttgatacactttaccaatttaatatccgcctgtcagtgtagatgtaataaccatttgcatgtactagcttgggtctataagcatctaggatgctcaagtgttcatctttgtaaattgtcaccaaggctaaaagaaagggacaacagggaagcctcttgtcccactggtgtaagacataatacaagttgctaacttatagtcctttgatggccaagaaactgtgctgaggtcacttatctaaagtaggcaaagatttagatgaagatgtccccattgctttcctagtcaaatcagctaggggtcagataagagttatctgcaggctgaaaacaacaacaataataataatgacaatgctagtagtcataaactagaagttcacactttaaaaatgaataaaacttgtcaggtgcagagtctcatgcctgtaatcccagcactttgggaagccggggagagcagatcacgaggtcaagagatcgagaccatcctggccaacatggtgaaatcccatctctactaaaaatacaaaaattagctgggcatggtggcgtgcacctgtagtcccagctacttgggaggccgaggcaggagaatcgcttgaacctgggaggtggagaatgcagtgagctgagatcacaccactgcactccagcctggcaacagagcaagactctatctcaaaaaaaaaaaaaattaataaaactaatacaaaaccctttagctaataaaagattatggtaccaaaaacatctcattataaatatcaaacactgtatattataagagaagatgaatcctactatatactattctttatgttactcagtccaaatatttgctggtctacctgattattcatggtgatatttttcattatatgccaataattatgttaatcttcttattaatatttctgacttgagtgaccactctagaatactcaggttttatttttaaaaaaagaactactgtaccgtctcagcctatcaacggcattgtgcacttgctttctttttcaataaaaattccaccattttctctttcttgcaaattatagcgaataaaagtggggtattattgtcctataaaacagcagaaataaattaataattcacaaaattacatatttctcaactgaactgaaaatcttctctaggatgctttgaacttcaatatacaatatagaaaggaagtaaatgaaaagcagtcccttcattctcactcctctgtgctttctgatgtgctgcactttgccttgcaaacaaccctcctctgtcttcccggattaactgtggtcattgccaaaactcactttaaacatttactagtcccaagaatccttgctttgatcacagcacttagcatggtacattgtagtcatttcactgtttcccactgaaaccaagagcttcttgaggcaagggcctaaaaccctaagacacagtagcaaatattttaagttttttacattaattaatgatctaaattactatctctaaagcagtgtttcttaaactatattccaaagaatatttgctttatcagaagtattataccccaagagaaagactccatgaccatctgtatttgagaagtattacaaaactgtattttatgtccaataatcaagaaatctctttaattttacctaatccccctttcacaatactatttgtggcaaacattaacatttgaggaatttagagtttcagagatacagttgccagagcttcccaatacaggtggcagtttcctctgggtggtacaaacttgcttgattcacttctatcaatggtgtcaggatcccagatgccaatgtcaggcactcctgctccaaatgggtcaccatggaaatgagctttgaattaagagagattggcttcaaatgcatttattttccttattattaaatagtccatgggtttttcccctaatacaagagaagagatttttatctttactgttagaaagctcagtatattctgtgtaagagagatagatttaaaaaacttaagaacaaatattttaaaagccaaaactcagtaagaaatactattctcaattataatggtaatcccgggaccctagtgcagctctactttttaaatccatttttactggcttccacttaaatggctacttaaaattattttttattttagacaaaatataaattggaaataaaaacataatggcttatcaataaaagttctcatactgatccatatggattatttctggcataatacaagccaataagtcacttgcatctttaaggaagagaactgaggagaaagatgtactgtctgcaatattcataaattatccaactataaccaggaataacctaaaaaggcttctaggcattcttatgggcagagaattatttgtggtatatataaagaaaagagttaaaaacttctaaactctaaaattcaactccataactgagggatttatatactctatagactatatattataaacaaatacatgctgacttaaaaaccttgaaatttttatcaaaatatactataatataggagttgtaaactcagatacttacaaagacaaaggaaggttgcctgagtaagggaagtaccaaggtgggcacagtagcaaactggagaatacctgccttctataaaggggcaacttctgcacagcagaccaaagaatgatagaaactcaggggacaccagttttgattttttaggatacggctgaagtccacatttcttcacgagtcttctaaattttacatgttgattcaacttatagaggcgaacaaacaaatctatgtaccacattagaatatagcccttgtttttttatatttgctattaatatgttactaaatggttgtgtaaaatccaagtatttgcatgtaaaatattttctttctctggtatcatatgttctaccaaaaaatcaggctctcatatataataaaaattgctaaaaagactcacaatacctgcttcaagaatttttccaacatgtattcatttaaaatgtttgtatataattttcccagattgttaaccaaatagataattggttcacaagactgctaaaactaaattattaaaagaattcctatctatattcttattaacttcatggatttcagtgtttaaaactgacattttgggtatgctaaagttctataaacttaacaaacatactgagatagttcataataaaacttcaactaaaaaaaatagtttaggatttgctactattctaattgagaaagcccaaattgtaatgaacatttgttgacacataatcacctgcgttgtgacaaagggacatgaaatcatgaaatggtcagcctctacgtattgaaagattactcataagcaaatttctgaagactctctgaatggtagtgaatgattcatggtgggaagcaaaacatgttattctgtaagctgagagatattgccaatgatatttcctttcacttcccagtcacggatgtagagaaagacagataagtcaggctaatattattgaaaaggagaactttgaaggagtggcaactatcaaatgccaactcttctagagatttcttacatttttgagatacagaaatttatatattgcacttatctattctggggtttttaatcacgagtgtatcccaaccttgagggttttttttttttttgtggttttttctttttggctattattgttgttagagacaagagtctcactatgttgctcaagctggattcaaactcttaggctcaagctgggactacaggaatacaccactgtgcccagcttcaagaaaacatttttaaacacgttcaggccttattaggtctattacatcaaaatcttcaggggaaagcctacaattgtagatttttaacaaaatgtcctcaggtcactgtaatgcacaattctgagaattagtgcagcagacaatcacttcagtctcacctctcacccacatggctaattcctttatcagttggagatgtggccaaaaagagaaaagagtaagagatagtgtcatttattaaaactccagttaagtttcctggctatgggtagaacagggacaagtaaactcaaaatcccacttgattttgctatttacaagctccttatctcccaccttcccactaagacattctagatttgagaggaggctttaggttcttatctaagtggctgtttctgccaggatgagcaataagtcagttaataatttgttccaccttctgctgaagtgtttctcacttcgtcaccacatattcactgccaatctggtttcctcagagtcctcctaaaattcatctctaggcaagttgcaactcattctttttcaaaccaaaaattattagacccaaagctaaacagcaccttgtctcaacacataaaacaaacttaaaaacaaaaaaaaacctcttcctggcattttccctcattatctaatatccaagtgacctgcatatttctgattgctctctttctcccctcccatttttacctcttaagccttgccactgagagatgatacatcagtttttcagaaaattagcagcaacagcaacatgtccctttattgtaagttgctttagttttgtttgagttttaagataaagcctatttccagggaatattttctttcatgtgttgttttacactagttaagagaaaaaaaaaaaaaaaaaaagaataagcctgtgtagaaaaaaagttgaaaaggttttacctttaacaaattcacaaatattttccaaagtgcattttataaagctgtgccctttaatgcttctttaaaagtatcaatatttaaaataaaatcttagacaattaagttatttcaaaataacttaatttgtatttgcattcagggaatggttgagcttccaaatataaaaaattgacccttacctatgtcaatgttaaaacaaatattttggaaagaaagttgattgacctataccttgtccagtgcttcaatatgtgcaccatgggaaagcagtttttctgccagtgaggtgctgtcactatacacagcataatggagagcagtgttgccatagatatccttaaggtttggattggcaccatgttccagcagaataacggcacaagcctcttcctggcaatggacagcctgtccgtgttagatcaagaaacagattgtaaattccaagaattcaaaatacacattccacaggtttcaccaactagttatatgtaaatgagatcaatttattttaattctatatatgtaaatcaaatccatgtcatgctgaaagagttggctctaatatacctgtatcaaaggcatcctgttttctttgtcacagatatcaatctggcattttctgctaaccaggagattgaccacttgcacatggccactggcacaggccaagtatagagcagttctatgagagtaagaggattttttaagaaactgtagtacaatatctcaaaacatacaatcattcatgtaattgtaaaaattgaatagcatgtttttcctctgtcttcaaaacaaataattttttgaagaaagtacaatacttaatagctcttattgctcactgccttaatgaaaacagcagcctatttgagtagaaagagctcagtctttggattcggttcaactagggcttgagtcctactttaagccttgacacttaccaactattgcttagcctttctgtgcctcaacttcctcattaataaagatgacaatagtagctatctcataggacaccatcgtgatgcttaaatgagaagctatgtaaagtatgtagaacagttcctacaacaactcaataattgtaagatttttgttttttgagacaaagtctcactcttttgcccaggctggagtgcaatggtgtaactatacctggaactcctgggtcaaatgatcctccatccccagcctcctgagtagctgggactacagatgagcaccagcatgcccagctatttatttaaaaatttttgtagagtaagaatctcactttgttgcccaggctggtctcaaactcctggcatcaagcaatcctctcacctcagcctcccaaagttctgggattacaggtgtgagccactgcacccagccagatataataattattactattactactacttaacaaaaccattttaattaggtagaatgatacagttatacctactttgcaggatgacttaatgagtaggtcacattttaacacctctgacattggaatgccacttataattcatgatttgttataactataattggtagcattttaaaaattatcttattgatatataaaatagcggggcatcacacaatccatgagaccttacattaagtagaatatggtatactcagcaggtctagggcagttctaggcatgcaactgaaacttaaatacattttagttcttaaaggtactatggggaaagagcactgaaataacaataatgcattttttaaacaaattaattctttgattttcaaacaacttgaagccaaaggaaactcatgattcaaatgaatacatatggctcactgtattcaatatttatacttagagaatatatgcaaataagactttccaatgattaatattagtatttaagactgataaactttcgaaagagcagttaaaggttatcttctactattttctaacttcagaaatgcttttgtttgaaaggtgggagataaagtttcaaggagattaagtcccaatattcctattttaaatctctcagcttgtgcaggcggggcaggtaaacatgaagtgtttaaggatggacgggtcctgagagatggtagaatatgtctgctacatagcaggtactcaggttatgcttgatccataaatggaatgaaagaatggataaatacagttggggagttcaatatttttaaataaactcctataaagcaatatttttgcaataataataatttatatgtgttattttatttttaaagaatacaattaaattgaaatgattaatctatctttgcataaatgaatgagtatataagaaaaacatatgtacataatatatagataataaaatctggaaacagataaaaacattccctttttacttctgaagaggctaaaagctcaaagaagataacaacacacacaataatgataaaaaatagaaagtgagaaattattttcatcagcgcaagattcatattcctctcttcccaaggattattccattaataataaacttttactagaagttttgtactcactgcagcaatcacagataagaaaaaggaaaaaaactttacttaaaatacaaatgctcagaaattacaaattttatattttgtacatatttttgctaaaacaagaccatagtatgtttgtgtatgtataatttaactaattttttctccttgctagctataacaaaatacatctttgcacatcaacgtacttctgtatctattgctaccttcagtggtcacatattattccatcctatggatgtaactgaaatttatttataggatccattctatgggttctttttaaagtaagtactgtgaaaaataaagtgcatgtatctttatttcctaagggtattttagtataatggaattcgtgggtaaagggcatacacattttttaaatgtagtacttaccattttcaaatgagtactttgaaaagtaatcagcaacttaaactttaagcagcagtataaaacatcctcacaaatattgtggatagaaaactgtttcattcctcttttagtttaaattcttataccagaaatgcgaaggattttttcctatgtatataagtaacttgtagatctggaaaaaggtactttgcccacttttagagtgtttgaagatttgatttgaaagaattccctgtaaaatgaagatgtacttttcatctcatgtgtatatataactgatatatataacatattatatgttatatatgtatacatatcagtaatatatatatatatcttatgatatataataaacaacataggccaggcgcggtggctcaaacctgtaatcccagcgctttgggaggcggaggcgggcagatgacttgaggtcaggagttcgagaccagcctggccaacgtggtgaaactaaatatacaaaaattagccaggcatgctggcacctgcctgcaatcccagctacttgggaggctgaggtaggaaaattgcttgaacccggcaggcagaggttgcagtgagccaagattgtgccattggacaccagcctgggcaaagaagcgagactccgactcaaaaaaaaaaaaaaagaatataatgaattccctatgaaatgaaaacatacttttcatctgaaaaaaaaaaatatatatataatatagtaaatatttttcaagtaagctctcttatctgagaacttctcgcccactgaaataactcacggtatttttgataggggaacgagttctctcattaggcaccccctataatgtatataaaccatgttttaaacgtgtacgttaaaaataacaacgctgtatatgcttaactttgtgagttaaatcactcaaattctccaactgctccagccagggaattatgagggatggaaaacagctgagagtccatttggctccgcccctccgagggtgcccagcgccctgcaaggccccgtcccagggtctgcggggaagccgggcctgggggccccctcccaccccaggctgagccccccgctacctgtgctgcttgtccagggcgtgcaggtctccgctcctgtgcgccaggcagcgctccacctccgcggcgtcgcctttgacagctgccctgtggatcttctgcagttcggagtcgcggattcggtatccggaacccgtgtagacgtggtctatggagccctgggccgtctggcccctgcggctcccgaagccgaataacttcatagtggtgacttcttctcagacccccaaccaccggctcttgagcgagggcagctgcctgtcaccttttcaccacccgcctccccgaccccggccgacccagccccaaatcccctatccaaccccaaagccccgatacaaccccaaatccgctatttcaaatctatgatctactccacaatcctcgatccagcccagtccaccacagccttcagcagcaacactcgcagcctccgacctctcagaccgagtgagcctcgcaaagccgttgggcgcgcgcctgcacggcggttgctgccaggctcccggaagacgctccctggtggcgcgcgcctgcaccgcggttgctgcccggctcccggaaaccgctccctggcggcgcgcgccggcaggtggggctgcagctctgggcaggcgccgatgggctcgccagttctcctgggatcgcccgggcggccccaggatcgcaggcgcgcagccagccaggcctgagaaggagggcctgtctggccttgcagcccaccccgctcctcctcggaagggagatagggtgctggcaagggcactccgcggccacctgagtggcttcgcggattgtctggctgaacgctgaggctctggccctggagtctgtgtggctagtgtcaggtagctggagagggatggaggcagagtcaggggctgctccttcccccacccgccctcactgctgccagtgccacacgcgcggtttgcagctgcagatctggcactggcgcaggatggcggagcttcccttggatggcctcagggccgccgagcgcacagcccacctggcctcaacgtccgctcctcttggacatctttctggatcctgggccctggcgttgggcactctgtatccacacggatgaaacagcggctgctggcggggccggttgcctgattttgccgcctgggggtctggcctcaggatccacgctactgcggggcgggcctggtctggagtgtccagtcacttgctgccagtgcaccacgtctagactgcagctgcggctccgatgccggcgtgagctggcgggcctggtacctgatgtcctcagggtcaagtgcatcgcccgcccacttgaggggttgctctgacttggcctcctccaagaacgcaagggccgccggggctggctcttcgtggtaaccgggatggtactgagcagcaggttttcaccctggtgccgctgctgtgcggactgcctgacttgggcgcccaggcacccgccccagggtccgcgtggcaggtgtgcaggtagggtgagtggcgcggagggtcgggggttgctccgtcatctctgcccgtgtgcaacttgcagttttgcagttttctgcagcagctgaggcgctggtgcgggaaggcggagctcccctggatggcgtcaggtttgcgggcacagagcacagcccaccaggcctgaaggtccgctcaggggccatagtggttgagttctctgtggaactgggatggggtgaacggccagttcccgtcctttggccgcctggccaactgccagacttaaccgctgccgcccgggcatctgtctttagcattgccgctacttgggtagaagtgggggtcggggtggggcgtggagcgtcaccggttgccaggccagcactgtctttgcaacatattcagatggcggcgggcagcttgggcgccagcatgggctggcggggctcccctggacggccctcaggtcgcttacagcattgtcccaggacttcctcggcctgtgccaggtgggcaaggtacggggggagcttccaaggcttctatcccaactctacctatttctacctattttctcttgagttattttgtctttatctgttttatttgcaaaaatagtatacgcaaaatacatcaagtgaatgcacatcaggcatatagaagatctggcagaaacacgttttctcatgcccatttccactcagtatttgaacacagaggcttccacggttttgattctttccaccaaaggttagttttgactgttttcaccatttatgtaagtgaaactataaattatataatttttatgttcactcactaaacatgcttgtgacacatcattttgctcctattgattattcattaattttattttgtaatactcaattttatgactataccacaggtttgaggcctttgcttgttttgtttttaatccattccactattgatagacacaaaagcagtttctgatttgaggctatcatgaataaacctgctacgaacaaatcagatatacacatttttttctgtaataatattttcacttttcttgagtttaagtacataagagtggattttctgggttacaaaataagtatatatttggcattgtatgaaatggggagacattttcctaagtggttatgccatcttaaactacaatgaaaatgtttgagagaatcagttccactttctaaccaatacttgatgctgtcagttgttttagtgttatccatccttatgggatataactgctgagtagctgtctgccttctcccataacacagaaaattgagggcccagaggacagttttattttcgtatttgacatcttctattattttttatagaaggatgatttgagtagtaaaattttctttcaattttctaggttgtgtctgaatcttactggggttccttgtcctaaaccacattcagaaattttcacgaccgacttcttatctttgtcataccaggccaatgagggacagcattcctgagactttttaagtactttgtatgtgtgtgatggtctaataatcatagccttaaaactttctggctgggcatggtggctcacacctgtaatcccagcacttcgagaggccgaggcgggtggatcacctgaggtcgggagttcgagaccagcctgaccaacgtggagaaaccccaactctactaaaaataaaaaattagctgagcatggtggcacatgcctgtaatcccagctacttgggaggcaggagctacttgggctgatgcaggagaattgcttgaacccatgaagtggacgttgcagttagccaagatcacaccattgcactccagcctgggtaacaagagtgaaattctgtctcaaaaaaaaaaaaaaaaaaaaaaagaatctcagacttctgggagacactgaatttgtgaatgtgtacagcatatcacaataacttttctttgagaccaagtctcactctgctgcccaagctggagtgcagtggcccatctcagctcactgcaacctctgcctcccggattcaagcaattctcctgtcttcccgagtagctgggattacaggtgctgcaaccatgcctggctaatttttgtatttttagtagagacagagtttcacatattggccaggctggtctcgaactcctcacctcagatgatccacctgcctcggcctctcgaagtgctgggattacaggtgtgagccaccatacccagccagaaagttttaaggctatgattattagaccatcacacacacacaaagtacttaaaaagtctcaggaatgctgtccctcattgggaccacaacacccagataattttttttttttttttgtagaaagaggagccttgctatgttgcccaagctggcctcaaactcccaccctcaagagatctgcccacctcgacaaccagagtaactggttctacaggaaaataccactatcccatgataattatattttattaatttttatttgcatagacaggaggtcttgctatgttgcccagggtggtctcaggctcctggactcgaacaattctcccatctgtgccatctgtgcctcccaaagtgctcccaaagtgctgacgccacaggcataagccactgcacctggcccgacttaagatgtctttaatctagcatcccatacttcatataatcaggaaaagcagtagtgtttttttttttaattacttagtatctcaacaagaatcaaccatctctcaccattgccaggaccctggtcagaaccactatcatctcatacctggatgttgccacagcttggcctccgtgcttctacccaaatcttcccacaatctttctcaactcagccaccatgggatgcttttaaatcaatagacagttcatgtcacctctctgctcagaacccttccgcatctcccatctcagcataaaagccaaagccccagcaatagcctcccagggcttgcacaatctgtactgatctgagtcccacaactccctggcctcctcccctaccttctctccctctctctactcgacagacctctttcctgagcttcagacacaccacggagttccctcttagcacctttattctgttgtttctgcctacaatgctcttccctcagtaccttggccagctccttcccctccttcaagtctttgctcaattttcacttaggaggccaaccctgaccactctatttaatattggtatgtgtccccattcctgccatgctcactcatttctttttactttttttttaagatataatctcgctgtgtcactcaggctggggcaccatggcacgatcacaacacactgagacctggaactcctaggtcaaaaaatcgtcctgcctcagcgcctctagtagctaagactacaagtgcatgccactacacccgctaatttttttttcccacgtagacagggtatcactttgttgcccaggcttatcttgaactcctgggccaaagcaaccatcctgcctcagcctcctaaatagctggaattataggtgtgggccactacccctggcttcatgttcatttcttcttgctgctgttacaaactaccctacattgagtggcttaatacaccacaaatctactacctaacaggtctgggggccagaagtccaaaataggtctattaaggctaaagtcaaggtgtcagcaggactgcatcccttctggaggttccagagagaacgtgttcccttgcctttcccagttccgaaagccacccctattctttggctcatggcccctaactgcatctccaaagccagaagcaaagcatattcaaatctccctctgttacctgtgcttacatcatcaaatcttcaattctgactctcttacctccctctttcacttataaagacctcttgtgattgctggacacagaggccggggctcacaaccataatcccaacagtttaggaggtcaaagcaggagaaatgcttgaggccagaagttcaggaccagcctgggaaacacagtgagaccccccccctcaattaaacaacaaaaagaaataagagaaaattagctgggcatggtggtatgcatctgtagtttcagctacttgagaggctatggtgaaaggattcctttagccccagagttcaagaccagcctcggcaatataacaagatcccatctctacaaaaaaaatacaaaaatcagctgggcatggatggtgtgcacctgtagtcccagatgcttggaaggctgaggcgggagaattgcttgagcccaggtggttgaggctgcagttagctacgactgcatcattgcactccagattgggtgaaacagagactctgtgttcaaaagaaaaagaaaagaaatacacatttggtttctgcccctcgtcctggcacagagcttctcaagttcttataaaggccttggtgataaatgtgataggagcatcttttgtttgaatatttggtcgtagtcccaggtttctaacacaagagcctctaagacctttgggatcaccatagtaagaatgcatttggtgatgttactgagatgactgggtgactgaaagctcctagacagcttcagaaaaagggctggttgccagaaggacaaaccatgtgattagaggcttggaactgtcagcctcacccactgggctccaggaagaaatagtggccgaagactgacttaatcaccaatggtcaatgatttcatctatcatgcctgcttaaagaagccttcataaacgacctcaacaaccagatttggagaatgcctgggttgctgaacacaagggagatagcaggaaggtaacatgcgcaatagagagcatggaagttctgtacccctcccgacacagcttgccctgtgtttttttttttttttttttgagacagggtctggctctgtcccccagcctagagtgccgtggcacaatcgtggctcactgcaacctatgcctccctagctcaagccccatctctcatcctctcacctcagcctcctaactagaattataggcactgagtagctagaactatagatcactgcacctggctaatttttagaaaatcctttttgtagagatgcgttttcaccgtgttacccacgctggtcttaatctcctgagcacttaagcgatgctcccacctcagtctcccaaagagctgaaattacaggcatgagccactgtgcccagcatgtacatctctttcaccggctgtttctgagatacagcctttaaaatgaaccagtaaaagaaagtaaattggtgagatgcagtggctcacacccataatcccagcattttgtgaagttgaggtgggaggatcatgtgagcccagaaatttgagaccagcctgggcaacataacaagaccccttctctacaaaaaataaaaaaacttagccagatatgctggtgcgggcctgtagtctcagctatttgggaggctgaggtgggaggatcacttgagcccaggagtcccatgctacagtgagctttgatcacaccactgcattccagcctggcaacagactgagaccctgtatctcagaaaaaaaagaaaacaatctgtttttctgagttctgcaagctgtccgagcaaatgattccacccagcaacggggtcatgaaaccctgttttctaactggtcggtcaaaactacatgcaacaacccaagacttgcaattggcatgtggagtgagggtagactcctgggactgagcccccatcctgcggggtctgcactaactccagggagtgtcaggatggaattgtgggatacccagttgggatccagattgtctgaaaatcagtgtagaaactccacatgcacatttggttagaggtgtttaaccataactactattcacgaaaaaggtctactcattagaactgaaaatcataaaattgtaagttctacaaaaataaatcaaccttatctattgcccagtcctaccaaactacagaatgtgagaacagaaggtctgaccgtggactcaagagctgacattaggaatgtcaccaccatcctgctctccaatgtctcctcatcttcagcagactcctcatcttcaatgggcagagtggaaactgcaacttgtgccatgatccttgcacaagaaaagtagtaagaaagtgagtggtagaaatccagtgtcctaaactcacatccagagctgtgcgagtttttcaccggctgggtaattcacagttttcttgaatcaggggaaaaataagactcagaaactaggaattcgttttacccaaaactctcatcagatagagaatccatccactaactttctatctagtattatttccataagttagatcagtatcactcccaaaacaaatgcacatggcacccagaatctgtgcatttctcccaagtaaaagaggaggtggatgggctcagtgtctcatgcctgtaaccccagcactttcggaggccaaggtgggcagatcacttgaggtcaggagttcaacaccagcctggtcaacatggtgataccgtctctactaaaaataaaaaaaattagccaggtgtggaggcacgtgcctatagtccagcttcttgggaggctgagacaggagaattgcttgaacccaggaggctgaggttgcagtgagcagagatctcagcactgcatctgagcctcggtgacagagtgagactctgtctcaaaaaaaaagggggggggaaggaggcaatgcactttacaacccagtgatgggctaccacaactcaacacagcaaagaggtgccaagctccctttctcccctgcacaacccgacacagaagagttggtgcagtggaatgaggttggatggagagaagttcctcttctttcctttttttttttttgagatggagtctcactctatcacacaggctgggtgcagtggtgcaatctcggtcactgcaatctccgcctcccaggttcaaccaattcgctgcctcagccttccgagtagctgggattagaggtgcccgccaccacacccagccaatttttgtttgtatgtttgtttagtagagactgggtttcactatgttggccaggctggtcttgaactcctgaccttgtgatccatctgccttggcctcccaaagtgctgggattacaggcatgagctgctgcgcccagccgagaagttcctcttcttactgagaaaatagatcacagggcatcaagtaacacataaaattctttataatacgcagtattatttttggaaaacctttcctaatattttggtatcagcaaaaaccctcagattaatttcaaacactataaaaatacagtacataaacagaaaacattaactgtcagcaatgctatagagaaattggaagctgtatgcattgccttttggaacgtaaaatggtacagcccactgtggaaaatggtttagcagctccttaaaaatattaagcacagaattatatgatccaccaacaccctttaagtgtatatacccaaaataactgagagcagggactcaaacaggtatttgcacacccgtttaacagcagcattattcacagtggccaaaaggtagaaccaacaatggataaagaaaatgtaatatatacatacacagagtattattcagccatacaaagaaaaatatctggccagattcaggggcttacacctgtaatcccagtattttgggaggccaaggtgggcaggtctcttgagccccgaattttgagaccaggctggacaacatggcacatttggtcagaagtgtttgaccataactactattcaagaaaaagatctactcattagaactataaatcataaaattataaattctacaaaaacaaatcaaccttatctaccacccagtactacccaattacagaatgttagaacagaaggtctcaccatggactcaagagctgatatgagcaatgtcaccaccatcctgctctctgcggactcatcttcaacagactcatcttcaacggactcctcatcttccatggactcctcatcttcaatgggcagggtggaaactgcagcttgtgccatgatccctgtgcaagaaaagtagtaagaaattgaatggtagaaatccagtatcctaaactcacatccagagctgtgagagtttttcaccggctggcaaattgttttttgcatcagagaaaaaaacaaaacttggtaacttggtattcgatttgcccaaaactctcatcagatagagaattcatccactaactttctatctagtattatttccatgaagttagatgaatatcactcccaaaataaatccacgtggcaaccagaatcagtgcatttctcccaagaggaggtggccaagcgaccacatctgtaatcccagcatgttgggaggccgaggtgggtggatcaggaggtcaaaagattgagaccatcctggccaacatggtgaaaccctggtctctaccaaaaatacaaaaaatagctggatgtggtggtgtgtgcctataatcccagctacttaggaggctgaggcaggagaatcacttgaaccagggagtcagaggttgcagtgagccgagatcatgtcactgcactctagcctggtgacagagcaagactccgtctaaaagaaaaaaacagtaaaatacaaaatgtctttttctcctaaccttcttagccttctgctggtacttcaatttctgctggtactgtttggtcattgccctctaaagaatgatagcttcctaaaaaaaaacaaacaacatataaaccaataaaaactcacattgaaagataaaaaataatctaggtgacgatgcaagcacttttaagacataataggccaggtgcagtggctcacacctgtaaacccagcagtttgggaggctgaggagggtggatcacctgagttcaggagttcgagaccagcctgggccaacattgtgaaacctcatatctactaaaatacaagaaatcagccaggcgtggtggcgggtgcctgtaagcccacctactcgggaggctgaggcaggagaatcacttgaacccaggagatggaggttgcagtgagctgagattacaccgctgcactccagcctgggtgacgagagtgaaactccatctcatgaaaaaaagaaagacataataaacataaaatatgattctattaactctattaatccaaataatgttttctaattcagaagaaatatataacatgtctatttggtagcttaaaaacattcttttaaaatacaaatacagtagacccaagtaggcttggggacttaatattagttactctagctacatgataaaattactggatatatcggaatcttaagcagcacaattatgcttcaagtaccatgctcatctgtcactgacacacacacaagtgtgaatgcttgctttgctcaattaactctgtaaataagctcaggatttgctgtggaatgttccctgctttccattttcactatggtgaaagttatggaaactcaatccccataatttaagcaaagttgtacttaaagtaactcatatgtaaaaatttaagatactgcctttagtgtcaaaaacattttaatccaggtaatgtaatctgcctgcttctaaaaactggcatataaagcaacagatctgttaggcagtcacaaggtaaacaggctcatcctactggagcagaagttttactcacaaatatgaaagaaataatctaaaatatcagagtgccacttaggattaagaccacaaactgcccccagtacacatcctctgtccttaaagatctgagctactaacatggaaaagattgaaaaacactgtcttcaagtataaataaaaatatattacatttcggtaagaatacattgtttagggggaagggaagcagatgctcatctattttgtcctatctattgataactcaattcagaagctgtaccaaaagtcaaacaaaagttataaatacatctcttaatttttaaagagcaatgattacagtcagaaaaactcatttggtggctagtattcttgaattaaaagtgccataccaaagtgaaatctttttggttttcaacatctagttttttcatgtcacaattattttgggattcttttccacttactgcatattgtgaaaactcacctgaactcaaaactctaggtaaatctataaacctgtatctcagaatccatctttaattcatttgtaaaatacactttctctgcacacatttcctctctcttcttttaaccgtaatatttggatttagggagcatcaagttccttgactgtaaagtcaatgaaaaaagagatatgaggtcaaaagaatgggagataatgaacaagaggccagtagttaaaaagtaaaatttcaataaagaataacagttaagatggtcattcatgttattacccaaacaccaggggttttgtccaggtcctcctgctcatcggagaaaaagccagtcactgaggtgacaagtactgccaaggaagaaagctttaacctggtgctgcagcccaggagctgggagctcagtcttaaatccatgggcttgactaataggggcaggaaagaaatttaacaatgtataagagaacagaaattagggaggggcaggaggcatgtggtgctgtgatctggtatgtttcagttatctgatacttcctgaaggtcttttttttgaggagagaactcagatacaacagatccaagtttcaagctttaacagcagggtcaattttgacattgatccaaaaaaaaacccatccattgggacaatagggccggtgtcaatgtaagcaatgattctgtagttcctctttgttctttcaaaatctgaaataaacaattgaatttatattatatgctaaatctaaagaaaatacatcttgtgtacttgaggccacaagagatagaagtaaaacctattactaatagcctatgagagagtcaagtttgggaacattataaaaaattcaaaaaaagtaataaatgcataaaacttacagagtaacaagtgctatttcagaattcttctaaatactaagtattgacatgaccttatcaatatttgcattactaaccatacaataagaacctgacttctgactattctgagataagggataaatgtgtactttaccttaaatgggaaagtgcatcatgtacccacttcgagattcacaacagggaaaactgatttgaaaaattgttgcttgtgaagttcatttatatgttaaaaaaaggccaatacattttcccttttccacatagaaaaggaacactatacttataaatactaaaacacagtctgtggaatacaaggaaccaatagaaacagtatgtaggaaaatggaagtgaaaagattatacattgcaaagacttcagtagaaggagtttttcatcaacatcatcagtttcagaagggccttctttgggatacaaagacaatacttcaacagtaactcccccaagccagacgcagtgacttatgcctgtaatcccagcaatttgggaggccaaggcaggcagatctcttgaggtctgaagttcgagacaaacctggccaacagggtgatacaccatctctaccaaaaaatacaaaaattaaccaggtgtagtggcatgcacctatacagtcccagctacatgggaggctgaggcaaatgtactcattttttcattcctgcacccaagaaactgcaaccaatctactctgttaagagcagagacaaagggtttcgactccatattacatgtgaaatagaagaaatgaatcagtttagtatgaacttgtatgcacttttggagaagaaagtaggtcaagaagccattaagatacatgaaggaaggtcaaatcttaaagaaaactagaaattcagatttatttatgtagctctagaaggaagaaccaggaatagtggagaatgaatgtagaaaacatttttagtgaatgaaagcatgagatgataacacaagcagccaccaatggaacaaactgatgtgcaacagcggatttgccatcactgaagctatcgagtctccaactgttgcaggtattacagagctatcaagagttttagtaggcggctggggttcctttcagatctgacatggcatgatgccaaaatgctgtacatgctctcatctttttctggctcatttttttttctctcttcaggtttcttaatcttttatctacttccctctattaataatcacctgaaccatacactcagtcttctgaagtaaatttctttatctttcacttcacaaataaacatctttgatggatgaaaacaccgcaggaaagccacctaagcagatatgacttctcaacttttttttttaagtgatttccattcatcactaattccaaacaaaacaattacaaactatcataaaattattagaaagtgaaaatgggaagcattggttaaatatgtgtttagtatgcttcaccatgtcctcaaacatatttaaaaagttaatccacacttctttaagtgcattgggggacttgctttagattaagaaatatgttaactatttcaggacactaaggaccttacatatctgaattagctcagattggctgctatctcctcaattattttctgataaataagaaacaaacagtaaatagcaacttccagaaaatctaccagtagtacacaagggcagccaaacttcaaaattcttgccactcaaactctagacggttactatttactaaaatgtaaataataaaaagacttttctcaatcttgtcctccagaaagaaaagccgtaaagttcaaacactaaccaaaaaaagggtaaggagaaacgtttatatattggcgttccttttattagtgtcttcacatacaacactcctcaattttaaacaccgctttctttcagaagacaaaaccaagacaaaatggtagaaatcaaagggttacagactttgatttaaaaggcataaccttttcaaaaatgagagctatcgatggatcacttctgagaagaaattccctggcactaggatagaggttggaaaaccatctttccaggtgctctaaaatagaatcctctcatagtgcaagagtccttctaattctaggggtctaggactatttttattattattgttacctttcccgttctggaaaatcctcaagactctgtcttgtaaatgtcaccaacccagtaggttctacagaagcaataaaagaaaaacatacccaaaataagtttcaattttgaaaacattacacacacacacgtgaatgtgcgcgcacacacactcgataaaagaataggtctaacattgaatataaaaccaaccaggaaatacaaagcctagcattggaaaataacagaatattgattgaaaatattatccttacagtagaaactcctataaaacagtaagacttcactaaacgaaactatacaaataacagcacaacagtaggatttgagtgctggtactttttggtaaagttttgaagctgaatacacttcaaaaaaaaaccattggaaaaaaggatgtataactggtacagcttatgcagtaaagacaaaactgaattcaaatttgtagactcctttacaaagaaaggacttaaccctacattcaaagactggtgaataaagacacatctatgtactttatagtaaagtgaaatgccacagctttaaaaagaaaatcatttgcacatcctctgaagttagtaaagctaagtttcaggcttagatagtgggcaatcactctacttgttagtagcagtcttagccagagaagaaattactggttctaagagtttacagaataaagatgacatatttttcaagaagcaataaatttgggaggatcaaaatagagtagtattaatgtagtcaataattttaagaggatgagatccttttctagtcagatttatttattttttaaagctagtagcaaaagaaacaaatatatcaactggccagaagtaatttgtctgattcaaatcaaagagcaaactaaaaaggccatgccatttctgttttcttgaatagaaaaaagctcttaaggaaagagagagatgtcaggaactattactgatgacagtgtataacccagtgaaagcctggccatcatttcattcctgtgcacaattccacatttccttgttctcagtcaaaagcaggaaccactcaaaaaccatatggagcagttgcagaagaaaacaaaattttttgttaacatgggtcttacattctttagatatctaactttaacataaacggataacgtatttaaaactcacaagtaagtggtcaaacaactctaacactagaaacacaattccatgaatataatagaaaacatctctcttgtcattcggtattagcagagaagtaagaacatcaaatgtcctttatatatactaagagatgctaagagaaattcataaacactgctggcaaagcaagaaaaagcagaagaacatggtttcttagattaagaaaaaatgccttgagagcacgtctgttagctttctttttcataacaaggcaactttcatctcagaataggatactctgattaatcaaatacttcccataataaaatcacaatatatactacatacaggtcataaattttcaaaaatctgatctataagatactttatctaaaactatataaaaagtaatttaattcggaaggctttttaaaatatttcagtctcaagatcctcatcaaatataaaatacacgtttaacaacactgaaaagttggtcctgatggaattctattctatcaattctaaaaggcaggtttttccacatactacatttctgaaactggaatacatcttttataatggaggtatcttaccataggtctagactagaggagaattttcccagagaagatgtgcatctgcttctgctgtcatctgggaacactatcagcccaacaccatctgaattaatcctttgtggaccacactggtggtaaggctgcacacccaaagcttagggcttgtggttcaaattctcagagaaatgtttttttctttctctatttagtgtcaaggttgagacttgcacgcttctttatggtcccttttctggatggtcaagttaatttctcatttatccctaggtgtaccagccttgtgggttaggtctcctactaaactccctgtcctgagtgttttttccttcttagaggtatataatgtaatagcactttttaaaaataatctatgacatcttagattagatttgatgaaatatggtaccttaaataagcttctcaagtctattgagtaggctccagaacttctacacaatgactcattacactgcaacctcttttattctctttaggatttcctctttaaaccattagctttacatactgcacaccaagagcaatgttgtactgtatttctacaaagaacttaattaacatgtacagtaaaaaagtcagaaaataaaatgtctagttataatttatttcttcaaattccaaatacttataatggcatatacatttctagttgaaaaaacaaacttttagctttttccttaaagtatctgaaatcctaaaatttagaaagccaggttagtttttagagaagacatacatgatttgactcccaggacaaaaaagtaaactctgtactacttagttataacaattctacttaaaatggcaactcaaagtactgtaaaaacaaaacaaaaaagaccaacagtaataattctacttagacctagaatagccaaaaaaagtagtcattttttttttttagacataatcttgctctttgtcacccaggctagagtgtagtggcacaatctcagctcactgcaacctccacttcccaggttcaaatgattcttgtgcctcaacctcccgagtagctgggattacaggctcctgccaccgcgcctggctaatttttgtatttttttagtagagacggggtttcaccatcttgactaagctggtctggaactcctgacctcgtgatccaccacgcctggccttacgtagtcatctttttaacaagtcattacaaattctaatttaattttgtgtctcataggtccaaatgattctgcattttaatatttcattcagtacagggcacaaaactgaaattcaataagctatgagataaataattccatatcagagaagcatataattttcccttaaatatcaaaatcctgataattgatttcattctaaaaatttaacagtgtccaatagcaatacattcaagggggaagatgccaagtacactgtaatgcaagagtaaaagtaggatatgagaaaaatgaccttaaaattattcaaagacatgttttaagacaatcctacaacccagaactgaaaaaaagccatttcacttgagcaggttgacattacctacttagtacaaagaaacttttaaggtgttctggtttacatccacttgtaggaaaggctacccattgataatagcttacatttattaagcatgtatctccttgtttaatatctataactaccctgtaaggtaataaccattattatattatttcataggtgataaaactgaagcttagaggtgtcaagaaacttgaccacggtcattcagcttctgagataagagtggcaataccactctattatcagctggtcattaccagtatttgttggacatttactattactgcctcagctgctatcaggttttggggaagcaagaatgttaaggtttaatagaggaagatggatataaaactcagtacaaaacagttttatgagaactccacaaagggcttaggggggcacaaaagagaggaatgggtagaaaagcaatgcgttagttgacttatacaaataaactagtgaatgcctctttaaataaagagcatccaaaatttatttcctggtcaatatactttctctggtttttattcatgaaaatgttttgaggtatattacagatttcagagaatatgtgtccgatttcagagtatgtaaaccccgcccccctacatttatagcacacatttatgcttatacacaagcataaaaccgaagttatcttgtcgcatcattactgtttcaatgtggttgggacaggaaggtttacgttaaacacaaaatgttcctcacatgtcacttgacttgaactgttcccatcagcaagaaaaattactgcaagaatgaaaggagttcacttttctctgtgactgttccaaagaagtggaagagcgttttaagtttatccggtttccttgatgaatgtccctcaaacaacctaaaggacttaaaaaataagagaatggaagataagttaaaatgccttaatgattcagaaaactacatccatattgctaccaagtaacaaaaagaaataattgttccagaagacaattctgtaatgataagaactagaaaattggtttagattcaaatggcatctggagagaactgaaatcaactagaaccagccttctttaaagctgttcaaatcagacagcatttgctaccaaccacatttctccaacctatcttccaccacagagaaggcaccatctagccctcccagtcaattggggtcagtcagtgcacagctactttctcaatggctaataacatttataattcataatgttactacgtagttggataagtaacaaaaacagtatctgaaaaaaatccttatctgagtgtttgtgaggaaatgagagtggaggggaatgggggaaggacacaggcaggtgtaacaagatatcagggctcaacaatccttgttaattaaacaactagtttcttttatggactgaatgtttgtgcctctcaaaatttatatgttgaatctttaatccctaatatagctaaatttggagacagggcctgtgaggaggtactaacagttaaatgaggtcatggggtgtgactctcatctgatagaactggtgtcgttataagacaaggtgagactacagtactctcccctttggcatgtgaggacaagatgccagccaacctataagccaggaagaaagccctcatcaggaaccgaagcagcagcaccctgatctacagcttctagcctccagaactgtgagaaaattaagccacccagttctatggtattttattatggcagcccaagctgactaatagagatcctttgcacggtaaccaaaacaatgcctaccctgtgtcatctagttttcagcaacccggacttggattacttaattcagtttcctttgaaatgatgtggcattgttattggtaacatgtaattcagtttattctgaggaaagaaaagcagggctttaaaagcattatgacctgagtaagtagttcactaaaagatttgtaacacaaaagcatgcttttgagcatgagatctagctttccaaaggcatttagaaattatagagactcagtggctatgaatgatgaggtactcttcatctgcctctagccatgtgctctgactttaaaaccagagacccttcaagtaaagtccacgttagtaagtgctgaaatgggtaattatttttcatgattacaacagcaagcttatgtaactatgctgagagggaaaagttaattccatgagaaaatcctattgagcgactgaaataaattaggaaaaggaaaggaaatgcagatttcaaatggttccgttttcaacgatctgaaatctgtattcaaggccaatttctggaaaaacaatttatgtgaatatttatttcctagaaagaatactaatgtaggctagtattttaaccaaatctaaaatcagatctcttttttaaaagtttaagacagcctgtgtgataatttttatttaaaagaatctgtcttctaaaatatttaatacacatactcataatccagttgctagctgaaacagggtacaggttaaataagatagtatttctaaatggattctgaatggattaaaactcaataaaatggacattttattgagtgaatggagagatctaatccatctggcaagtcagttaagagagcttctgctgccatttttattgacatgtaatagtgtaataaactcacatgtaatactgtaaagctctgtaaaaaaattttaacctagcctatttgtttaaaggagatgttaacaattcatgctcccttcaaccacttcatttttgcttttaggacaggactgttcattaacacacacaatcaattactaaacacaattactgaaataaatattatcaagcagtaaccaaaaaattcaacgtaaggctatcatacccaaactccaatatccagaagccaatttaagtaacccatgcctccttggcaaaagtgtatggataataccttttccttgtgatagtaaaacctatccattttcttacatcacccaagtatcagcttttacgcttctacaaataaagcagacaatgaacatactgtgtagaaatcctgagctcttaattaaaaggtactcacagagttgtatctaaatcattggctacaatgatctaaaacacacacagagttatatctaggtcatttgctacaatgatctaaaccacttcatttacatcttagtattaatcacaggacaaaaacgctaatattttcagaactacaatcagtgttgctatctggcacaggcaacgtgtcttcaaaaccccatgacactatgtgtttgcccccaagtaaacaggagggagatccaggcgccccttccaaaagcaacagcttagaggagagaaggaaaatcaaagatactgagatgattcattttagcaaaaagcgaacctgccaccccaaagagcagaaaacaaaatctgaaaactaagatgtatattattatatgttattcacagaacttatttacaatatttttaaagaaaaaattacaaaaccgtgtttctgaaaatgttacaataaaattatatgtgtgtaaagtctatctattttacgtgtacatttgtgtgtgtgtaagagagaggggattatgaattaggaagcgtatgtaccaaaacattagaagcagttatcctcgggtaatgagattatgattttcactttcctctttataccttaatatatcatctccaaatttacaatcagaattcactataaaactattgcatttttatttatttatttattttgtgagacatggtctcactctgtcacccaggctggagagtgcagtggcgcaatttcagctcactgcaacctcggcctcccaggctcaagcagtcctcccacctcccacctgagcctcctgagtagctgagacccatcaaagttaagttttcttcgatttaaagtacttgttataattatgttgtttagcctcatggtaaccagaaaacaaaaatcaatagacactctaaacataaaaagcaaggaattaaaacactaccagaaaaaattacttcactacaaataaagacaggaagaaaggcaaggaggaaagagaagaagtaaaaagagatcagaaagaaaagaggaagggagaaagaacaaaagaaaaagtagcaaaacaatcaaaaaagtaaaaaatggcagtagtatgtttttatctataataatcttgaatgtaaattaaattaagacagagtgactgaatggattaaaagacccaattatgtcctgcctacaaggaactcagttcacctataaagacatacacagacaaagtcaagggatgataagagatatcccatacaaatggaaacaaaaaaagcaggagtagctatacttagataaaatagcctttaactcaaaaaaagaaaaaataaagataattatataaatgagaaacaagtaaacagccgttaagtgcatatgcaaccaacactcaagcacctaaatatagatgcaaatattaacaggctttaaaggacagatggactgcaatacaataatagattacctcaacactccaccgtaatcaacaccccactatcgcgaacggacagatcatccaggcaacaaaacatcatcagttaaactgtactctatacagaatggacctaacagacatttacacagcttttcactgtgcaactgcacaatgctcattctactgagtggcacatcgattattctacagggcagactgtgttaggccaaaaaacaagtcacaacactttttttttttttgaggtggagtctctctctgtctcccaggctggagtgcagtggcactatctcggctcactgcaagctccgcctcctgggttaatgcctttctcctgcttcagcctccggaggagcccgccaccacgcctggctaattttttgtatttttggtagagacggagtttttccgtgttagccaggatggtctcaatctcctgacctcgtgatcccgcctcggtcatccaacacatttttaaaaactgaattcatatcaagtatcttttgtgaccacagtcgaatagtattagaaatcaataacagatagaactttaaaaactgtacaaatacatggaaattaaaatacacacccatgagcaaccaataaaagaaatgaagaaaacacaagggaaattaaatatttattgaaacaagtaagaatagaaacacaacataacaaatcctgtgggatgcaccaaaggcaattctaagaggaaaagtgtatagctataaatgcctgcatcagaaaagtaggaagatctcaaatagcctgacggtacacctccagtaatgagaaaaacaggaacaatcaaatgctagaattcgcagaaaaaataccataaagattagagaagaaattttaaaaatagaaacaaaaaatacaaaaagtcaatgaaacaaaagctggggtgtttttaaaaaaaaatcaaaattgacgagttttaactagatgaagttagataagaaaaagaaaacaaagtcataaagaaggcattacaactggtaacccagaaatacgaagcattaagagattactaaaaacatcacaaacaaattgaaaaatctggaagtgaatacatttctagacacataacgaattcccaagatagaatgataaaaaataaaaataaaaaacctgaacagaccaataatgagtaatgcaattaaagcagtcataaaaagtctcctggcaaagaaaaacacaagaatcatggttttcctgctgaattaccaaacatttttaaaagagctaatatgtattttactcaaaatattccccataaaatgaagacgaagaaaggcttcgaaacttgttctatgaggacagcatgaccctggtacaaaaaccagaccagaacacaacacaaaaaggaaaccacaggcaaatatccctgatgaacagaggtgtaagaaatcctcagcaaaatacttgaaaattgcatttgacaacgcaataaaaagatcatctgccatgatcaagtggatttcattcatcccaggaatatgaggatgattcaataaacacaaataaataaatatgcaacatcacattcagcaaatcaagaacaaaaaccatataatcatttcagtagacgctgaaaaaattaaaagtcaacattccttcatgataaaaactcaacaacatgagtacagaaggaacatatctcagtgcaataaaggccatatatgacaaacccacagctaacataatcaataaggaaaagttaaaagctcttctcctctaagatctggaacaagtgtggctacttttacaccacttttgttcatcataatactggaagtcctagctagagcaattaggagaatgcaataaaaggcatccaaattggaaaaaaggagtcaaattgtctgtttccaggtgacatgaacatatatagagagaaccctaaagattccacaaaaaacctactagaaataataaattagtcaagttccaagatacagtatcaaaatataaaaatgaatactacacccatggaccaatagtgaaatatctaagaaagaaatcaagaaagctatttcattaccaaaaaaaaaaatgatatctaggaataaacttaaccaaaaaggcaagagatcccaaaatgaaaacttcataaaacatagatgaaagatactaaagcagacacaagtaaatggaaagatatcccatctctatgcactagaagaatgttaaaatatgtgtatcacccaatgtgatctacagaatcaatgcaatccatgttcaattacaagacattcttcactgaaatggaaaaagaatcttaaaattcacatggaagttcaaaatacctcagatagacaaaagaatgtggaataaaaagaaaagctggaggcatcacactacctgatttcaaaatatactacaaatttatagtaaggatggtactatcaaaacagcatggtactatcaataaaaggggcgggggagagacaagagagatgaacgaatgagacagacagacatagacaagtgaaacagaatagagaaatcataaataaattcacgcgtttacggtcaattcatttttaacaaaggccccaagaacacaccttcgggaaagacaatctcttcaataaactgtactaggaaaacccaacacccacatgtacaagaatacatccaggccattaccttaccatatacaaaaatctactcaaaataaagatttaaatacaggacctgaaactatgaaactaccagagaagaaaacataggataaatgcttcatgaaattggttaggacaaggaattttcaaatagacatcaaaagcacaagcaacaaaagcaaagatgtaattacattaaacttaaaaccttttccaaagcagaggaagcaatcagtataatgaagacagaacccgagaatggaagaaagtctttgcaaactatgcatcaggcaagaggttaatacacaaaatatctaaagaactcaaactactcaaaagtgaaaatacaaataatcttatttttaaaaatccacccaaaacttctatcccccaccatttccccaccttcttttcccgaccgcatttcgccctctccctctcaccaccctttctcttcctccatctaccccaaactttttcaccgttatctccccaccatcatttcgttttctccccgccccaccccgcgtcatttcgcaaagccttctctattctcccgctcaccacgcttttccccaaccatctacccaaacactttctcccgttttttcccaccgtattttcccccttctccctggccaccctcttttttccccctcctgctgtcatcatgcccttttcctccttcatctaagcaaaaacattttccccccgtcttttcccaaagccttttccccactcctgctgctcaccaccctcttttccccctttatctacccaaaaactgttttcctcattgtctttcctcctactcctccttgccactctttcccttctccatctacccaaaaacatttccccaccatcttttctcgaagccttctccccactcctgctcacctccctcttccccccatctaccccccaaaatttccccatcttttcacaaagtctgccccctcttcccactcgtcctcttctctcccctatcctgcttgccacccttttttttgccctgcatctatcccaaactattttcccgtctttttcccaaccttctttccctgctcccttctcgccaccctctttctcctccttgtcaccctctttccctcctccatctacccaaacactttttacctaccatcttttctccaccatctttcttttctgccactgttttttcgcaaaaccttgtcttcctcccgctagttaccctctttttccttctcccacttgctatcttcttctgctcctctatctacccaaaaacttctctccccactgtcttttcacaaaaccctctctccctactgctcgcccatttcccccacctcaccactctctcctctccccaattgccaccatcttttcccccttcatccacccataaacttcctatccaccgtctttctgcaaaaccttccctcactcccgctccacaacctgtctttccacctccatctacccaaaaccttttttccccaccatcttttccccatcatctttttgcaatgccttctcctcctcgctatccttttttccctttggcaataaccaaactctttacccacccctctatctatcccaaaactattttcctcttcctacccctccagccgcgctgcaatcgcaatctccactgccaccaccaaccatagcgaggcgagctgcgcctctgtgccgtgtctcaagcctccagcatacggccggtgactccttttcctggtcctctaagctgggcactgagcagctcaacagtaaaacaccgaaccctaaaaaaaaaaaaaaaaccgtaacggctcttcagcatcatttatatacggaggttatgcgcatgccggttcctagacttcatgttctgattgcatgagagcaagtcttaagataaccaatcacagcatgaaaataaagtccaatcagagtaggcctagaggtttttctctcatccaatcagaacatgtagtccaggatccgtaacttcagtatataaagcatgctgaggaagtggtgcgtcatttttgggtcttctgtgtcggtgtgtccagctgctaggtacctgggttagagaactagaagggtccattagttttcaccggctggagcctggagcctggagcctggagcctggggcgctgcctccctgttggtggtgttggtgacggagcggtaggagggaggctagcagcgggagcttctcctgccaggctggaagacgaggagaaggaagagacaccactgcatgctggaggctggagccagagcctgcgcctccgtggcttacctcgctgcagttggtggtgacatcagagaccacagctcggctacagtggtagcaatgtggttgcagtgagccaagattgcatcactgctctgcagcctggcgacagagcaagacaccatcttaaaaaaaaaaaaattgacccagtgttttgcatgtttcagaaaaacaaatgataccattatttaatatgctgcagtaactagaagcctacttataaagttggtggcaaataagtcattggtatatgttaacttcctataatcacttacatgttcctaagagtcactttgtgtatttatataagaaggtcagcatgtaaatgagtatagatagagaaactttttgttgaaaagtaagaaagcttgtctcccttttcctagttatgaaggaaccaccaccacaacaaaataaagcatatactttgtttataaccctgaatcatgatttatggccagattatcctagcatccaactgcctaccttggcatttatcagttgaaatgagtccagagaaaggaattattttttatatatctgctgctcttgaaggagaaaccttctttagaggtcacttgtaagaacaggtgcccaaatcccctatatccaaggcactctgggctgcctgggaactctacaaatcacagttttgaggggttcacttttctggttgaaatttatcatagtttatatgatgaaaggatgacaggtagatactctttaagagttgaggatgtgttatgttaccaaggattgtaaatatttaatgagaaaatgagttagagtttcaataatattgatgggacctattatcactcactttcatctaaagctcagtgttacttcaaagcataaaatcaagcaaacatcccatgattaatttagtttcttacactgctgtgctttgtgtttcattgaattcagagtatgcctgtgtacggtccctgggaacactgtatgaaaggatttttaaagtagtctgttctgatactggtttgtcaatgaaacttttcaaaaaggttagttgaatatcacttagtgttctttatgtgaccctcttgggtctccttcccagtgccaaattcccccatctcaacctcatttggacatcctatattaagaaaaaacaaagcaggtactcatcagcaggaacggaatcctactctcttgacagaattcccgtgatctataacctgctggataaatagttcaaatgctgtatctctgttcctattcctagactttctggcacctattacccttcaagtccatgtgtcttccagtaggttgcagtgctctccccaggagatggcagctacctagatttgtatgttacagaggtggtcgtgtgccttctctacctctctcctatgttcccatgtaacctaaccacacaggccataatcagctccaccctaggaaacataacattggtacacctgtcccttgaagttgtccttagagagaatggtctgaaaacaaagggagattaaaggtcttttctgtttcagggaaagtatagttctgtcagtagatttctggttaaaagacacagaagaaggaaaaaagacactcatctgtaggaactcagtttagccaatgtgacttccacttggaagcatttttcctctcctcttcaagcccaactctagggaatgtcctgtgcaaaaatatcagtgtaggcgcatctctttgcggaactgagttgctctgctttcagtttcctctctccagtgcccccaagctcctgcctggcttcttctgctgttcaacccaggatcccatgctctaggacagccttctcaccatctttcttcagctcttaattcaaaagtcccacttccagttcatgctcagagaaaaagcaagtagacctaatctttattagaatgtgaatttctagacaatagtactctctttggcttacttcactgccctacatgctgaactttcagataatataaggaagagaaaaaagtctagatgttggagagggagtcggtttcattttatacgattcagcctaatgggctttcattgctaacattaggggttacagttgaaccagccaactcaggaggaaattcagaacctggattcttatagtgatagtggaaaacaaattcatggttaagatttgaatgtgaattttaaaataaatcatagtatttaaaaaaaccatttttccttattaaatatgtaactttggaaaagttacttaaccagttcataatagtacctattttatagggctgctgtggggatttaatgagaacatttatggaaagcacatggcactgtaccacactcataataagtactcattaagtgttggccacaattctcaccagccttgttctctgtcctcaggagatgatgaccataattggaaaattgcccatgtggtactcaaagaggaacaggaatttcgctaacttttccagggcacaaaaggcgaccctcggaactcaactgggggaatttacctggatgacatcactcttgacagaaaccccctgccccacaggggtctggagagtccagaatttctcccaggtccttgagaacaccagcgaagtggacaagcttcagagccctcgattctacaattcagagggatgcggttttgggttaactttatacccccatggcagagaaagctctggctatttgagacttgctttttacatgtgcagtggggagaatgatgctatcctggagtggccggtagaaaacagacaggtgataattaccatcttcgaccaggacctgatgtcaggaacaggatgtcctcaagtttggtgttcactacctccaagttgcacatatctccaggtgggtggtgttggcataaataagaactgcccctcgaaccagagaggcccacagatgtgattctgtggtgcaagaaagagtaacgttctcctcacattttccgcctgggaataccgataacataggcgtgttggagtttcaagttaagattttcaatgccatcacatcctccttccctttcctaaattcactcatcaaacatctgttgagggcttaccatgtgccaaactctgtgctaggtacttacaatacaagtgaatcaggtgatccctgcctcattgatctcattgtgattgaggaaacagatactgctaatcatttatcaaatactcggaacttgctaggctctgtgcagagctaatgtacttactcctaaaatagcactcaatatcactatgttcatgaaataaacttacatcagtaaagaaatgggaaaactatattttttttttttgagatggagtctcgctctgtcacccaggctggaatgtaatggcgcaatcttggctcactgcaacctccacctcccaggttcaagcaattctcctatttcagactcccgagtagagaaggggtttcaccctgttgcccaggctggtcttgaactcctgagctcaggcaatcaacttgcctcagccttccaaagtgctaggattacagacatgaaccaccacacctggcactattttttttttttcaaaagagaagacctaagcctcagaagaaagaagccatagctgtccctctcttttcgttaaaaaagtcacgcagtagcagacaactgatcactcagagctgtgattctctgcctctcccatctttcaattctgaattgcaattctcctggaaagagtaaatagcttaatttttttccaacactttttttatttttatttttatttttatttatttatttttttctgattcacaaatccctgtatcctcataaaagacaaactggaaagtgaagtctaaagaggtaatgtgattttatgttacctacaattttgcagtgacaaatgacactgtcatctgggacaggccgtccagggtgggaacctatcatgctgactgtaattgttttagaagcattgactttggctggagtggtttcatctcccaccaaatgctgaaaaggaggagtttcctgaaaaatgatgacctcatcatgtttgtggactttgaaggtacttttcttggtcttcctgagtaaataatcctatgctcttggcactctactgattttatcctgattttaaagcacacatggagggtggggatgaggttaaaaaaaatgtgttgtaggagaaccacattttcttcaattggtcaaggactcacatctttattttaactgtccctgaaagaaactgaaattttagtgtcatctttttgaaaattttatcagaggtaacagttcactgatttcaatttagtttccatcagtctatccatgctaactttatgcttcattttgcaaattcaataaataaaaatgtgactggattactttaaaataaaactagctagtaccgtgggaatcagctggattcaaagccacttttccatgtcactgggggtgacatatcactagagatagaagcaggctggggaactttcaccagaaatgggagttcactgtagtcagttactaatcctggatctttctcgtgaccctctatttcctgaagatatcacccacctcagccagactgaagttcccactaaaggcaaaagactgagcccccaaggcctcattctccaaggccagaagcagcaggtctccaaagaaggttcaggaaaggccatgttagaggaagccgtacctgtcagcctcagccaggggcagcccggctgacagaagccgtcagtgaagaacacaggccccctggaggaccataactggccacagtacttcagaggcccatgtgacccaaacccttgccaaaatgatggcatctgtgtgaacctgaagtgggtggcgaggtgcaggtaggctctgtggctggggagacaggcaggccagcagacctgggccgtgtgcatgcttatgcctggtaaaggctgctgtttgcagagtagggcgaagactacctcagatggtcagctggatgcagttttccttgactctacaaaggtgtgccctggattcatgggcttacgctgccaggacagaggcgtcccaggtctccttgtctcttgactttcaccccttttcctcctctggggtattgtcaacagcatcttggatgttgttggaatttctaactctaacaacatccaagatggcttctagcctagggactttctactccatgacagtgggtctcaagaccaagcttaaatctttgctgactacacagatgttattattagctcctaatgattattagttatacagtctgtcatttacactgcactattattaaagttatgttttcaataatagtagtaagaacacctgatatttctgaccccttgttatgcatcatgtggtctcctgagcatcttacacgcatgatctaaattcattctcactgccacctgtgacataagggctctccttatccccatttggtgtatcaagaagttgaggcttagaaaggttaagtaatttatctaaaatgtacccagatggaaaatgctgaagctgggacttgcatctaggtctgtctggcagcacagtttgctatatttaatgtttaaatattaaaaagcagtacagtttgctatatttaaatttgaatatttaaaaagaactttaatagttctttttataatgtttgcttgcataaaaccctgaaaactgtttcacaaaaggaggtatgtgatgacagaagcaacagttccatttgaacagtagcagatgtaggagctattctgcctacctcaaaaatttacattacttctgagttctttttagtctccttttttttctttttgtagcttttgctttgaaataattttagacttacagataccttgcgaaaatactacagaggctttctctataccattcaccctgctttccgtaatgttggcatattacacaaaccgtagtacaattagcatagccaagaaatgaacattggtagaatgctagtaaataaattacaggccttattcggctcttcccagttctcccactaatgttctttttctatttcaggatccaattccggatctcacgttacatttagtttttatgtctcctgtctcctaatcccctccaatctgggacaattcctcagttctttcttgtctttcattaccttgacacttttgaagattactggttagggatttttttttggttcatcttgttctctcatgattaaattgaggtttcacatttgtgtcaagattagtaaatatgtgctgtgccttcttgttgcatcatgtgagcaggtacatgatgccgatacatgtaattactggtgatgtcaaccttcatcatctggccaacagcatgtccaccaggcctctccactgaagagttaccatttctccctctgtaattgatacatatcttgggagagatagttcaagaccattgagacatcctgcttttcctcaaatcctcacatgctaatttcagcatctattgatacaacctgctgcaatattcaccactgggatcttctaatgttgatttcctatgtccttcacattcattaattagaattcttctgtaaaggagaatggccccttcaccccgttaatttgtttatgcgattataaacataaacatttattttagtcagtgggctctgttgcaatgatttcataatttattttgttgcttctattgtcccagctttggcctttgggagctcttccaggttggctcctgtgatctttcaacatcagattttatgaacacaatgttactttctggcaccatagcatgctctaggctcatcttttatatttcctgccccacccatagaatcaatcactcttccaagaagccctctggctccttttactggggaaggcccatctgtttctgggctccaaagccatgggtcttcatatctttgcctgacaggtccttagatgccagattccattgtgtgcccccaacacgcttcatccttcccaggctaagggaggccagggttgccacttgtatgtcagcctctactcagccaaactattcctctcctagaaacctgcagctgagagttggcagaataagtttttctaagataacagtaggggatattacgaagttgtgtttggaggggactgggtcagaaaaaaaatgaaataaacttgctattactcactgatttctaagaagtcaattctcaggatagagatgaggacttggaagttaaaatcattcaggattagtaaaagaaaatgctgacttctttttttttttttttttgagacacagttttgctcttgtcacccaggctggagtgcaatggcacaatttcagctcactgcaacttcgacctcccgggttcaagcaattctcctgcctcagcctcccgagtagctgggattacaggtgcccaccaccatgtctggctatttttgttgttgttgttgttatttttaatagagatgagaccatgttggccagtctggtattgccattttggccaggctggtctcaaactcctgacctcaggtgatccacctggcctcccaaagtgctgggattacaggcgtgtgccaccatgcccagccagaaaatgctgacttctgattgtttcactctgccttgtagaattctgctgagtagaccttctagtgggaatgtttgaaacaaaggctggaatttttacaaaggtatggatgagacactacaagttatatgccttggttatgagattaattcatctttataccagataacattaagaaacaaaactaagggctggccattatgtgcttactctgtgtcaaataccttgataggtacagtgtcctcattatctcaggtgaacttcagggcaaccttgtgagatagtgacagtacacactaaccttacagtaacattttatttaatattatttagacgttttcaagctaccactgatgctctaagtcagactgtatctggggaatttcctttgtagcttgtattcttagccagtgtcaggcaatgtattcctttaagtgtctcagaccgtcctcctgaatcctaggtggctgagaagcctggatctggaggcataccttttgggattagatttcaagtgtgaaatgcttactaacaatgggaccttgagcaaattatttaaccttcctgtaagatgaagatgatgagaatggccaagtaatagcctccacctcaaaagttgttgcagggttaaattagttggtccatatacagcacttgaaatgggaccaggcaccacgtggacccgctcagtgagcgtttgccatttttattgctgtggagatgagtgttgctaggaggcacctgaggcctgggatttcccacactctcttcatgtccttttccctcagatgcatctctggacatgctttcttctaaatgggagcgctgtcaggccatgcaggtgcacggcagcgtcctgggcatggtgatcggaggcacggctggtgtgatcttcttgagcttctccatcatcgccatcctttcccaaaggccaaggaagtgacctgcctgctggcattggccagaccacagcagcacctcctccatgcaggccttaccttccaatggtcagtgcagtttggggcagcttttttatcagccttgctttggataggacctccaaggtctaaggcctccagccccatgtgtgacccttgtcatctttctgccccacataattctgttactctgctatgtgctcctaatgtatctagtgtgtcctgtgacaacattcatcatacttcattgtaaaccacttgtttgattgactgtctttcctatagactgtaagccccatgagggcaggcacatgttgttattgaccatgctggccacgtgcctagatgcatggctggcacattgtgggcactcaacaatggttgaatgaataaaacaataaatgaatgaataagatatagaaactctcatttatattgcagatcaaatatatatgatgaaattcttaggttgaatatgttagaatcaaatactcatttttcattagacacagtagtgtcattactcttttaagatcttgttaaagatttcaaataaaggtacttctaggcagcccggcttcacagcatttgctttcctctgagattctaagagaagccctttaataaatttaataaatattgagttagcaccttctttgtatctggtattgtatgtacatgtgggtgtgcatgtgtgtgttgaaggttgggggtgttcaaaagctctttcccagatcttttaagtttaacagtatattttatagctatttatgtacaacattatcatattaacaaacagaaggtatcagagaactttaaagaagtatttttagatatgctttctttccatagttcctaaggagataaaaatctagctggggcaaggaagttccaagatagatcaagtggaaaaaaaaaaaaaagaaaaaaaaaagctaaagtttctatacccaatcagcaatgagtcagctcaggaaatttaataaacaaaaatattttagggattctgagtggtcctttaagttataaggtttcctaagtagagactttatgacaattttgtagagttaaaatgcactggaaacaaaatgagagattaacaagagtttctttaatgcaaaggtatgagaacaatttgtagcaagtgaaaacagcacccctgagggcaatacctctcaaacttgaggtgcatctgtatcccagggaggactgattaaaacagattacagggccccacactttacaaacctccactttcagtagagcctccaggtccctcccaagagcttccgtaagtcaccacaacccaagaggaccagggagattccctcatgcagatgttcccagaccatgcatgtgatggcatgtggagggcttcccactttgacatcttcctgtcctctgtagaaactgggtcagtagatctagggtgagatctaagaatgtgcattcttaaatgtgccaggatctaacaaggtataagaatgtgccagaatctaataagttctcaggccatgctgctactgctactgactcccccacaacccccacctcacagacaccttgagaaccactgctctagtggatagaaaacaagtctggaagccaagcatcctggctgcaggcttggattgcccatccagctggctgggtaattttagtaagaaatcatttaagctcttgatcttagtttactaacttgtcaaatggaaataatagctgactatctccttccacatgactttactacttacagagtagcagagtaatacaatgggataatgaatatgaacctatctcagagtttaatatgtatgaaaatattactattcaatgttcagactagataggaagctatcctgtcaccagcccagttgtattgtctccaaagtccagattggaaatggattccagctttgtttcttgctgtgcttcacagtcctgcaaaccctccactaacctcatagttaggcctaaagaaagctatgcccttaacactctgctgagtatctgacctcagaagtgaactctaggctttgttgctgctgctgctgttattgtcctttggttttattaaaaggaacatgctgtggtctgtctcacatggaaaggcccctagcccaaaccaatgacaacatttcttaaatacatgagtttctctctggaagaagcagaagctcaaatttcaaagataacctagtattttcatctagtactgcaaattaaaactgctaggtcaaaataatgataaggaggtaccagaatgagggtaaagcattttgatatttatttctctctagattctcaaccagtaccatgcctactatctatctttatcacttttggtgattagtggtcacctcagttgattaatgatctggctcaccataaatctgacatggtattcagcttttctttgagcccaaaccctcaatcattccaggaggactagcagatactttattcttttgaggtgttgggatggtgatggcaaagtgggcatgtaggatggggagtgggtagaaattaagcatttcataatctctaggcagtatggaatttgggatttagatgagcaacatgaaaaatgtgggaaatcctccctgaatctgagtgtctgacttctttaatcttacatagtgggaataagtcatagtggcttgaaattttgaaaatgtctcatgcttcccacaccatatccttgatacatccccatctgtatcctttccttctgtgaactgagctgagccaatctggccattcacaaatgtcaggttctttcagtaatatctggagcctctgataattagaagtggatgggaactctaaccccctctctgattatgttaaaatgaatcaagatttgaactaaattctgctacacattcatatttgttaaccattgttgtgggaagtcagggactccaaacggagggaccagctggagctgcggcagaagaacatcaattgtgaagatttcatggccatgtatcagttcccaaaattactacttttataatttcttacacctgtctttactgcagtctctgaacataaattgtgaagatttcatggacatttatcacttccctaataatagttttataatttcttatgtctgtctttactctcttaatcccgttatcttcataagctgagaatgtatgtcacctcaggaccactattgtacaaatagattgtaaaacatgtgtgtttgaacaatgtgaaatcagtgcaccttgaaaaagaacagaataacagcgattttcagggaacaagggaagataaccataaggtctgactgcctgcagggtcaggcagaatagaactgtatttttcttcttgcagagagcgtataaacagatgtgcaagtaggagagatattgctgaattcttttcccagcaaggaataccttggggaaggaatgcattcctggggggaggtctataaatggccgctctggaagtgtctgtcttatgtggttgagatgaggactgaaatattccctggtctcctgcagtaccctcaggcttactaggattgggaaattccagcctggtaaattttggtcagactggttctctgctctcgaaccctgttttctgttaagatgtttattaagacaatatgtgcacagtgggacatagaccctcatcagtaattctaattttgcctttgccttgtgatctttattgccctttgaagcatgtgatctttgtgaccttctccttgttcgtacaccccctctgcttttaaaatcctaataaaaacttgccggttttgtggctcaggggacataacggacctaccaatatgtgatgttacccccagaggcccagctgtaaaattcctcctttgtgctctttctctttatttctcagaccagccaacacttagggaaaatagaaagaacttacattgaaatattggagtctggttcccccgataaaccaacaaacccacaaatagccatccaacctgttttgtatgtgtagggaagtctctgctctgtccttttaagtgctccgccaccaagcctcttggattaaaggttcattctacacacatgcagtcaaataatctgaaggccaggatcagtcgactctctaccctagggtttctgaacctcagccctggtgatattttgagctggatattcttttctgtgagggctgttctctgcattgtgatatgtttagtggcatccctggcctctacttactttatgctcatagcacacttccccagtagtgacaaccccaaatctctaagacattgacaaatgtcccctgaggggcaaaatcattactgattgggaatcactgctctagttggatgagccaatgaaaacttgtattaagtgagtgaaaactaggaccaaatagagttctagtctaaggttctaccccaaaagttagttcactgggcctgccaaagtattgtaactatagctatcttgacaattgtatttaaccaatgcaaaaattattttaagcatcctttatactaataacaaaccctctggtatagcttgctatagaaatatttaaagttttgcaacagatatttctccagtagagacttttgattaggatctttcaaatactaactaactgctattggagtgtgtattccttttcagaatactttgcatactatttaacctcccccagggtgtggattatagtccccctgcaggctgtatacagtgtaatacctatatggaggcatttacaagcaaattacagatgatctcacaccttcccttcttgagctcctcctttctcatgaattatatcatctgttttatggcttgatgaaatttttagagattctgaagtccacctcttgtatttgggtaaactgaggcaattctggagaggctaagtgccttaggcaggtcacagaaccacttaatagcagaatctattattcttgtttgactacagaaaaccttaataagattagaggtttggaaggtgctataaaatataggcaaatctatattgaacactatgtaaaggtctttttacttggtttcccttattagggatattaggtttatggatgatttgtcacctactcaaatttctatatgtttataaatatggctaaaacatctttcttatgccaattttaatataaatatgtttttcaaaagtctctaagcaaagaaaagtttgaaaagatttatagttatcctgtagctgtgagtgtcatttagcagactcttgaaaaccctaatgaatgggggatgggagataatggagtcaggtgccagtgacctctaatgagtactgatgtgaaaaaatatgataggaaagatttgatatgggtaaggcagcctaacagggtgtgtgtgtgtgtgtgtgtgtgtgtgtgtgtgtataagagttgcagctaacagtgatatcagagtaaagacaagacccatctctctttgccttccacaattttaccaaggactagtcctggaatcccagaatggattgagacatgggcctcatctgggtcacagcatcccttagggcctggacaaatttaggacaaattgacccatgtgtggctcaccagttcaatgaaaatcattaaaaacatttaaagatcctatctggtcaagagaataaaaggagaatagaaaaatggggtcataagaaaggtatgagaagaaagcaggaggcagaggagatgttcagatatcagcccccaacaaaaatggtcaccaacatccattcttcttttcccagtaatagaatccccaaactccaactggtcaaatggctactcagagtctagtttaccttctcctgcttcctttgcaggtagatgggtgatatggtttgtctctgtgtccccacccaaatctcatcttgaattgtaatccccatgtgtggagggagggaactggtgagaggttattggatcatgggggtggcttcccccatgctgttcttgtgatagtaagtgagttctcatggagctgatggttttaaagtgtggcacacctccttgttctctcacttttcaagtcttgctaccatgtaagatgtgccttgcttcccctttgctttccactatgattgtaagtttcctaagccttccccagccttgcagaattgctagtcaattaaatctctttcctttataaattacccagtctcaggtagttctttatagcagcgtgaaagcagactgatacagtgaggtagtgtgatcaaattcaggccagtggaatggaagaaggaatgttgcatgtgagcttctgggaaactttcctaaaggagtcttggtgcacacctgtagtcccttcttctatcctaatgactgataaggggatgtaatggccagagtgagagctgccaaatggggccatgtggtgaccttgggaaaagcagattaaaaaaatagaaagtatctggatttctgaggactgcaccgagccaggctgccacaccagtcttgggctgcttatctgtgttagagaaataaacttctactttaagtcgctattattttgaatgtctggcattcacagaaaacatgatcctaatggatataattatttctatggggccagcacatggctcagactaagccaatcatgataccctgtactgccacatatacatgaacatttggagaagaaaagggttagtcttctttttaaatctcaatctattggtctgtggacctcataaattcctctccttgaagatctaccttggaatgaaatgaatacacaaagagaggcaacaacacaaaaggaagagccagaactctgagaacactgtttgggcacctgaatctagctgtacctgaaggtgtaccaatctactatctttcccagttacatggtaagtgcccacttttgttaaactaatttgattgtggttctgttacctgtgactgagaaagccttaattaacaccactgttatagtgcataattggctcatttgtaaagaaaagaaataatgaaattagtttgaagattaaataaaattatgtaatatgtaagattaccaaaactgatttgaaatgcagacatggggaagttaaccaggctcacacacttgttatgtgaattactcacccattctggcttcataatgagcacgatttaaactcaaaccttgataaagttatgatttaggatgtcacatacctttgacattactctcaaaagctcttaagcatgaattaaatgtgacaatgtgaaaggcatatgtagtttgattctgaatagaaccggcgtctaaatctgagttctgtcaagatctatcaagaattctgagtgttggatattatttagacacgtaggaagaaagtatgacttctcaggaatgaagtgtgattctgaggctgtgtttaaatatatcaggaggagaattgaaacatttgccctaataaatttggctaagtcgtgatgcatgatttatatatgtgtgtatgatacatatctactatagtttttatgcacacacagtaagatgcaaaataatgaaggctaactttattcagcaataattgcatgccagatatgattttgtaggctttataagaattttataacaacccatagagcatgtaccattattatttcctttcacatagtgtaaattgaggcagaaagagttattttaccaaaaatcaaactaagaagtggtggacctacaactgaaaagcacacagtttggctcgagaaccaatgctgttaaccaccataccacatttgccaaactggctgtcaatcaatgctgaagaacagcccaatacccctgtccatgcaaaatgaagcagagaatgcaaagcattcaagtagcaaatcagctgctgtttcagtctgcatatcagaaggaaaatcatgacttagctaaacgtattaggacaaatgtcccaattctccacttgatatgtttaaacatagcctcagaatcacgcttcatttctgggaagccatattgccttcctacatgtctaaatgccattcaacacgccaagaattcttgatagatctgagatgaaaataaaaacaacgctggtgattgagaacttacaagaagctcacttgactgaagactcaagctggggggtccaccagataactaagttgagatctactttcaataaagcagcacagcaggaattctttgatgtttcaccagagacttaaaaaggaagtaggcgcactctgaagtttgcccagaacattggtcattatgtcctgggctgccccaaggtggaattataaagtgagatgaagcttggagaagccttaactcctccaacctctctgtcactgtcgttctccctatcattttttgcatttgaaactcttcctgctacggaagcctacttttaagcaagtaactggcatcaggttgcatagagaagcaatataaggtggtggattcatgcccatgttctaggtcagacactgcatttagatcctgattctactggtcctcagctgtgtgactgtgggtaagttatttacctctctgtgcttagctttttcctccaaaaatgcaaagaaaaagaatatttagttacttttggtttgctatagagtttaaatgagattatacgcataaaaatcttagaacagcagcaggtacacagaaagggctcaaaaaatgttggttaatatatttatatagttaccagccatttccattcgagggtaaatttaagttactgtgtttctcacccagaggtgtatttgcataccttttctctccttgagattaacctgagattaatcttcttaactttatctgtctttgagatttctgtttttgtaaaaggaatgtccaacatgaaggagaaggtgtgagagctattccaagggtataggagcaacaggccaaggtgcgtgacatccccccaaactgggaagctgtctgcctcattacttaaggccagttcagcttgtccctctacaccaaggaccagccctgccggcagttggccctgttgacttctcctgggtcttctcggatcacacgttagcaatgtgtgctcagaggataggaacttgccatccagcctcagctgctggctggactgtcagattgccctgggatagctgcagattcatctgcagattcatgatggattgaaaatgaaaatccaggccagcagtggctttcaatggatgaattagaaaagggaataagaccacctatgttaatccttttgcagctgccttgatggaaaaagtattgggttcccatgaaacatggaaggcacccatttttcttcctcaaacgaccttccagcagcctatctggaatgggtgaaccagatcttttctggggctttcagctttgctgttagtgccataaatgagattcagtcagtaagggggggacagagaaaggaaggagctatctcagcgagtatgcctcagaaatgtatgcctgcctgcaggtgtgctatgcacacttgtaaaccagtctctgagacaggtctcaatcaacttagaagtttattttaccaaggttaagaacatgcctggaagaatggaacacacaatcacagagacagcctgtggtctgtgtctttctgcaaagatattttgaaggtttcagtatttaaaggggaaaagtggaggcgaaagagggagagtatggtcacatggcataatccatgcattgcaggagaaaaggagcaggtaggaaaatagtcagtgatgtattcatctcagtaaatcagtactttacataaaaggtgtacctagtgtagctctctgtggagatatctggcctttcatttgttagctactttcttagcaatagaaggaaaaggctgtttcttgcatggctcagcttccatcttaattttttcctttttgcatagtgattgggggcccgaaatttcctttgcctttcacgcactgaaacgacgtgactgggatttccctccctccacagtcctacgtggctttctgactaccctttcccctgtaaggatcataatatgaaagttaggaggcgggagtgaaagagattttttttcatttctggtttctgttatccactatgccttgaccttcgctctgcccatatgatcaaatgacttcctgaacgtagcccactgggcgcgtcatccgcgggactgactctgcctcccacgggcttcctgaggccggaccgccgcggggacgcctcctctcacgcccaccaggggcgcgcgagcctcaggagacgccagcagtggttgcggagctgcggtgctggaagccagctgtcactccaacccagctggagattcctgtcgggaatgcttgggataggatagctgtgagggagcccctggggcatgggaaaaccctcacagttccagaaaaaacagaaaacgcatgcaccgtttttctcggttaatcaaagtcaaattccttttcccgcaactgctggggtgccggctggctggcaggatggaagaaccaggatggcaccaatcaaaatccgaaaaaggcagggtccaaagtcattcctgggttttgttgtttaatgtcatcggaagtgggccgtgacagcaatctgcccaccacttgcccaatcaggtgctcttgactttcatactgagaataaagccatttttccccccgggctcctgggtttgttctgtttaggcttcaatagtcaccggcatccttcacatggctctgcatgacagaataaaaaccctggggtgggaacaggctcatgtatctcctaaccatgccaccatgtgtgcagagggacctgtcatggacactggtggcctttcaacttcatttcaaagtttacaggtaaaagggggaaaatgggtgtgtataaaattatttaagaataatctcagcactttgagaggccgaggcgggtggatcatgaggtcaggagatcgagaccatcctggctaacacggtgaaaccccgtctctactaaaaatacaaaaaacaacaacaaaaaaaaattagccgggcgtggtagcgggcgcctgtagtcccagctactccggaggctgaggcaggagaatggcgtgaacccgggaggcggagcttgcagtgagctgagatggcgccactgcactccagcctgggggacagagtgagactccgtctcaaaaaaaaaaaaaaagaataggatggttgtgtctgaatcataggacaccatgaccaaggcccccacgcccaccccggacacatacagatggtatttggagatcagaacttgtgtctggcatagagcggacttcgggagttggcccatctcccctcttttcttcttctgtccactaaaagtgggaaacttggtttccgtctagaatgtgctagaggataaatagagccctcacatcctttatattcatctataggacatgagggctctattttcagctgtcaatgaaaatttcaagccatcctcacacaaatgttggaacaggcttctgtttgttcgtcagacaattggttctgaaaactttacttcaaggacccttgtttaaaccttctataacgtgctggatctttgcacacggcttgggaatgcggatggtgtgagggaagccatcagccctgccagccagttgagctcaggggcgagctgccggcctcccccatacctggaagatggaaaggatcgttcgctgtttggagaatagagctgcattctgggtgacatgcggaagcctgagaggcagcagcaccgcattgcaagaaggcaaacaattactacagagacagtgttgctggaagtcagggaccccaaacggagggaccggctgaagccatggcagaagaacgtggattgtgaagattttatggacatttattagttccccaaattaatacttttgtaatttcttatgcctgtctttactgcaatctctaaacataaattgtaaagatttcatggacacttatcacttccccaatcaatacccttgtaatttcctattcctgtctttaatctcttaatcctgtcagttgaggaggatgtatatcgttccaggaccttgtaataattgcgttaactacacaaattgtacagcatgtgtgtctgagcaatacgaaacgtgggcaccctgaaaaaagaagaggataacagcaattgttcagggaataagagagataaccttaaactctgaccgccggtgagccgggcagaacagagccatatttctcttctttcaaaagcaaatgggagaaatatcgatgaattctttttcccagcatggaacgtccctgagaaagagaatgcacacctaggggtaggtctctgaactggcccccccggggcgtacctgtctcttatggtcgagattgcacaggtgaaataaactccagtctcccatagcactcccaggcttattaggaagaggaaattcctgcctaataaattttggtcagacaggttgatctcaaaaccctgcctcctgataagatgttatcaatgacaatggtgctaacttcattagcaattttaatttcgcctccatcctgtggtcctgtgatctcgccctgcctccacttgccttgtgatattctattaccctgttaagtacttgatgtctgtcacccacacatattcgcacacaccctccccttttgaaaatccctaataaaaacttgctggtttttgtggcttgtggggcatcacagatcctaccaatgtgtgatgtctcccccggacttccacctttaaaatttctctcctttgcactctgtccttttatttctcaagccagtcgacgcttaggaaaatagaaaagaacctacgtgattatcggggcaggtcccccgataagacaggtcacgagatctcattagatatttcattgttatagtatggaaaggaagcatatttgtgtgctggcatacatgatgtgattttaaatcccaagtgataattttagaaaccaacagaacctaatattaaagctaaactactgtcctcttgaaatgatgagacgctattccggttgcccttttaaaaacacaatcaagaggtaagttccctgtaagttccaccttcattttggacacttgaagaatcagtcttttactggcctgggtcactcactgggttttctcttttggatgaggagggcttatttgacttcaccatcacatggcacaaaataaacgcattccacctacctggcatttctaggaccacctatttctttttttcttcatgagtgtgacttcctgctccattcacctcaataactcgcccacacctccttcctatacttagtaattactgtaatctttctcatctccatgtaacttttttttttttttcctgaagcattccaacatggatctctttgaaattctctatacaaaccacaaaaggccgtgacttcccacagtctttcttaatttctggccttagcgaaaacctgaaaatcccacagacgtttatttaaccatttccccatgtaaacaataagaagtgggggaggaggatagcagacatctggcttactcaagagatgatgtgttagtctggacttagaatattcccagagaatattcctataatctgtattagcttctcatttgtgaatgttctaacctcacagactctgactcattaggacaaagccctttgcaagaaactgacttaatggaaagctcttaatgcaagaaagtttaggctcagggaatggactttatacactgagagatgtcaggaacacagggaagcactgggcaccttacgaacaaagtagatcacacaactccatgtgccttcattctcaggaatctgctactaatagccttgtaatcattactgattgagagatggcaacctcagggccaaatgaggctcctgcattcataaaattctcagcttcataactgctgttctacaattttgaattctactgttcattttaggattttcctgggaaagcgtagtggctgggctaatgtgtattgcagtgggcagaaaaccagcaagtgtttctccaattatttgctttcatagcttttctggaatttggacccagtgctgtggcttgaaagggtgaaacgcatgcatgcatgtatgtgcacatgtgcacaagtgtgcatgtgtgtatttgtgtgtgttggggataagggaacatgccccagttaacaaatggagcagtgggccagatccacatcctgtgtaactcccacaggctcctgctatgatgaaagttcccttcacagggttgaacacagtgattccccaagggatcctggctgaagtgggtggaagttcagcgtttcttgccccactggatttttgaacatgacaaccacatcctgctcctgacactgtgtgctttccttgattgatcatgtcaagatagccctgctaacatcgtgctccaagcctggctcgattcttcttgatataactccaggaaccaaatcagtcaaaggccttctttctctaattctaattctaattcaagggatttcccccaacccaacctctgtctccatcttcttagtatcaagctctgcccaaagttgatcattcctgaagaacaaggcatgcacttatagcataacaatgatttcctttagggactttcagtaatgcaccattcatttgggacagtgatgtgacaattctcaggcaaatgtggaagtagatgtctatgtaatttgtgaatatgtagaaataaagagttcatttacatcaactgtcccacctctgtcccatacctctccttccccatgaagaaaagagaggcagaagtagaatttaagtagaatttaaaattaaaaataaaaagaagatattttaaagggttaaaatattaaaagaaaactcctttgaacctcaataaagaaatggctgttgaatctcagcctcttttgccccatcttcctaatggctgggcccatttctgttgccacacagcccacatatcctaagtagccccacatctctatttttgtctcattctccttttgggatcggacttttatttgcaatgtagggttgctgtatcaatagcacatggttaactctaatatggatgcaattttcataagtatttatattttttaatgaaatacatacacacaaaaagaaagtacacatgcagataattcacaaacaatcaaatccttgggaaagtctctgccatttgttcaacaaggtcaagtgtcattagcagcatagaacagccaaatgtaaaatttctttccaggagttttccaagtggttggaataaacacaagttagaccatgcaaaatgcttaatgtatattggtgtgggaaagtaaagatggaaacagagaatacctagggagctatgcaacacaccaagggccattatccacagtaacaataacagtgacaacagcaataataatgtacaatgcaataagattattaaaatatattctataatgcacagagaagtacctgcttgaagccattaaatatatgacagggtctgtcttcagcgcaatatatcaaatttggcaattgaaaggtatataaaatatatattttttgctttcaaaatatggaacgaactaaaatacaaggcttttctgataaacgataaaaattcaatcagcacttggatctaatgacgtatctttataatacttcctctgtagatacagtcacttagttcaaaccttaacatacaaagttatcctcaggagaatcatatttccttccattcatttcttataaatattattatccacttgaagtcgttctgatgaaggaatttcctccctattttttcagccttttttttctcctcttagctaagaagacatcaggaagacactgcccaaagtattcattccccatgacttactttcagtttccatttttgagccattaaaaaaaattctcaatgttgcactatctgagtgattatattagatcattaacatggaaatcttaaaacgtggcccttaatgttgtttgtctacatttgttcctattttcatctttctctttttcttctttttccctttcttcctgtttccctcccttctttccttcctttcttccttccttcctagaattcactgaagtatttcctaggttgtcttttacttactattttaatcaaagcttatctttgtgcccaatgtgtagaaagtgaaaatgtctctttgaaattctatattacagtatagacagagaagttgggccttcgggggcttgagtttcacttaaatactatatacatgtggtatcacacaagggggagggggagggggagggaacaaacataaacataacaattattttcagtctgtctttacaaaagaaagcctcttctctatgaaagtctttttggcatctgctcctggaaacctgccccaagaacacgttctccattgctttgcaaggatctctttttaaaagtacatccatccactgtccccaggaggtcacgtatgttggattatcccgttcttagttgagcaacgaataagcactggatgagttttccagggatgagctggttgcttctggggtggaaacattatatgttcctgaaaaaaagagcagcaactcagccttgaagacaagccatcatgaactttggggtgtgaatatctcctaagggacccaggggagcagtggtctaggcactaggtaaactcagccatgcctggaaaccaacccatacctgccctcctcccaagacctagaaatgccagagaactaacagagttgtcattctcatgcatgtgtggcagccaacaagcagtcacttcttcacatcataccagcagccaggtttctacaaaggacaggaagatgtcaaggtgggaagccctccatatgccatcacatgcatggtctgggaacatctgcatgagggaatctccctggtcctcttgggttgtggtgacttacggaagctcttgggaggcacctggaggctctactgaaagtggaggtttgtaaagagagtaaagggaaagaaaagagaaaattatagggagagaaaaggcaggaccagaaaagaagcaggagtcaggaacgtcaacagaactgctgagaatcagtgcagcaaggaaggcagcctctgagcaactgcacaggcttgtgtctgcgtggaggtggggactgtgcacagggagtgggtggagagtgtgtgtcgggcaagaaaagggttgaagtgcccaccctaccatcaaattgctgaaccgccaccgctaacaaagtttctgtcatggcctggggtgatcttaggggctgctgacaacataaaccaaattatggtacttatggggcccccaaacatgcccaattgggactttcataatcagaagtgaaggtcccccagtttcatgggtaattcatcaaattgaagcagaaaagaacccaagtcctctggagttttaacagttataggcattcacaaaatttgcttgtatgtgaaaagccttaatctggaacattgatgcatttctcaactctgcatttgtgagatctgttgagtttcaaaaagctagaagaaatcctggggcttattttcctgtgggggagggatggtggcatgggacaggggtttcaatttgctagaatagctgagatctgttgcccaaagttattaattccattcatttcatatctccaaggtagaaatttaactgtgaatatttctaatagaatagctaactagggggatcccttatgtaatgcaagcacacttctatgtgcttccatgtgtaacacaagcacactttataaaaaaacacaaaaggaaaacaaacctacatagtgagatcctgtagtaagattttctaaatgtattctttgctgccccttaaccctgaaacatgacctatctactcttatttgacataatttgagaagaactctgtgtttgacaaggccagcaatttacagttctcattttgatggatgatattttgacagacagctctccaaatcattgtctagattctccaaatcttattctttatgagttattataagttcccaacaaaggcagctgccctctgtacccactttttggtgatttgtgaaaatgtaagttcctctatttaacctctaccccaaaagaggacattttaggtaaatgccatgagtggggtgaaagagtaggggtgttgaggctccccatttgaccaaatgtgttctgggcaagcagggagaacatagaggccactactcacctgttttaccaaacaaactgttaaatctccttgatattggagaactcatagaaaacacaggtgtggatgaacccagggatgttgactagaagagagaaaaaaagggaaaatcacaaagcaaatttgtgggaccaaagctgtttacatcactaggaggattgattttccaccctctagtggtcactgccggcatctctagtcccactcccagaggtcacattaaaatactggaatcttgtcatctgtattagaaaaataactgtcaaatacaagttttattgtttgttaggcttctagtattttctgacatgtgaaaggcagtcagatatatccaagggcaatagttatgttccaaaatgagctatagaaaattttatccattattattcttcaacttgttttctctaatgccttgaatccccccagaagactgcttctcattgaacatttgatttcaaccttcagtttatatcatatattattttaaaccctatttaagtatgtggagtagcatctcaatgacagctctatggctctgtttaataggcagaatgacttgagaagcaaaaacaattgaatgatctatgccaaatatagctgttgagggagatgggtttgaggatgcaatatatttagcctaattgatcaaaatcctgaagaaaaaatttagtactctgtacttcagaatgctagtggaatacatgaggttataaaatgaaaagtctctgcagagaaaaggtttacctttgagtgctgtgaagaccatctcgacaatgaaaacttattcagcaaagcttcctgtacctgcattgttaaaaagaagctatcgtaacttcaacatgccagaagcacttcacgcttttctagaaacatgaaactgtcattgctcttaccttcagatcctagaggcatccaaagagtaaactgaataatccctgagaaaaaaagattaaaaagaagtgcattttaattatagtctattgtccagcaaaagagaaagtactattaacctggtgttaaatttgtactacttctttttctatctgagtttatggaatgagtccagtccatgatactgttcaatgagatgcagttggtccacaccaagggactctaaatgttatgaagttaggaggatattttctattttcccattttcctttggttgagaactggaggtcctgttggttatgctatttatacacctcttgtgtctacaatatgcctcacatagttgtgatgagaatcttggttatggggtgggataactagttccttccaaataaggcatatcatgaaggtcattacatatgaactttatagcttggagacacaggcccagtagtagaaattaaggttcatatgttcttggcacaagcatcctgaaagcagtatctcaagtgcacctccagcgtctgcctcttcacaagctcacagtggcctcaatccttgggcaggttttttcctatattaccacctctccactgggtgaaacagaattaatcacttccttccttgtggtttaaaggcttgctatctatacctctgttatatttcttctaacaaactggtctgcattgtaattagttacgtgctgcaggagagcaaagaagatgttttttcattgtagtacaatcaagcagattgtctggcattcacaggacattcgttctttgatttttgatgtttccagagaagctgctatgtggtacacaggatttatttcattcaaatgattattgagaacctactctgtaccaaggtctctatcaggcatagaggtatagtgatgaacaagaaaagggcaatccctgtcctcacaaagacaggattttcatttaggagataatagactgcatcaagataatcttagacaaatggggattttccttttactggtgtaatcagggtatttagcagagactgggaaatgacactaaattataatgtaggtgataaaaagcatgaggttccataggatcagaagaatgtgttctttccatctcattgaattctcattattactaatctttagagctgaggcttcctctgggctgaaatccttccccattcctactcttgtttgtgtttctatcattaatttgtcctacaggaataaaatcttcctgaaagtcccgcactgtaaaactcacctggaagacattgaggatggcaaatacgatatggaacacaaggttggtccctgggaacacagtggtgagatcaaaatcccaagtgaggcccccagagtggcgtgaggaccccagtgctcttgctgatctgaaacaggctgctcttctcctgcttgcatggcttgtctccaatggaaggcctcaggatcttggtgatgaccacaatagtgatggttatgttcaccaccacaatgatcattgctgggatggcaaaagccagcagggccttggtgtcctcccagttgagccaacagacattcttcctcatatagacttcccagggctgggtggctcccagcacgatgacagagatggccggtagggcagccgtagccaagacagaaggcaatagctttctgagtggacctgcttgtttcgtgcagaatgaaaagcaggcgatagaacaacatgaggcccagtgtcagcatccagaagaagatgctgaggtagaagaagtggatgaagaaggtggcagccacacaggctgtcttgcagagtacgtagtgattgtcctggatggcagcaaccacaatgaaccaggtgttggcgaccagaagggaggcagcaatattcactatgcaggtgtggtgcatataggaagtctggttcttggtcactgatttccacaccacagtttccacaactagacaggccgccaagctgaagatggaaaagcccaccccaacgtaagaaataatatccagtagtattcccaggagagaaccaggatttggggagtcaggggacatgagaatggagaatgatgttaggtggtcacagatacaggtgacattgtccccatcaccttcttcaacatagcacccactgctgtcccacccccccgtgttgttggaaagcctgaagttccagaagacacatgttgtttcgccgcctgaagggctgttgttcttaaaagtcattgaaatcttgaatggcatagtcacattgtggctgacagtggtcgtcatcactaagctctctgcaaaattattttcctggataccctgggcaaggatggcttggagagttgggaaagccatggtgacaataggtgaatctgatggcaagttttctagatagctcttgtcaatgaccacattgccccagaggtcaaagtatgggaaaacaaacctctgttgataggtttttgggtggctggacatgattaccatgctgctcatctgcacattagtttgggagaaggacaaaggagggctatttcctaattgtagtgcttgggaaaatctttccactgaatgtagtagctgtgaactctgattggtccattgctgttgtaaaaccttccaggtgttcaagacgggcttcccaaggatgacattaaccgtagagagcacgtgctgaaagtgaaatggtatggggtcaaactaaccgaattctttcaatcataaaaaagaaaaaaacaacatcttcctagaaactgattgcataaaggtaagaggaaacgagaaaacaaaactgagacatcacaggcagtggggatgtatgaccttcttatggcagagtttagcagaggatgggtccccaagactgaaagatgtcagtaagcacttagcaatggtgacagtgagagtcacacccactacacaccctactctctaaggtcaattcagcaggctggcagggatgtttactattttattttattttattttaaatcttaagcctgtatttttagtagagatggggtttcatcatgttagtcaggcaggtcttgaactcctgacctcaggtgatccatctgtctcagcctcccaaagtgcctgcaatcccagctacttgggaggctgaagcaggagaatcgcttgaacctgggaggcagagatacatttttcctgctgcccactcttctccctgctgcagtcccctttctcctgagcacatgtctggttgtagctctggccttccaagattatagctcctgctgactggtgacttacaggtgtgcatatctcatgacctctggaataatggctggcagtcttttatgtctacacctttgcagaattcaggctcctctcctcccagcctggtggtctctcattagctttgtaaaggtggttgggttttggagatggactattattatttaaactgtaaactacatgtctcccaaagctagcccatcctaagcccagtaataattaaggcaacatgaaggtaaaatataagagggaagttggctatattagatcttccccactgccataattttctcactgttataattattgcaaatgcagtttcaatatgagttgtttttcaattcaacctctggctttctaattaaaaatgattagttaaacacatgtgcatcttcttcctattctaccaacatcctattgaaatgaccatgtgatggacaaaagagaagatatgtgtccatgctgagaacaggatgcaaaaccctcagcagactagagggcaggaggagatgggaacacactgggatgtgtagcccgaacgatgcaaagaacagagttgagggtgagatggaaacccctcacaaaagaaagattaaaacaaacctagaatcccaggcatgcctcacaagcaactgcagtgctattaaaacaaacctagaatcccaggcactcatcacaagcaactgcagtgctattaaagggctgtttatggatcagctgggccagtcagcttcccttctcccatcctgcaactcctggcagtagctggcagcagttatttaaaagagaccagccaagccagttcctgagtgagtccaaccacagtcagcccagggccagccttgtggctcccaatctatggtactgagggtcacgttcattaattacatttccaatgaaacaataattgcctttagtaaactacagaagcataagtagaagcgatattgtagtaaatgtctcatatcattacttctgccagaaatacctctgcccttgcattttcaaaagatatttgctgcacccttttctgaaatatacttttataatctcgattccttcaaaaacctatttatttatttatttatttatttatttatttatttattgtatttgagacacagtctcgttctgtcacccaggctggagtgcaatggtgccatctctcctcactgcaacctctgcctcccaggttcaagcgattctcctgcctcagcctccagagtagctgggattacaggcgcccgccatcacacccggataattctggtacttttagtagagatagggtttcactatgttggccaggctggtctcgaactcgtgacctcaagtgatcaccagccatggtctcccacagtgttgggattacaggcgtgagccacctcgccaggaccaaaaacctaactttaattatttccctagccactatacggattattttatttagtgcttttttacaccattacatatacatataaggaaaactggcatcttttacatatttatttatttttatcctgttttcctctaaaaactattaaggcaacttccaaaatatattctacataatgagattaataaacaagtaaaataaatcagtaagaaaatctagtttggattgttatgagttaaaaaatgaatacacaaaatataacatgatatttggtctaatataggcttcccgtgccctcccccctcctccggccaccgcccccaacccccgccccagaggacacggggacatggatgcccgggtctgaagccatggctgggcagctacccttgcgcctgggactgcagggctccctccccaccagctcagaagccggcagggctctttccttcctgttctcagctcccgcgggctccaccaagcgcgcggccctgggacgcctcccctgctgcagccagcatcttggcagcagcctctccagatgggccgctgccatcaacaccaccccaaccagtaatgtggctcaaccagttctgccatcccacccaggaacagaaggcagcaagaaaacctcactttgatccccctgtgattccatctccaacctgaccaatcagcactccccgcttcctgagcccctgccatattatccttaaaaactctgatcccaaacgctcggggagactgatttgagcaataataaaactccagttttccgcccagctggctctgcaagaatgactctttctctattgcaattcccctgtcttgataaatcagctctgtctaggcagcgggcaaggggaacttgttgggcggctgtgtgtgtgtgtgtgtgtgtgtgtgtgtgtatatatatatatatatatatataagcactcacatacataaatatatgtaatatttgcaactggaagtagaacaggacctcctaatccagagatgagctcctgtagcatcaggatgactccctgccaggtggagcctccgttgtggtcatactattgaggggacccccacctgaacgccagtcctcacccctgattcagccattccacagatatttattcagatgttccaggaactattctaagggcatcaagtgctgttcttgtcacaggcaaaggaagtcccaaagggaaagtgtcttttccggcggtgcctgccccacctccaagcctggcacctttcgaaatttatcttaggacatttccgacaggtgttgctcttcttcagctttgtcctggcataattttgtttcccaggagccttcattttcttccttcattgatcctacatgtgctgtagctaacaggaattcctcagagcacgtagcctttggatagcatggtttcacggttgtcaactctgatatgtttatctatactttaagcttcgtgtagttttcattaggattttttgaaatgcacaggatgatgtaggctagaatggtaggttcgattagctatgttccttgatgatttcacagccagttatatttaaataacaaaactattcagatttatgcttctacgataagagatttcagtatttttgaatcaaaccattttaagggtttttttttaatgaaacacttatttacttaaaatgattacataactctccccttgcatgccacattttaggcaaaattaacagcatattcctaaaacccagcttactaaattgcttctcttgatagctttttttttttttaagtccaagaagaatttctaattggaagctttaattgtagtgagctatgtactagccaaggaaggcaataaattgaaaatatgctgtttaattttgttgttgtttgtttggctggagaacactacagttttatttctattcataaaccagtgcttcccaaccagggctgtttttgcctccagggaagaaaatgtctggagacatcttgggttgtcaaaactgggggttgctactggcacttagtgagtacaggctgtggatgctgctaaacatgccatcgtgcacagaacagcctgtaccctctcttctcctctgcaagaagaattaaaaattatctgactcaaaaggttaagactgctaagattaagaaaccctgccatcgaccagtggaagtaaaaattgtaaggatttattatttcaaatctatacagctttacctcatgagttttactttttctaattctctttagggaagtttctcttccctctcattttccaaaccaagttgtgattttgggcgtgaactactacaccccacagcccagcttctgcgcttgaagttgttgtggatatgggctccatgcttgtagtggcgaacttcgaggcctatcacatgtggcctgtcacgagtggtctgaggctaccccagaccactccatcacatgacctgtgcatacaccttacatcattccgaaatgcccttcacatatgccctcttccagaatatagaacatcttccttgcgtaaatactttcaaggaaaagctggccacactctgactacttaaaccccttgaagttttgttctatgaaaaacataaatggtggttcagctggcagcatcctcagtaacactcttgatattttctatcctctaattttctccatctgtttgagagaacacactttgggttatctagggcctatgccaaaggaggcattgtggataagtgtgactcagccctcctcaacaaaaaattacctttcaatacagggcagaagcttatgatattaaaactcatgtggttcctcgagaatctcctcaatacactttcctcgtgagccaggggtgagggtaactggcaaagcaatcaggtcttggcgccaacaaaatcccatttcatccctgaaatacaaggcccatcaggacgtgacatctgtctgtattacttcctactgtataatccccagtaactagaacaaagcagttaaacaatattcaacagtcagaaatatatttatcatatgctgctaaaaataccctccattttctagctctctaatcagttaacatgtgcacatttaaactacatcacagcattgaatttgttctatctgtctgtatggacacaattgtgctgctgacaatttagtcaagtgtttcatctctatgtagacaaccatcatgtaagaattaatgagaatttcctaacatcatggtggcaactggcagctattgttctgaaaatttctagctctgaaaaattttaggccaacatgtttacagtaatgttttagtttaaagagcttggaaatggggtttcctggaatatattggaataaaccatgtattttattcccagttttgggagacatctgctttccttatgttccccaggctaccaccatccaaaagcagaaaagccatttagggaaccaagagttttagtcaagctatttaactgtcatcagaaataaagaaaaaaaatcacctttacagccttctgggttaatttttataaggtggtttgtcttcattcagtggaaaagaataatcttaacttcaggtcattggcaggtcaataaaagctctaaagctaaattttcaccaaaatctcagttgagataagtaatatttaaggattatttggaagaataggctccactgatttctgtaataaccaaagatttaatactggattaatccaaaccatcgtataactccatacacaagccatattgtctggattgtccaagaaattgcttttaagaaattgtcatatacttatggtccaaaacgtgtttattatagttttattgttgaggacaatgtcccctttatcgcttggtgactccaattaaagaccccaataaacattgctctcagacttgattttgacaacaaaacctctcacataaaatactgaaagtatgaatgttagaattcttttttatttccgggaagctgagatacaaaaattgaaccaaaattcagtgacatagatctttatcatatcttgcgtggtcctctgaaataggaagaaaacattaaattttaacttttgactttagggtaaaaaatcacttttatacaaatcaaaaacaaacaagaaaagaaccccatacaaattatagagataaaggccgaaaaaattgaccataataaaataaaatttctgtgcaacaagacactaggaataagtttgtaagaaaagctagtgggaacaaaaagatatttacaacattattgaagacataaagattgatatccaaaataaaaacctcttattaaagaggaaagaaaaagtaaatgaaagtacaaacagattaagaagagaaaacagggccgggcgccgtgactcatgcctgtaatcccagcactctgggaggctgaggcagatggatcacgaggtcaggagtttgagaccagcctggccaacatggtgaaaccccgtctctactaaacatacaaaaattagctgggtgtggtggggggcacctgtagccccagctactcgggaggctgaggcaggagaatcacttgaacccaggaggcagaggttgcagtgagctgagatcatgccactgcactccagcctgggcaacagagcaagattccatctcaaaaaacagaaaaaagagagagagaaaacattaatgactaacaaatgtatctaaagattctcagactcgttagtagtcaaaaaagtgtacattatagcaatgatgagagtgcaattctctttatctgaactggtaaacataaaaaagtcagacaaaatcaagcattactgaagtgacgataaaggagttatctggtgatgctagtgggaagatacagtggctgtgcgaggtgattctacaacatgacttacaggcgagtactcatgcgcaccctctgccccaacaacctgacagctcttcccctgccatcttccatggtccacacaaacatgcatgagtgtgtcctgggcagctgcaccctcacctttgtgcatcacagcagggtccacctgctctgagtccttatgacatgacgctattctcggtgttctgatatgttcccgacacgtacaatggctccaatcagccctactgctgcctggaacaaagagaaactttggttatatagtgagtatttgcataaagaccattttcaaagagcaagaagactataaaagaaataaatttgtgcctgtatatggactccctaaagctgtctctggcctccagtttaaaaacatctagaatctagccaggcccttgcctttccttgaagcacacttatctgcctagaattaggtgtaaataattttgttctatttcccaccccacgattctgaagaactggctcaaatgtacccaaactctggtacacatttgtcaatgctgcctcttacaggacaaaaaaaactgagtattttctttcataccctcatacactttccacattgaaaatgtgggatattctgtatttccacaagcagttctttctctctcctttatctctctcctatttttcttgaaacccctactctctcactctgtgatttgtctaaatataataaagatataggtacaaaaaatattttactttcctcttaattctactatgagaagaaagcatcaagttcaacgataaagggcagctggtaattgaccttaggtgtagggagaaagacactggtagggatgaggcaaacaagaaagtctgttttccatgtaaagtgtggaacagtttctcagcaattgctgagatcaaggataagccctacgggtttggtcaggaaagaggacccctattactctgagagaatgcagaaatccctccgttttgttgttgtttgttttctctgagcccttgtgatctggcccccaagaattcctgtggtggcagcagtaggtggtgcctaggagaaacaaaacactgaggccagggcatcttcctctccagttggtgcagtagtgatcccaagagggtgatgcaaactttttaaagtcttttctcattttgccacctgtcacctggctccaaacatgggtgcagccatgaaacactgtagcagagtaccgtaatcaaagacccagcattctggccagaaaacagaaaagaggagctccagggaaccagaaaatattggagacattgtggaggggaaggagtatgagaaagtgacaccataaagtttttaatgaactgagcgcatccccaagctgcatgtgtgtggatctgctcctaattagttaaccaaagattttgagaacgaagctagcagattatcatccgagttccacactgaccaccaggacatatctgaagaaaactggaaaggctttgaaaactcaactgattgttggaaccacagctcacaaaacacagattggaacttgcagcttgaatatgacaaggtcaattgcttctaaaacaaaaatagcatccatccgcctaatattttatgaagatccagagcctcaaaacttaatgtccatgacacaatccaaaattacaaaaaaacagataaactgtaccccacatgagaaaagacagtcagtactaagtagctaccaatactgagaagaaaaataaatttgaattacatcacaaggattttaaagcagcttttataaaaatgttccaacaagtggttgcaaacactttttttttttcttgagaccgtgtctcactctgtcacccaggctacagtgcagtggtgcaatctaggctcactgcaacctcagcctcccgggttcaaacgattctcctgcctcagcctcccaagtagctggaactacaggcatgcgccaccacatccagctaatttttgtatttttagtagagaaggggtttcaccatgttggccagatggtctcgatctcttgacctcatgatctgcctgcctcggcctcccaaagtgctgggattacaggcgtgagccaccatgcccggtcgcaaacacttttataccaatggaaaactagaagtatcagaaaataaatagaagatgtaaaaaggaacaaaatgaatatattaggaccaaaaaatccaataactgacatacaaaattctaagtaagctttttattacaataaaactaaagaggtaagaatctgttattgtgaatataaatcaacagaaattatctaatctgaacaatagagagaaagaaagatgaaaaagtctcgattagagccttagagacttgaggaacaataattaaagttccaacatacatgtcatctgagtctcagaaggagaaaaggaaaaggaatgcagtgctgaaagaattttgaaaacctaacaggaaaaattacccaaatttggcaaaaggcaaacattaattgaactaaaagaagaaatcaacaaatgtacaattatgattagataattcaacactcctctctcgctaataattagtgaacatttgaaattaattgatggtaagtttgattaattctgagatttttagcagtattgtttatcacatataattaacagatcatttctgtatagcaaacaaaaatgcattctgagccacatgtaatagttcatcacacaaaatgttgagttaatgccagtcagaatgtctctcttcttccagtacagggattacaaaataatgacaagacctaaggtcatgtatgcagtgatgcactaagtaccttaaataataggacatgagattgcaagcacaatgcagtcactatgaatgagaaaattatgtaagagctcaagttcatgtgctgaggaggcttctgagaagccttaaaggatatctgaccaattcagctgttactgggttagactattaattgtcttattgccttaactctcatcaaaaaaagactgttctgcaggctttttttactgtgggcaagtgattaacaacactccagctagaaaattcttcctgatgtctgtcctgagtctctcctgatctaacaagcaagggtatacaagaacttatcagttccatcatcaattacaaaaaaaaattaagttgtcataagcatagtatacgatttaacgatttactaaaatgcaatggtagtcaagctatcagaggatggaggaacctccatttcaccatctggttgttcctctttgttccctttaggtgagtctgagccaaaagacccaacactaatcacaatgctttgtccatttcagtaggcataattccttacaacaacaaataaaataatccctaagcatttatttcataaaataaatgtattagatattttggcctcacaaaaataagagatagagtctactcaaaacagtgttttgtttatcattttcataaatttcaaattagaatgtaaagtttatcatatctcttccatttgttaggatagtgttagtaacatttataaaatcattttctttctcctgtatttatttgacataaaatgtgtcattctctgagaatataagatgaaatcattccacagaagaattacttatatgcagagttatttatgtgtaatagtactccataaattccctttgagggcctttttccattcagcaagaagaatgtcttgatggtaggcaaaattgtacgtaagttaaaagtatgaaatttgaatcaagctctgccattgaattgtcacgtgaacctggaacaacataacctctccctgccttagtttctctatttatataatggtaagtataataaaactatacttcaagggcttttgcaagcactatatgaaccaatagatctaacacatttagaacggtaacttgatattttaggcaccttgtaagttattgttattatctgcaattgtatctacccaaaagctagaatccctcttcttggcccccacattcctatgacatgtctataaatatcttgtaaatatatttattcattttatgcatgcatttacttgtattctgaatgcctttacatgtgccaggcattgtctaggtgttggagaaactaagactgattcaaaggagatatttacttaaaagaaatagctgtaatgggtataatttgcagacggggagaaccctgtgaaaaagagagtaattagaaaacttcattttgaatataaagagaaaaaacttttctgagttcataaaagaattattgatatcatcaacaataaagagcatatgctaacatttatatttcctaactattctacatacctatatttatatagatttcagctaacaactgggccttggttctactatgacgtgttgctaaaagcattgattatataagtttgtgttatatgcagtgattgcatgagataaaactttaagacaaaaaaatctgctccacaaaatgccttggtcttcatagcttattcaagtcatttattttatattctgcagactgtggaacatctgtttattaatgcagctttatgatatgttgtaaattgccttgacataaaataggaaattgcacattcgagcccagattttcttttcatccccttgtgttcagcttggcaaaaggctgatactgccagaaaaagaaagaaaactttgttcaaaattgaagttaatactttcttggagaaataactactaactaaagacaaatacttgatgagactattttaatgtatctattgtccttattaggtaggatataatttcttactttaacatgtgatgattttatttcaaagccattttgactgaatgactttcaaggttattttgcaaatcataataatttaaatacttaaggaagctagtcaaaaatttgaaattaattgatggtaagtttgattaattctgagacttttagctgtatcatttatcacacagaagagaagatcatttctatatagcaaacaaaaatgcgttccgagccatatgtaatagtccatcacacaaaatgttgagttaatgccagtcagaatgtctctcttcttcaagtacagagataacaaaataatggcgagacccaagatcgtgtgcgcggtgatgcactaaaataccttgaataataacagatggggccggacgcggtggctcacgcctgtaatcccaacactttgagaggccgagaagggcagatcacgaagtcaggagatcgagaccatcctggccaacgtggtgaaaccccgtctccactaaaaatacaaaaattagctgggtgtggtggcaggggcttgtaatcccagctacttggcaggctgaggcaggagaatcgcttgaacccaggaggcggaggctgcaatgagccaagatcatgccactgcagtccagcctggagacagagtgagactccgtttaaaatactattactactaataataataacacatgagattgcaggcacaatgcagtctgtgaatgcgaacattatgtaagagctcaagtccatgtgctgaggaagtctctgagaagtcttgaaggatatctggtcaattcagctgttactgggttagactattaattgtcttattgccttaactctcatcaaaaaaagcctgctctgcaggcttttttactgtgggaaagtgattaacaacaccccagatagaaaattcttcccaatgtctgtctttaatctctcctgatctaacatggcgtattcctagttcagcttccctcaatggaaacaaagaagaattgcttaaaagggaaattattctatgggttttgtttccacaacaaaacaggagataatgtgccctattttgtaaaacaaatcatttcatcgaaaactctcttcgaaacctctactcagagctatgttgtttagtgacctcaagcaccaatagatggacatttcacccattccctaccactaatagtagcatcaaaatgtcattttgtctttaaaaacaaatatgtgctgaaattaaacccacttctttgtagatcttctgactataaaattctggcttagttgattcatttattctctgcctctttcttttcctccctcccttagttccagctgtattgctgagccctacgaaggtgctgtcctgggctgctgagttctcctgagctgcagcaaggacgggccagactcagggcaggtactgccgaatgacagtgagccctgctttctgggggctccctgtgtaattaggtgaggctgactttagtcacattatcacaccagggaactgaggctctcaggctgatggaaaatagcaggagtctacaggatggttatataaagcggcaggactgaagggtgagggaaggctgccctgagatttaactgttgagccttgcaagacaggacaaggacaggatcagcataaagaggtgggtggagggtgggtagagaattctaaaccaaggtcaacagagtagtttttgtgaagagaggaagcagggagtgaatgaacaactgaaagagggcccacaagactgggatgccaagcaagggagaggaacaaagcctggtcccgcactggagggcacagtgaaccagattccactggccatgagtcactcgtgtaggtgtctctgagctaggagatgtgtactaattcctaacaggcaagagtttaggccggcattggccatcagagaggatgaaagaaaaaatgtgtcttatttatggagctagcataagaggaagctagagctttactaaatgtgaaaatttaagttgatgtatattctacatcctgaacacccagtgacaaactgatgttccgatatctgtttatacagtgtgtgtgttatcattacactggcaaaatggatgatatgcttgccttatttcaaatcactaagttttgtattatggtgatatactcatactgctttcttatcaactcagaaatccattatataaaatccattttttatggccatctaaatcctttattcaataccatcagcctgggacatgttaatatatttctgctagacataccacccagacttgaaatgcataggacactaagcacatagtggtagcagcatgttttcctttaataaaaagacattatttttggaggcagttttacatttacaagaaaattgagcagacaatacagagagttccttaaaccctccctagctcatcatgcctattattaagatatcttgcattcgtctggtatatttgttacaattaacgagccaatattgatacattattattattaactaaaattaacagtttcattaaggtgtactgtttgtgttgtacattctatgggtttggaaaatgtgtaatgtcatatatccaccatgacattttacagaatggtttcactgccctaaaaatctcctgtgctccacctattgatctctccttctccccgcaaatccctggcaacaactgtgcttttcatggtcttcatcgttctgccttttaaagaatgtcatatagttcggcttacacagtatgtagtcttttcagatcggcttctttcacttagcgatgggaatttaaggtttttttttttccatgtcttctcatagttaaatagtgtgtacctttttatcacttaataacattctattgtatgagtgtaccagagtttgtttatccattcacttactgaagttgcttccacctttgggcaattatgaataaaactcctataaacatcaatgtatagagttttgtgttgacctcagttttccatgcctttggttaaatgccaagacacaattactggatcttatggtgacagtatacttagttttgtgagaaaccacttcccttccaaagtggctgtatggggctgtatgggaaatatttgaattaacatccaaatcacacaatctttttgttacactttaagcattaagagattcattgtcatagttaccttgggagttaattgcttctgaggagttgacaagggctctcggtaatgtggtgcatattaacacaggttatattaatgaataaacaatgcatgaactgtgaaatgtaagaccatgcagagtatattattaataaataataatgattatgtactacgtatttatcttttgacagagaggtgcacaacaaaaacaaatgttgatattcttgaaaattttgaagtcaagtctcaacaattaaatataaattttgtctttccatgtaagtgatagactaatgaatctacagatttgcaagtttataagctgaagtgaatgagtgcctccttctgaaaattattattgggcttatgagtttataagtgcatgcatttcaccctggttggcctaagctggcaatttcctccaagtgggcatattaggaataccaaatgtcatgaacagactgcaaagagagagaggaagggaacatttagcttctgacagctgaacacaagaaaagggtccaaccaagtttcctgggaaagctgcaggttacaaatatcagatgaccaatacataacttctcttgtttattttaattcttctgttttaatagacaatatttcattttgacattttaaggaacatttctgtgtctctgttctagcccctgatgttacctttggagactaggaggaagagagagggaataattaatatatttataagaacatatttttgagtaagaagaatatgcatgagttaacatttattaatatatttttattaatcaaaatatattcacaagaaattatttatatttaagaatatactcaataacatatatgtaaaatatgttattcaggagtgcattcttaattcacatgttctttgtgccacatgtgtccactgatctctgtggaagattcataaaaacgatatgtaaggtatccaaattgctgaaaaccacagacagtgagaaaaatcttgaaggcacctagaggaaaaattaagcatttacatcaagcatttatcaatgagaagaatatattcatcggaagaatcgtattagtccgttctcacgctgctaataaaggcatacccgagactcggtaatttgtaaaagggaggtttaattgactcacagttcagcatggctggggaggcctcaggaaacttaaaatcatggcagaaggggaagcaaacatgtccttcttcacatgatggcagaaaggagaagtgctgagcaaatgggggaaaagccccttataaaaccatcagttctcgtgagaactcactcaccattatgagaacagcagcatggaagtaaccgcccccatgattcaattacctcccagtgggtccttcccacaacacctggggattatgggaaccacaagttaagatgagatttgggtggggacacagccaaatcatatcaagaatatattttaaaaataaatcattttattcaagaataaactcatataaatatgtttatcttttgcaccatcagtttttccttttttcttttagcttccatctgtcaaagcagaaagccaggtcagagatagaccagacatcccttcacatttgctgagactatgacacaagaaaaaaagtcaaccttaaatagcagaaacaaatttaacaaaacagtcatcagcaaattggccactcagcaaagtggctttgtcagtggacctggtcgagagagctaggacctgctgccacagaaacttccttggtcaggtgaaacaaccccgaagcagaaagtgtaggtagaaaatcaggactgaagcaattacacatgttgtaattgacctttccatctccaggggataatgcagtgaaaccctgccacctttccacaggctaactctcagaggaataaaaaaaaagtcatgtgcaggttgatttgggctcatgaatactctttcatcattcaacttttgatgttcaaaagtgtatgttattatatttgtgcacatgtgaaatgaaagagaaaggagcttggacacatgaaaaccaaggaaagaaaaacctaatttgttttactaataaagaataacagaaaaaagggtaataccaatttcacttgcttctatgtctcttttctatgccctcaggaagtacaatttaccactttgggaagcttaggagggagcatcgcttaagaccatgagttcaagtccagcctgggcatcatatagatgtctcttctaaaagcactactaatgcaataaaatgtattctcgttgaaaattacatctgcagagaataaaacaggaaaaaaactgctgtcttttcacactcaattgtttatcttctgatctgattcatcttgccattgtatgttgcatataagttgtaataaactaaaatttaacatattgtggtacatacacaccgtggaatagtggaatactatgcaaccataaaaaagaacgagatcatgtccttttcaggaacatgatgaagctggaggccattatccttagcaaactaacacagaaactgaaaacaaaataccacatcttctcacctacaagtgggagataaacgatgagaacacatggatacatagaggggaatgacacacactggggcgtacctgagagtggagggtgggaggagggaaaggggtacaaaaaataactattggttactaggcttaatacctgagtgatgaaataatctctacaacaaacccctatgacacgcgtttacctatataacaaacctgcccatgtaacccaaacttaaaataaaagtttaatatataaatatatatatagtggcattttgaacagacatttacatatagggatgcatgaatacatagatcaatagatgtatgtattcacgggttattatgaatgcaaatatgcatttaaaaatagggtttccaggactgtgggaggccgaggcgggcagatcacgagatcagatcgagaccatcctggctaacacagtgaaaccctgtatctataaaaatacaaaaaaaaaaaaatagccaggcatggtggtgggcacttgtagtcccagctactcaggaggctgaggtaggagaactgcttgaacctgggaggcagaggttgcagtgagctgagatcacgccactgcactccagcctgggtgacagagtgagactccatctcaaaaaaaaaaaaaaaaaaaaaaaaggatttctgggcatttttggttgtcgttttgtctgttttttttttttttgttttatttttatttttatttatttatttatttattttattatactttaagttttagggtaccttcatgctaaaaactctcaataaattaggtattgatgggacttatttcaaaataataagagctatctatgacaaacccacagccaatatcatactgaatgggcaaaaactggaagcattccctttgaaaactggcacaagacagggatgccctctctcaccactcctattcaacgtagtgttggaagttctggccagggcgattaggcaggagaaggaaataaagggtattcagttaggaaaagaggaagtcaaattgtccctgtttgcagacgacatgattgtatatctagaaaaccccattgtctcagcccaaaatctccttaagatgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaaggcatgtgaaggacctcttcaaggagaacttcaaaccactgctcaaggaaataaaagaggatacaaacaaatggaagaacattccatgctcatgggtaggaagaatcaatatcatgaaaatggccatactgcccaaggtaatttacagattcaatgccatccccatcaagctaccaatgactttcttcacagaattggaaaaaactactttaaagttcatatggaaccaaaaaagagcccgcattgccaaggcaatcctaagccaaaagaacaaagctggaggcatcacactacctgacttcaaactatactacaaggctacagtaaccaaaacagcatggtaccaaaacagagatatagatcaatggaacagaacagagccctcagaaataacgctgcctatctacaactatctgatctttgacaaacctgagaaaaacaagcaatggggaaaggattccctatttaataaacggtgttgggaaaactggctaggcatatgtagaaagctgaaactggatcccttccttacaccttatacaaaaatcaattcaagatggattaaagacttacacgttagacctaaaaccataaaatccctagaagaaaacctaggcattaccattcaggacataggcatgggcaaggacttcatgtgtaaaacaccaaaagcaatggcaacaaaagacaaaattgacaaatgggatctaattaaactaaagagcttctgcacagcaaaagaaaccaccatcagagtgaacaggcaacctacaaaatgggagaaaatttttgtgacctgttttgtttttatctattgacactagcaggaaggcttacttttttatagtaggtatatatttcaaaccatagccttaggtcttatgacatagttaaaggaaacatcatataagagctcagagatgtaaaatagagccatttatgatggttttgagaaactgtaatggtacatctatgttaattttttatatgttaatttaacttaggttttctgcgtttggaactgtgtacaggtaagatgctctaagctaccatatagcaaaatttaaatgaaaattaccattacatttatttagctccaaataatttaataactattactgggttgttactagaaagaaaaacaggtcactgtaatgttaacgaagtaaagcagtcccaatcaaatcttgcattgctctgacatgtgttttgctaaaggagagggagaggcattttgttgtatttccagctggcttcctggggaaacagaaaacatttggagaatgtattcccctttgttaattgtgacacatgtgtccagtgaccccgatgaagaactcttaaagtgacatggaatgtgttcaaattgctgaaaaccagagacaaagagaaatcaacacaaaaactgaaaatctctcatttttctcaaaagagaaacatcttgaggaagctagaggaaaaaagacattatcaaacaagaaacaaggttaagaatggattaagaatggtttcatatcagaaaccatgcaagcaagaaacgaagtgacacttttgaagtcataaaagactttttaaaaacctatcaacccagaattctataaccaatgaaaaattcattaaatatttgttaattactctggcgattttgaattaaggtgaagttgaattcccctcatgtggcttgcaagttagtcttgtttttgtggtttgggtttttgtttttgagataaggtcttcctctgtcatccaggccgaagtgcattggcacaatcacagctcactgcaaccccaacatcccagactcaagtgatcctcccacctcagcctcccacattgctgagactacaggtgcactccaccacacctggctaatttttgtacctttgtagagatggggtttcaccatgttgtccaggctggttttgaacttctgggctcaagcaatctgcccaccttggtctctcaaagtcctggaattacagacatgagccactgtgcccagtcttgcaggttggtcttaatgactgacttttaagaaatggaatatggaaaagtaaaaactgtaattttgtagtggaggaaaccatcaagtcaccaacatagccaagtaatcaaggttaacatgaacaatgaaaagtcatatggctacctcacaccactgtgacacaatgggaaggtcacttcaactatgtgaaattcttcctcaaaatttacaaccccactttaatcaagaggaaacatcagatgaacccaaatcatttgatgcacattgtaaaaaatatctggtcagtagtcttcaaagtgtcaaagccaggaaagacagagagattgtccctaattgaagtagactaaggagacatgaagacaacacaatataagatcctggatggtacctgggaacaaagagaagaaattagttaaaaaaaaaaaaaactggtgaaatgtgggccaggcacagtggttcactcctgtaatcccagcactttgggaggccaaggcaggtggatcacctgaggtcaggagtctgagaccagcctggccaacgtggtgaaatcccgtctctactgaaaatataaaaattagctggctgtggtgttgggcacctgtaatcccagctgctcgggtggctgaggaatgaaaatcacttgaaaccaggaggttgaggttacagtgagccaagatcgcaccactgcactccagcctaagcattagagtgagacttcctctcaaaaatgaaaaactggttaaatatagcctgtcatttaggtgatagtattgtacaatgttaatttctcgtttttaataaatgtgccatggtaacataagaggttaacatcagaagaaactaagtgaagagtgtatagaaactgtctttaccatctttgcaactctatgtaaatctaaaattattccagagaatgacttcacaaggtggcagaatagaatttctccagctccacacccccacatggaaatccaactagcaactatccacaggcaagaatacctttctgaatatcccagaactcaggagtgagactgagacacccaattgtactgcagaactaagagaagctgtgcttgaacagtaagagaaacagttcattttgagagcatgccacccctccaccaagctggcacagcacgacacacagaggatttcaccggacccactatttctacagtggaaaaagaaagttggaggtggacgtccagctttcccaccattctagaacccttcacaggaggctcactcttgtcttataccacaggaaacattaggagtgccatcggggctagaccacctggggtcagctagaaacaaataatgggagtagatctcacagagactagcatatagttagtctgcattctggataatggaggcatcatatgagagagactagccaacagcattgtactgcaggaagtacagctcacaggtgtacccagcttgaatccctcaccagctttcctacatagacctggtgctttctacagcattgcccaggctagaaggcaagtgaacgtcagcacttctctgcagagggtgcatctggcccccacccagcaccagcagctgaccagggactccactaagctttggtgctttgtttaagcctgccctagaccaggagacaagatcaagtccacacatatgtgtggggcataatggcttctagccctgatcagccctgtgtagctgagcaacaccagagtctttagttgaccacagagctcagcccagaggcctgctcaactacagattctaaacaacaataccatccaactagcagagacagcctacaatcctgcctgatcagagtgaactgcagagtccagttagcagtaccattcaaccttagggctcaggaagtgacacagtccaactagagaacctgacaccaagctctgcccgtccagggtcattgccagctaatgcatccaaaatcccttcctacgaagtagtaaagctctgtcaaagcctggaagaggtggccatctcctcaaacacagaagcatcaatgcaagacagaagtatgaaaagtcagggaaatatgacaccactaaaagaaaataataaagatccgataatagatctggaatataaggtgatctatagaatgactgacaaagggttcaggataatccccttaaagaggttcagggaactccaattaaataaaattaagtttgaaaccaattcatgaacaaaatgataatttgacaaagaactagagatgataaaatagaaaccaaatagaaatctgagacataaagaatacaacaatttaactgaaaatgtcaatggaaagcttcgacagcagacttgatcaagcaaaagaaaggatcactgaattcaaagacaggtatcttgaaattatccagtctgaagagcaaaaagaaaaagaataaagaaggcctgcaggaattatgagataccatcaggcaaactaatattcacataatcggagattcagaagaagatagagaagaaggcccaaaaaggatatttaagaaaatggctgaacatttccccaatctggggaaagatgacaacatctaaatacaggaagctcaaaaatctccaatcaaattccactcaaaaaggaatttaccaagataaaacataatcaatttatcaaaaatcaaagacaaagaaacaaaactgaaagcagcaagagataagaaacatatcacattcaagaaaccacaatatgactttcagttgacttcttagcaaaaactctgcaggccaagagagattggggtgatacattcaaagggctgaagaaaaagaactgccaaccaggagttttttacttggcaaagttgtccttaaaaaataagagagaattggctgggcggggtggttcacgcctgtaatcctagcactttgggaggcctaggtgggcagatcacgaggtcaggagatcgagaccattctggccaacacggtgaaaccccatctctactaaaaatacaaaaattagctgggtgtggcggcgtgcacctgtattcccagctacttgggagcctgaggcaggagaatcacttgaacttgggagggagaggttgcagtgagccaagattgcagcggcagagcaagactccatctcaaaaaaaaaaaagataaaaaaagaaataagagagaattccaacttccccagacaaacaaatcctaagggagtctattacattatccctgctttacaggaatggctaaaagcagttctttaagctggaaatggaagttttctacttaataacaaaaaaaaaatgcatgtaaaaatctcaataactcaatggtattaagtaatacataatcaaactcattctctaacactgtatgggtgatacataaagcaatcgtatccttactgtgatgattaaaaggaaaaactattaaaagaaactgtagctgcaattgttaaggaatacaaattacaaaaacaaattaaaaattttacatcaaaattataaaaggggggagtgagagtatgagattaaagttcaattattatcagcttaatgtagcatgttataaagctcagatattttatgtaagcctcatggtaaccacaaagcaaaaagaaaacaacaagagagaaataaagaaacagggacttacaaaaaattcagaaaatgaatgacaaaacagcagtagcaagtgcttacctatcagtaattactttgaatgtaaacagattaaattctccaaccaagagactcaggacagctgaataaattttctttttaaagaaccatatgctgcctacaagagactcactctactagtgaggacacatacagactgaacctgaaggtatggaaaaaaatactcaatgcaaatagacaccaacagagaccaggagtatctatatttatatcaatcaaaattgtctttaaagcaaaaactgtaaaaagagataaagaaggtcattaaataatgagaaaggggtcagttcaccaagaggacataacagttgtaattatatatgcacccaacatcagagcacctaaatacgtaaagcaattattaaatgacatgaagggataaataaatggcaatactacaatattatggaacctcaacaccgctctttcaaaaatgtccatacaacccaaaatgacctacagtgtcaatgcaatctctctcaaaattgcaatgtcatttttcacagcaataaaaaatatccttaaatttgtgtggaattacaaaagaccctaaagagtcaaaacgatcttgggcaaaaggaaaaaagctggtgtcattacactcgctaatttcaaaaatcttatgaagttattgtaatgaaaatagcatgacactggcataaaaataacctgactgatgaaacaggatagaaagcccagaaatcaacccatgcatgtatgatcaattgatttttgaccaaggtgccaagaacacacaatggggaaaggacaatatcttcaataaattgtgtggggaaaactagctatccacatgaaggagaatgaaatcagatccgtattttataccacatacaaaaatcaacccaaatggattaaaaatctaaacataatatctgaaactgtgaaactactaaaagaaaacagaaaaatccccaccacattggctggggcaatgattatttggatatgaccccaaaagcacaggcaacagaagcaaaaatcaaaaagagagaaataaaatggcatcaaactaaaaagcttcttcacagcaaacctttaaagtgaagggacagcccacagaacgggaaaaaatatttgcaaactatacagctaataaagggtcaatatccaaaacataagaaactcaaacaacacaaataccatcagtctaagttggtgagccctttcaaactgcagctcactttatttatttatctattttttttgagacggagtctcgctctgtggcccaggctggagtgcagtggcgtgatcttggctcactgcaagctccgcctcccaggttcacgcggttctcttgcttctgcctccagagtagctgggactacaggtgcccgccaccacacccgactaattttttgtgtttttagtagagagacgggatttcaccctgttagccaggatggtgtccatctcctgaccttgtgatctgcccgtctcggcctctgaaagtgctgggattacaggagtgagccaccgcacccggcctttttttttttttttttactttaagttgtggcgtacatgtgtagaaagtgcaggtttgttacataggtatgcatgttccatggtggtttgctgcacctatcaacccgtcatctagatttttttttttttttttttgagatggagtctcgcactgtcatccaggctggggtgcagcggcgtgatcttggctcactgcaagctccgcctcccaggttcacgcctttctcttgcttctgcctccagagtagctgggactacaggtgcccgccaccacgcccgcctaattttttgtgtttttagtagagacggggtttcaccgtgttagccaggatggtctcgatctcctgacctcgtgatccgcccgcctcagcctcccaaagtgctgggatgacaggcaggagcccccgcgcccggccccatcatctaggttgtaatccccacaggcattaggtatttctcctaataccccctccccttgccccccaaccccgtaacaggccccagtgtgtgatattcccctccctgtgtccatgtgttctcattgttcagctcccacttaggagtgagaacatgcagtgtttgattttgtgttcctgtgtgagtttgctgagaatgatgacttccagattcatccatgtccctgcaaagaacatgaactcattctcttttatggctacatagtattccatggtgtgtatgtcccacattttctttatccagtctatcattggtgggcatttgggttggttccaagtctttgctattgtaaatagtgttgcaataaacatacatgtgtatgtgtctttagagtagaatgatttataatcccttgggtatatacccagtaatgggaatgtgcagctcacatttttaatttgctcagagttttcttctctttggatgcatattcattgtctctgcttctttttctttttcagaattttcagatttgtgtaaatttcctctatcgattgccacgtcactttcattttccatcccatctttgtctcttagtatttttgctctgagacttgaaatggtccatcttttcctttgccggtctccaagccctcctctagccctgaggtaggaaagcccacaatagctctcctaccactctcaggccttcatctgcctgctgacggtccaaaaacgtcttgcttcaggagcacaggttggagttagaagtgaaattagaggaaaattagaagattttaaactattatttccccagaaccgcacagaatcggcagctacattaaatttcttacccacagagctgattttagaaatacataactgcagacatgtttaatggtgactgtcccgttaaaaggtaatagggatgcatgtgtccccattaaaggacttgccttgttccattaaaaggtaatggggatgcatgtgtgtgtgtgtacatgtgtgtgtgttattatccaccaaaaagcagcaaaagttttttatatatattttaaagaaaataataggagaagggttttgtcatgctatacttagaattctgaacatcataactcttattacaatgtatgttttaaggttaaaaacagtattatttaatgtggaaaaccttggtaaatgacattctatttataatatatattttatattcataattatgttatattcttatatgcaatattcaacactaatataatttgttttatggtacacctggcacgtaattctctcatatcttggagatggttcacataaatttttgtaattctgtcctgactagtcttcctattaactgtttaaagaactttatactccactatggaaatccttctttttaataaataaatgtgctttatgtaatatttccataaatagttttaaattacacctggaccatgactcatacagaaatatgtacatacacacatatctatatatttatatgtataaacataagtacacatatctatatacagaaatgtatttctatctgtctttcctattggatgtcttgaaactccatctttgggttcctttcttttaacttaaaacctatttttcctactaaaatgtaatgaaaaaaataaaaccaactgggagtactaatagttggcatattcttactaatttatgcctcagtgggacaatattttatcaactcttagcatggaaaaacaaatatactttggttttcacagaaaaaaaggagaaaaaacattaagcatctcaggcaagaaagggatgggaaaagcgtgatttgggtgaagcttagtagtgaagtaaatgtcacatggtagcctaagaagctgaggacaattttcacttgcatgacaatttttagtagagttgcttagtaactttaaaaacagatttaatacattttttctcttaaaaaaatctacagcaagaaatccagaaaccaatacaatttctatcatttcaatccagaattctttcaattgtttcaggttatggaggcattggcccataaaatattttgcccgataatgttttccaaaaagggaaatcttttctgctctcatcaacaacaaaatgtctggaagaaaaaggaaatattaaggaataaaaatttggctgaagagcctctctacttaaaggaatgaaaggtgtttcaaaaagttactaacaataagcacaaaaacaattaaacattaaatatagaaacaaaagaaatatttcatgattttccgtagctcttattggcaatcaaaaaccagaaaacaaaagcagcaggggggaatgcaagaataaatgaagtgcagagaaagggcaaacatgagtaaatagtaatgaaagctttttaaaactacaataatatcttgtagaaatataaaatgcaataaaaaagtgtattacaacaatggcacaagggtgagagatacacaaatacatggaagtaaacttgtaaggatcttgcattctttgggaagtggccaaagtactaataacttaagagaacatattgtgatcttgagggaaatgactaaaagtttcattacagctgcaaagctaatacaggagattcatagccaacaattggaaattacccaaaaattcatcaataaaagaatggataaacaaatccattgtatgaattccattcatataatggaagagtacataacagtggaaaggaatgaactaaaaatatctaccaaaaattggaggaatatcaaaacattttgctaagggaaatgagcaagacacaaggtgacatactgtatgattccatttatatgttcaagaagaggcaaaactaatcaatggtgataagagattgttttggaaaggacacaggaaacttcctaggtaatggaaatgttttatatgttgatctgaatgagggtaaagagagagaaggaggaagacagaaagagagagtcattgaataatactgaagttctgagctaagagtccttaacggatataaaaatattaaaaggagccttcttaaattgtaccacacactttaacctggattcatacagcatcaaaggtagaaaggatatagagggatcatttattccaatctcctcaattttacagatgaataaacagacacagaagaatagttgctgtattagtccattctcacacttctataaaggactgcccaagactggggaatttttttttttttttgagatggagtctcattctgtagccaggctggagagcagtggcacagtcttggctcactgcaacctctgccttctgggttctagtaattctcctgcctcagcctcctgagtagctgggagtgcaggcacatgccaacacactcagctaatttttgtatttttagtagacacaggttttccaccatgttggccaggatggtctcaatctcttgacctcatgatccacccaccttagcctcccaaagtgctgggagtacaggcatgagccactgtgcccagtgagactgggtaatttatgaagaaaagaggtttaattgactcaaagttccacaggctgtacaggaagaataactaggaagcctcaggaaacttacaatcatggtagaaggtgaaggggaagcaagcatgtcttaccatagcagagcaggagagaaagagtgaagggggaagtgccacacatttttaaaacatcaggtctcatgataactcactcattatcatgagaacagcaagggggaatctgctcccatcatctaatcagctcccaccaggtcccagttcaacatgagattttggtggcaacacatagccaaaccatattatgccaccactagtccctgccaaatctcatgtccttctcacatttcaaaacacaagcatgccttcccaaaagtcctccaaagtcttaactccttccagtattaactcaaaagtccaagtccaaagtgtcatctggaacaaggcaagtcctttccacctatgagcctataaaaccaaaaacaaattacgtacttccaagatccaataagggtacagtcattgtgtaaatgctcccattccaaatgagagaaattggccaaaacaaaagggctacacatcccatgctagtctgaaatccagcaggggagtcattatattttaaaccttcataataatctcctttgactttgtctcacatccaggatacactaatgcactgggtggcctccgaaggccttggaaagttctgcccctgtagctttgcagcatacagcccccacggctgctttcacaggctggaattgagtgcctgtggcttttccaagcacatggtgcaaactgtcagcagatctaccattctgggatctggaggacagtggccctcttctcatagtttcactaggcagtgccccagtggggactctgcgtggggcctccatccccacatttccctcctgcactgccctactagatgatctccatgaggtctccacccctgcagcagacttctccctggacatccacacatccccttaaacctaggtagaggctcccaaacctcaactcttgccttctgcacacctgcaggcccaacacaatgtggaagtcaccaaggcttggggcttacaccctctgaagcaatggacaagctgtatcttgccccttttagccaatgctgcagctgaagtctccatgatgcagggtgccatgtccctaggctgcacagagcagtgggtccctgagcctggcccacaaaaccatttttgcgtccaggcctgtgatgggaggggttgccttgaagttctctgaaatatctcagaggcattttcccccttgtcttggctattaacattcggctcctctttacttatgcaaatttctgcagccttcttgagttactcccgagaagatgggttttcttttctaccacatggccaggctgcaaattttctgaacttttatgctctgcttcccatttaaatgtaagtcccagttgcaggtcatttctttgtttatgcaaataagcataggcttttagaagcagccagaccacctcttgaatgctttgctgcttagaaatttcttccaacagataccctaaaccacctctctcaagttcaaatttccatagatccctagagcaggggcacaatgccatcagtctctttgctaaagtatagcaagattgacctttactccagttcccaataagttcctcatctctatctgagatcacttcagcctggacttcactgtccgtatcactatcagcattttggtcacaaccatgcaacaagtctctaggaagttccaaactttcccttatcttcctgtcttcttctgatccctgcaaactgtttcaacctctgcctgctacccggttccaaagtcacttccacattttcaggtatctttattgcaatgtcccacttctctgctaccaattttctgtattagtttattgctataaagaactacctgagactgggtaatttatttttaaaaagaggcttaattgactctcagttccatacgctgtgcaggaggcatggctggggaggcctcagaaaacttacaaacatggcataaagtgaagaggaagcaagcacatattcacttgaccagcaggagagagagtgaagggggtggtgctacacacttttaaacaactagatcttgagagaacccattatcacaagaacagcaagggggaaatcttcccccaggatccagttacctcccaccagttccctcccccaacattggggattacaattcaacgtgagatttggttggggacacagagaagagccaaaccatatcagatgccttgtcacagtctatcgtgcaacttgtaaatggaagagccagtgctaggatccagttatcttgtatccactgcagcacttgctcagaaccactttttctgaaaaattcaaattccataagaattaaatgaaggcagaagacaaataatatagcattctaaaattaattcatacagttcataagtcagaagacaaataatatagcattctaaaattaattcatacagttcttttattccaaacttaatcttagttgtctcattaaatgaaagtttctgggttgaccactgatgaagacatagacagaagctatgaattttacacatactttgatcacattttttcttgcctgaattattagaagaataacatgtttcagtgtgcttgattgctaagtgagacagataagtgtaaggttatttttcaagcaatatacttgctcgtctttcaggaagcactttactcatgattacatgtgcacttagataaaagtacagtttttatcttgattgtcactcatgatgtaattattcataaacttaagaaaagaagtttctttcagcatgacaaatggttctcatgcttgtgacatgacacttttgatctgttatgtgaagggaaaggtttttcttccacctacctaaaattttccccaatacaagaaatttgacagcactgaattctgtacctgacaggatgacttgtctccttgcattttgttaacctaacaatttcttccaatagaagcattcaaatgaagagtaactttgtgataaaaacacaggaagcaaagggaaaccaagggaaaaaactcataaaataaaccacctgttagtgctaccaaaaaggttaagagatcaattccaagatttatatactaagaggaaaatatttttaaccaacttatagaatgtcataagctgccactccacctgctatctcctttcccgatttactttgcttcataggatatctataactgggaggatatacaaagaaatacaatgcattactttatacctcaaaacttttaactaagaataaaatattacatgaggcagagaaatgttctatctatagatttaatatctaaatgattttcttcaaaagccagcaacagagtaaaatttattttgtggtgacttttcattatttatcctcattttaatcaaaatcaggttgtttttcttgttctaaattgctattatatatagcatttgtggtttgacaattcaatgaaaataggttttcaccgaaatatcaattcaaagtttctaccagtagtatccagcgataaaatcgactatgtttccttatgaactaaaagcaaaacttgacatctaagtaatcaaatgttaataatagcttggatagattctcattgttaaacaaaagcaaagcaaagaacaaaagcaaaaccaaacaaaatgctgtaattatatttgacttcacttcttacttatacatacatatatatgtatatatgtatatcattggttgggcattttttaccagtcatttattatcaaatgtttatgtaaagtcattgatgctagaaagtcataattttaattattgcattacctctacaatttcttctttcatgttcattttaaaatgatgaaactgctatcagctaagttttttaaatcaaagtaaaaggaatcagaatcttgatgtcagtctagcctgtacctgacctgcaaactccctaaaaaggaaaaaaaaaaaaactgtatttaaaacttctcatgtagagtcaaggatactttttaagtcccccttcctggaatattgattacttaagtgcttttccagaatctctgagctcagttacagtcagaccttcctatccataggttctacatccatggattcatccagtcatggataaaatatcttcaaaaattaaaaataacacaaattttaaaacagtatgtaaaacaacgatttatatagtgtttacattgcattgggaattataagtaatccagagattatttaaagagagagtgtatgtgtgggttacatgcaaatacttcatcatttacataaggaactcaagcatccatgggttttggtatccccagggagtcctggaaccaatgtgccaccaatactgtgttaagtatcaagacaaatggattaatgataagctgtgtcttctctacaattctttcaccacgtttttcctttagaaaaacactaaagtaagtatgaaaagctttggctccaatttctcataaattacttaaaatttgatatttacaaatataattatgaattataagttgatatcgtattgcaataacattttgtttctataatcatgcctctttttaatgtgattttctcgtgtattttaatatattgcagaaatgcaataactgaagaacttgttttttgtacagtgagaaatttgtatacaaagtcttctaccataataaaaaaaatgaagaggagcaccaaaacaagtaatttgccaagagtcagttttccttggattcgtatattccaattcccctgccaccaccccacacagacatgttcacatttgccaccactctctcactgcctgcaatgagatctagttagccagagatgtttttcaggctttttcagatattatgttcatgttttgacttgccatgtagcatagttaaggaggcctggctttgttttcctactgtgaaaggtttggagagtttgatgtcccactgggctgaatgattggcagtcaattcaactttcttcctcatgtaggtatgcataagtgacttctcaactattagaaagttacttttaagtaggattcacttgagtaatagccaccttaatatttctcttcttctcttaaaaggaagagaaacatttgccatataaaatactgtatatcttatttcaatataaatagcaaatttgatttttattattcatatgcaatactaaagaccctcagcaacatttcaaatcagagtttcacatgaaatatgtaaaactgccaaacttgaactgaaaggcatcttaatttcatcattgaaatggtaactttcgcaataaatattttgaatattactgaaaaataagagaatgaaagttggagggcatgtcatttttttatctgtagcttgaacactgcgatgatccacctcattgccataatgtttttataatttaattttctcattaactctcattcactttgaaaaatatgtgccatgttgcacaaggataaccaaaagatattcctcagagaaggcacacacataaatcagtaagcttggagctcatgtctgttatgtagttttggaattattccaaagacttacatagtttgctatgttttgctgtaacaagaacttagattgtgctccctccagccctcaagaatgcggtgtctgccgggcgcggtggcttctgcctgtaatcccagcactttgggtggccgaggacggaggatcatgaggtcaggagtttgagagcaggcagtttgagaccatcctggccaacatggtagaccccgtctctactgaaaatacaaaattagccgggtgtggtggcatgcgcctgtaatcccagctactcaggaggctgaggcagcagaatcacttgaacccaggaggcagaggttgcagtgagctgagatcacaccactgcactccagcctgggtgagagagcaagacaccgtcttggtgggggaaaaagaatgcaatgtcagagctcatcagacccatcatatgtgagttactgacctcaaccactggatttcaaaatacatataaacataagagctcaatgaacactttgagaacttcagtaagtctcagccacttctccaaaaatggagagcatattctgtgacagggctgccctgccagtcacttcttggaaggctgaactcatgcagcaacagcgccccaccctgtcagccgctgagctttgaagactcacctgcatcactggcaccaccgactggtgtcaagggaccctaggtgtctttgaggatctccatggtgtcagacaccatctctccagagaattcgcttgaaaaaaaggtgcacctcaaactttcattcgatttgcctttccacagaggtctgcttctatttctacttcaggaactagactttaatatttggaactcactccctctgtggttaatgtgcttcatcttttgagtgtattccctgtagatttgttcacattattcttctccttttcgagcattgtgaacttaagaaaacaaattctccttgcatggcaataaccatgtgatttgtgaaatcatactttgagcatcttattttagccatacaaaatagcgtggctcagaaattcaatgtgatcgtttctctggtcagtgacatatccccatgaagtgaagcagcaaggcagtaaaggaacaggggttttagttaaggggtaaaatgggtaatcttcttggaaattacaagcaactgaatagctcattccaaaatatgcagaaatctctgaaatcatacatactttttatgttagcaaaacttaagtgcaaggagtcataatttaggtttatttaaagaatgtctccagtcttgaaataacctgggtgataaaataataatacaatctttacttttatctacttgtttctctttaattttagcacatttaatatgacgtaaagtaaaatataacagttcttcaatacatatttttcagaactaaataacatttaagggagatatcctgatagtcttcaaaatattttcaccttagattacatatcattattttttggtattaatttctaatttaaagctatttttccacttaggatcctagtttttatttaaattttatttaatttttatctcctcttttttcatctattgttttacagatcgcttacaataattttccctcagtgcatagaaaggagtgagcttgacaaccacccacccccttgaaaatcaatagaagttgtcttttataataaagctctcccttatttactggagaagtgaagctaagtatacagatgcatcagcctgagtcagaaagagaagcagatattgttcagcaggaagccaggatagtgggatttccaacttcctctaggtcgttttgtgaaaggtggtatcattttatgttaagacaaattcccagaaatgttaccaccctccacacacacacacacacacacacacacacacacggaggcaaggaggaggctactgtgcctgggcacttgcctaggcattgcctgaaaattacagataattgtcactaaccaatctaattgcaactgttaaaagaaataaccctcaattcagagttatttcctattcaaatgcaatacaatttttgtttctaatatattaggttgcacagaaacactaagattgtacttaaatatggactgaggaccattttaaacattacagtaaagtagtgatcacaatttcatctggttatattaaaagtgttctggaatggtattgggaattgattttttctttttttgagatggggctctcactatgttgcccagggtggtctctatcttctgggatcaagtgatccttctgcctcagtttcccatgtagctggtactactggtgcatgccactgtgtctgtcacattttttaaaatcataaactgattctaaattataaataaatcaagaggaaaggcagaggacttactatgctgctatcttgacaacatcaaagtaattaatccccaaaagtttattcaaaaatcacaagttgtttccatcttagacccaatttctgtaccaaataaagcctattttactccataatgaaaagtacagataatgaaaagtacagagcccaatgatgcttaaatgatgctatgtaatctaatagctttgatgagtcagtttccaagatatataattatattcaaagagttctgtctggttctgttgatactacaatcaaattcttccttcgctgcagacaacaacttgtacttaagcagaagctgagtcatgccccccactatacgcctctaacaacagatatgcaaaagtcttagagctaaatgtctgagtggtcctgttttataacagatcaatagttcctgaaattagtatttgccttccaggctaaaatattttttctacagtgttccaaatattcttgcatttcttaaagtcattgtcataaatagcaatgatgctttgataatcctgataacaaactacttccaaactgcagcaacagaaggaaagtggtaggatatacagaaaatcttttgagaaatccagagaggactgatactagacataaaagcaataacctgtggcttttcaagaagagaagcacatttcttcccaattaaaactaggaattctcaacagatatagttcactttcaagtgactagaattgtcgcattccttataatatcaaatgaaatattctttgtttcctatgttcaccggctccttggtcacacttactatttgagcagaacagtccaacatacatcgagaaggcacagtcacaagcgatccctctgcgtttctctcacatctccctcggaggtgacacatgtggccatagctatgcagtgtccagcatgcccttgctccactcttggagtcactgtggctctttctttcagatccgggatcgtccctttcaactgcagaaaatgaatgcattccagaaagcctgggtctgctggccatttcacctgcaagggaagcactgcaaatacaaacacattcctttgtgttttattcaagatttcatcaccctgtcaaactgaggccttatggagaatagcagaaactgtgatcactcaaaaggtctcaagaacaaatataattttggaaacatacatttaatgaaatgttaagtaatggcaaattacttcatttatttatttactatatatattcatattttacttgacacataataattgtacatatttatggggtacagtgggatatttcagtagatgtatacaatgcataatgatcaaatcggggtaattagcatgtccatcacctcaaacctttatcatttctttgtgttggtaacatgaaaaaccctctctcccagctatctgaaaaaaaagacaatacactgttgtttactgtggttaccctatagtgctgtacaacactagaacttattccaccaactaactgtaatgttgtggaagacaatactgaccacatttgtgaaatattatcctaatatgaatgataattataggtggggttttatgctaacatagctgccaagaactccataaatgaatgcccacaattgtaagtgagaaaacaagattattcaatttggtctgtgtgtgtgtgtgtgtgtgtgtgtgtgtgtgtgtgtttctattctcaggcagggagttggttttagttctttttttaagaggcccaaactcatgctactgtaagaattaactgcaagttaattattgcaagttgaagttatttataagactatggtatgtatatgcagacacacaattctgaattcactgtgtaatattagtactcaaaatcatatatattgtacaggagaacaacctgtgtgataattcatgagttatctcagtctctaattggacagtacaattatttactttaaaatagattagaaatcaccaacagagagctttttttttaaactaaatgcaagcagagtaaaaagaaatgtagagtagaaagaaatgaagcaaaatataggtcttcctttgggaaaaaagtcaagacacaaaagcagttgaagaggtgtctttcatttcctagagtgatacacatatttagtagttcagtagttaatttttgttcaacagccatattgaggctttattggcatataatgaacacacatgcttaaagtgcaggacttgttaaatttttacttatgtatacaaccatgaaactatcatcacaattaaaataaggaatatatccatcaacctagcaaaatattctcctccctcttgataacccctcccccataacctccctgcttccctcaaatccctggcaaccacagatctgatctctctcatgattagtttctattttccagaatgtcatataaatggaaccacatagtatttacttttctttatctggcttttttctttcaacagaattattctgaaattcattaatgtgtgatatgtatcaatagttcattcctttttattgctgagtagtatctcgttgtgtgaatatagctcaatttgtgtgttcattcatttgaagatgggcatttgaattgtgtccagttttcatctgttataaataagctactatgaccacttatgcacagatggtcatatgaaaatatcctttcatttctcttgggtaaatatctagacaagaatagctatgtcatatggtaggtatctgtttaacatttaagaaactgccaaattgttttgcagaatgtttgtctttatgccaaattgctttggttgattttattatggtaatctaaacttgaattactggtataagtcaattttttgaaactttgttaagatttttttgcatctgtggtcatgaaggactgtatttttactttttaaaaatgtctgtctaggttgggcatggtggctcacgcccataatcccagcactttgggaggtcaaggtgggtggatcatgaggtcaggaggtcgagaccagcctggccaacatgacgaaaccctgtctctactaaaaatacaaaaaattagcagggcatggtggtgggcacctgtaatcccacctactcaggaggctgaggcaggagaatcacttgaacccaggaggtggaggttgcagtgagccaagatcacgccactgcactccagcctgggtgacagagcgagactccgtctcaaaaaagaaaaaaaaaagtctgtctgaatgtggtgtcagaataatgctggacttgtagaatgagttcaaaagtattctctcctcttcaattttctgaatgagtttatgtttatttgttatttcttccttaaattgctagaaaactccagcgaagccatctgggcctggaatttttttgtgggaaggtttttaacaataaactcaatctaattaatagactattcatgtcatctatttcttcttgagtcagtattagtagtttacatctttcaaggaatttgtctttacttctaagctgtcaagcatactggcatacagctttgcattgtaatctcttattatgccttttaatatatgtaatgtatgtagtgagatcacctctctcattactgatgttggtaaattttgtctttttttctctcattgatggcagcagctgcagccatcatgcaggcgacagcagggaggcatggctgggcctgcatactccatgaagctggtgggagccccaccccttctgagttggggtatgagttctctggtgtggctgcagacccaggcctcctgctctatggagcaggctgtagcccagcccaaactgcagctgtggatccaagcttccctgtgctcttggagggggctgggaaccgacaggatctgccctcctgggtacagctgcagccacccaacccactgctgcagacctgggcttccggctccatggagcaggaaggagacggagacaagcagaagccccgccccttctgagttggctgggtgggagctccctgggtgcaactgaggccaccgtctcaggcgcaggaccctggcatcttggcagcctgcacctgccaccccctgctggctctgggatgtctgctctcactgcctggcctctctcctcttctggcacccgctttaatctcccaacagggttggtcaagccctggggccttgaatggcagggggagggagagtcctgggcagaagcagatgggtccccagtaaagccccaccttcaagccggggagggcctgaaggctgggagccagactgccaatcctgtggacaggactggggatctgtccctcctctgggccaccaatggctgctcatggaccaattggcaggtacttcctcccctctgaggtccataaaagccctgggctctaccagagagggcagaggacagagagacgatgggacgaccagctgcagagacgaactctcccctctactgagagcttcagagacctgcagagacctccaaatgaccagcctgcagagaggagccacactcgccagggcctcctctctgctgaaagctgaacactccaccggacgacctgcctgcagagaggagctacccactgtgcgtcttctctgagctgttctaacactaaataaaactcctcttaatcttcttcgcccttcctttgtctgcatacctcattcctcctggatgcaggacaagaactcaggcaaagatgccactgtccacagaggtttctgggcaagaaaatcaaaaccccaaagatcctgtaacatcatgattggctgtctccacatttacatcatacaattcaattacaaaccactgcaaagcagcacttattgatgaagagctggctcgtgagctgtaagtggacatgccatcagtggtggcaggttgtagcttattaacttgaaatgatactttttttacattcctctctgccctcacatggtgctaataattgtcataaaagggagtatatgactccaccatgacctcaaaaggcctattcctcatcttaaaggaaaatgtcactttcctggtgctagaaattgtagatatgagagttgctcaagttcatttatagtgaagaaaatttaatagtgtatttatacaagcctaacactatgaaatgcatttatttattaaatactatggaaggagctaatggcagtgatccagaaaacatatccttttcagttgagatagaagagcaaaagaaatctctattcctattgcagagaaaaaatagtaaatatatttgctcataacaacataactaaactgtttgtggcttaataaataaaaatatagttatttaaaggtggttcaaggtttcctatataatcttacattccccaaatgtgaatttgcacagtaatgaattaaaaataaaacaaagcaatattacttgtcaattcaatcaaataactttgtaatttagcagaaaataaattgcaccagtttggtttaaagccctaactacacatctatagtttccttaaattaattaaaagaagtcatgcaattttcacagaatatcacatgcatgttatccattttaatttctcttaaaaatgggttagttgccattatcaaactttagacaagaaatcaaacagataaagtaacaatgaaagcaacttagacattagctgaagggtttattcttaattgctgagtacccatgctttatccacaaagggtgatttaccatttctgtaaactgatagtgagttattcaaaatggaaattaagaatacaatcccggctgggtgcggcagtcacgcctgtaatcccagcactttgggaagccgaggtgggcagatcacctgaagtcaggaattagagtgaccagcctgatcaacatggtaaaaccctgtctctactaaaaaatacaaaaaaaattagccgggcatgatggcgggtgcctgtaatcccagctactcgggagcctgaagcaggagaatcgcttgaacctgggaggcagaaaaaaaaaaaagaatgcaatccaattacaatagcaacaaaaaacttataaaatacttaggcgtaaatttaaccaaggaggtgaaaaactgtacactgaaaactataaaacactgatgaaagaaaatggaagaaaacacaaataaatggaaagatattttatgtccacaaagtagaacaattaatagtttagtttttatttttaatttttatgaaaacataacagttgtacatatttatagagtacctgtgatattttgatacaagcatacagtgtgtaatgatcagatatgggtaactgggatattcattacctcaaacatttattgttttcttgtgttgagaacgttgtgaaatacaaaataaattactgttaactatagttgccctattgtgctaccaaacactagatcttactccttctatctatctaactgtattttatatccattaaccaaccccttttcgagccctcctcccactacccttcccagtttttgctaaacaccattctgttcactacctcccatttttttagcccacacatatgagtaaaatcatgatatttgtctttctgcatctggcttatttcacttaacataatgtcctccaattccatctatgttgctacaaatgacagaatttcattctttcttctggctgaataatattccattgtgtatatataccacatttcctttatccattcattcattgatggatacttaggttgattccatattttggctattgtgaatagtgctgctgcaataaacatgggaatgtagatatctctctgatacactgagttcttatcttttggccatataccaactagtgggattgctggatcatatggtagttctatggttagttttattgacaaatctccacagtgcttttcagtgtggcgatttccagtagctgtacgaatttacattcctaccagcagtgtatgagtacttccctttctccacatcctccttatcatttgtcattttctgtctttttgataatagccactttaactggggtgcaaggatatctcattgtgattttgatttgcatttctgtgatcatcaatcatgttgagcattttttcatttatgtgttggccatttgattttcttcttttgagaaatatgtctattcagatcttttgcccctttcaaaatcagagtatttgttgttgtttttttttttttgctattgagttgtttgagcatcatggtgtattctgattattaatcccttatcagatgaatactttgcaaatattttctcccattctgtaggttgtctcttcacactgttgattttttcctttcctgtgcagaagctttttcactcgatgtaatcccatttgtcaatttttgctgtggtttcctgtgcttttgaggtcttactcaataaatctttgctcggaccaatgtcctgaaggattttacctaagttttgttctagtaggttcacagttttgaggcttacatttaactctgcaatccattttgagttgatttttgtatatggtgagagatcagggtcaagttccactcttctgcatatggttactcagttttcccagcaccatttattaaagatactgttgtttctccagtgtatgttcttatggcctttgatgaaaatcagttggctataaatacatggatttgtttctgtgttctctatttcgttcctttggtgtatatgtctgtttttatgccataaacatgctttttattttttatcactgcagctttgtagtatattttgaagtcagatagtgtgatgtctccagctttgttctttttgttcagggttgctttgtatattcaggcttttttgtgatttcacatgaattttaggcttgctttttctatatctatgaagaatgtcacttgataggaattgtcttgagtctatagttaacattgggtagtatggacattttaacaatattaatttttctaatcatgaatatgagtttttttattttttgttacctcttcaatttcttttatcagtgttttacagttttgattgtacagatcttttacctctttggttaaatttactcctaggcattttatatttgtgtagctaaggtgaatgggattgcttccttgattttcagattgttcactattggcatatagaaacgctactggtttttgtatgttgattttgtattctgccactttgctgaaatagttaaccagttgtaacagctttttagtgaagtctttaggttatcctaaatataagatcatgtcatttgcaaacagtgacaatttgacttcctcttttccaatgctctttatttcttttttaatagctctgtctaggactctttcaccacttttcaataaaagaaaacgatgtgattgaccatttttcaataaaagtggtgaaagtaaatatccttgtcttgttctagatcttagaggaaggatcttagggaaagtgaatatctttgtcttgttctatgttagagaaaaggctttcaacttttccctattcagtacgatgttaactgtgggtttatcatatacgaacattaatgttttaaggtatgttctttttatacctaatttgttgagagggtttttttttaatcacaaagaggagttgaattttatcaaatactacttctgtgtctattgagataatcacaaggttttgttctttattctcttgatgtgatgtatgtgatgtatcacatttattgatatttgtaggttgaaacatccttgcatccctgggggaaaataccacctgatcatggtgtataatcttttttctgtgctgttggattttgttttctagggtttttttttagaagagttttgcatttatgctcattaaaaatattggcctatagttttcttttgttgtgtccttgtctggttttggtatcagggtaatgctggccttaaaaaagatttggaagcattctctcccctttgatttttcaaaacagtttgagaataattggcattagcttatctttaaaagttaggtaggattcatctgtaaagccatatggtcctagacttttctttgttagactttttattactgattcaatcacattattcattattgttctattcaggtttcctgtttcttcatggttcaatcttggtaggttatatgtgtccaagaatatatctattttataagttttcaatttgttgatgtaaattgttcataatggtctgtaatgatcttttgtatttctgttttatcagttgtaatatctcctttttatctctgattctattccattgagtttttcttttcattagtctacctaaagatttgttgattttgtctaccttttcaaaacaatattttcatttggttgatctttcatatttttagtctcaattttatttatttttgttgtgatctttggtatttcttcttcctgtaattttgggtttgatttattcttgcttttctagtttcatgaggtgcatcattatatttgaaatatttctacctttttatataggcatttatttctataaactacccctcttagtactgctactgcttttgacatataacgtaaattttggtatgttgtgtttctatttttatttgttttaagaaattcttaaatattctttttaatttcattatttgcccattggttgttcaggatcatgttgtattggtgcattttccaaagttcctcttgttattgatttctagttttattccattgtggtcaaaaaagatacttgatgtgattttaatttttaaaaatgtgttgagacttgttttgtggcctaacatatggtctatgctgaagaatgctccatgtgctcatgagaagaatatatacacgttctcccgctgttgaatgacattttctgtaaaagttaggtttatttgctctagagtgtagtttaactccaatgttcctttgctgattttctctttggatgatctgttcggtgctgaaagtagggtgttgaagtctcctattattgaaatgcagtctgtctctccctttagatctagtatttgctctggtgttgggtgggtgtatactcataattgttataccttcttgctgaattgaggatctttttatcattatataataacctcctttgtctctttttaggatttctaatgtgaagtctattttatctgataaaactacaactactgctgctttcttttgctttccatttgcgtggaatatcttcatgtgtccttacgggtgaggtgagtcttttgtaggcagcatatagctgggtctttaaaaaaatacctcatttagccactatgtatcttttaactgcagaatttaatccatttacattctaggttattattgacacgtatgaacttactcttgccattgttaaagagttttctagttgctttgtagagcctttggtcccttcttcctctcttgctttcttctcttgtggcttcatggctctctgtagtagtatgttttggttcttttccttttatcttttgtgtatccattacaggttttgctttgtgactaccctgtggcttacataaaacatgttatacttataacaggttaatttaagctgataacagttaattttgattgcatacacaaacttttcactctaacttccttttctcccatgtttgatgtttttgatgtcacaccttacatctttttataataacaaaaataacataagtaataatttcatataaaataatataaataaaaataataggtctcctcagccactcaggcctttgctgctcctccagagagggacttgcaaacatttaaagaatttgcatgccatagacaaggccaggaagaactgtgactggattcacaagcccttcccaggccttactgggcatccttacctggtgcccacaaacagggagtacttagaacatattttctggtgcctctgatgacaggcactgctttggactggagtggaaagtagggcaccaaccattcctggggccttcactttatagccagatgcagtcctccccccaaccaggggtcttaagaaactttttggagactcattgggccaaccagacccatgcaacaaggtacccttctcaggccttcatacctggccccatctgagcagcccccaaggccttcctgaccactggctcccatccaggctctccccagttccatggtccattcagatttgtcctggcctccagagaggggtttagatacaattttgcagggtgcctcctatgaccaatccccactcagtccaccaggtggaagggatgccctccctggcctccatgactagttagggaatgtctcagctagctaatttgaaaagagaaacgttttcgggagtgctgtatgcatctgtgctccagacaaaactgtagccatgacagagacccttcctggaggctccctgtccagctttgactgatctctgtaggaaatacagactttcccataggggaagtgagaaactcttggaggcattagctgtatttttgttttcatgtagttcaaagaattattttaatttctgttgagatttcttcttgacccttatgttatttagacgtgtatttctgaatatccaagtattttgagattgcccagctatcattctattactggtttgtataataggttccagtgttttcagagagcaggtatggcatggtttttatactttgaaatgtgttaaggtgggctttatggcccagaatgtggcctatcttggtgaatgctccatgtgagagtgaaaagaatatgtattctgctgtcattacactaagtaggctacagatgtgaattacttccagttctttgatgatgctgtttagttctaccatattttattgatattctatctattggatctctccatttctggtagagggtgttgatgtttacaactatgattgtgaattcttttatttatccttgcagttctatcagtttttttgcctcacatattttaacactcttgttaggtgcacacacattaagaattgttatattttctcagataattcactttttgttatcaagcagtgcctatattcatccagaattatcttttctctccgaagtctactttgtctgaaaactaatatagctgtttcagctttattttaattattgttaaccttgtatatctttttccatttcctacttcaaatctatatgtctttgcatttaaagtgagtttcttttaaacaatgtatagttgggtcttttttgtgggggatcaactcagatgaactcagtctttaattggtgtgtgtagaccattgacattaaaggtgattacagatgcagttagattggtatttatcatgtctgttattattctctatttgttgtccttttttttcttcctatttttgccttccactcttttcctgccttttgtggttttaattgagcattttatatggttccattttctttcccatttaagcatgtaaattcttcctttctttttactgtcaaaaaatctttctattggttgccctagattttgcaatgtacatttaccattagtacaagtctactttcaagtaatactatattgctttatgagtagtgcaagtattttataataacaaaatatttctaactcttccctcctatagtttatatcattgctattattcgtttcacttatcaataaattataaacatctaataactattgctatcattattttgaacaaattatttattagctgctatatcaattgaaaataagaaaatgcaaagtttttacttcacattcatatattcattttttatattcttcctttatgtagatccaaatgtcttacttttctcttaagaacttcttttaacttattccaacatttcttgcatgcaggtctaccagcaacaaattgcctcaatttttgttttctacaaaagtctcttccaggcacggtagctcacagctgtaatcccagcactttgggaggccaaggcaggtggatcacttgaggtcagcagttcaagaccggcctggccaacatggtgaaaacccacctctactaaaaatacaaaaattagctgggcgtggtggtgtgtgcagccaagatcacgccattgcactctgcaccccagcctgggtgacagagtgagtctccatctcagaaaggaaaaaaaaaagtatttatttctccttcacttttgaagactattttgtctaaggcattcatggtatcgcactatgattctaatttgcattctcatgaatttgctattttcatttactatttcatcatggacatctttccatgttaatacatgtaagtctaccgccctgaagaaataaaccaaaacataaattaacggtattgtatagatgtaccagaattttttaaacctggcttttctgaatggctatgttttctttattttttgttatgacaagtaatggtgaaatcagtattcttatcatcacacatgtatttgcaccgatgttccccacacccatttgttgtcatttgactttgtcctggtacgtgcacagataaattttctttaaactttatgctatcaagttaatcaatcgtgtccttgatggctttcgagttgtctttgttgtatacatgcctttttatttttattttaagagacagcggtctatttatgttgcccaggctggtctcaaactgctagcctcaagcgatcctctcgcctcagcctcccaagtcgctaggattacaggcgtgaacaaccgtgacgggctctgttctatgctttaaagatcttctctgttcagaaattttaaaattaaagtgttttcaacaaagctttcatggttgcagtttttcatcgcatacctgagggcgcggtattttctaagtccacttgcgaggctctggaaagcccggcctggcagggcgcccggcccgcaggctcgcggttagcttttccacgggccagactgggagtcacgtagggagagtctgtattctttattcttcccagcagtcagccttcccttatgctgctggggacgcgtcatggtgacctggagctccgagaggagccggacgctctccacccacccatgtctgaaaagcgatccgacgtggactgcagccgtttgcgccggttgtcgggctccacctggcggcggatgttatgtattgcacttgttctctggagctcccgtgagagagagaagtggccgctgtgcaccgggtcgagttccaggatgtccctagcgttagcaggattgttccgcctgctggcagagcattcgctccccatctgttcgtgggagcttggacctgcagcttaagctcggaggaggctcttgcctcgctcttagccctggatgctctgtggtggggcaacatgcgggtcgaccagcaacccccagtgcctgcccctccaacacaagacctatcggggtcaacacgaaccatcttgaaagggtgtttggaggcctccccgcgtgtgtccccataccagtaccttccatttgaccccattttcctcaagttctgcctcagaggtggcaaccggcagctgtactcagaggacggcggaggggtctccaccagcctggactaggtcccgcgtcggaccgcctcctcagacctgccttttccgaggtccgcttgggaggtgacaaaggactggagaagaaccaggtgccccggggagggtgtctcagattctgtctgtgtggagcaggacccttatgtttttggcctcttcccacataccttaacctcttcccaaatactgggaatcccagggttcatttggctgccgaaactgtccaagctctaggctgcaggcaccaacctattccagtatagtcctttgctccaggacacctgggccgctttcctgagggaagaacattctctttatcaggcagagaccctggccacccatgccattcacaagctgttcctgccagatctgccggcactcagtcatcctgggccatcaggctagtgagttccgggagatggtgagtgctcaggtgtgtgtgtggccggccagaggtgtcagagccccaagtagctgggaagtagccagaggaaagccaagtccccagtcatctgatgctaacctcgaaattctcatccttctccttcctcgtgcattgctccttccaggcattctttaatcacagctgtgttggaggctgggattccaggcccagcactaacagggtacagccacagctgcagcatctcacagtgacctagagcctggcccagctacccaactcaggcagttcatctagcacagcatccctgggaggtggccactgtgagattcacttcggattaggaactgaggctccaaagccacaaatgacttgcccaacatcaggcagaaggattagaatttaggtctgctggcctctaaagctgtctctcaaagaatagaccatcaaccaaggagacagcttatttccaggtaatacaatgaagtaacgtaactacaaagaaggatgagtaatcatggtgggggcaggatgggggggggctgtccctgcatctgtctcttctcttcctcctgcccccaggcccagccactgaacacgctcctggaccttgacgtgctgggcttccatgttgtcctgtcttggctcagacaccacagaaggatcactccccttccagtgataatggagttcttcattactaaagtgtacagtcatgaaatccattactaaccctgagactctcaggcaagaggtgacaggtcagctaagtgggagaacagtagcaaagtctaatggaataagacggggaggcttccaatcagagaaggacagtaaacacagatacaagctgggtggcctccacacctgtattcagtcccccaaggtactgtggggaagaagacatctgcaactcagtaaaatcacatctaaatccttaaaaaggattcttctcctctatacattagtcaaaaccctcatgggtactttatccagatatgaacataaaatagtattttctgcacatctaattagcaataattcaggaccattacaatagtccaggtggcgaggaccagtgagatcctttgatgcttctcttgaaaaatgtacatggtgccactttttgcagcatcatttggcaatatgtattaagaagctataaaatgtttacagcctttgacctacaaatcgtacctctgggaatttttaggaatataatattcagagatactgacaaagacctgtgtacagaatgttcgttgcaaaccagctctgttctatgctttaaagagcccattattcacaatagctgaaaattggaagcagcttccatgaccaatgaataggaaaaaagtagagaaaatcgctggggtggggggactctacaataaaaatcataatgctttccaaatgttttagaaagaatgttgatgctacgggggaaatgagggagcttcctaatgaagcatattaaacttaatagatctcaaaggcgactcttgttttcacactcaaatatggctcttccttttcttctctcagtgaaaagcactgagttgggaaaagtccccatcttctcccagtttctcaagtcaaaaatctagaatttgttcttgattctttcctttctctctcactggacagccactgctacaatcagtcctgctggggctgctttcaaatgaatacctctgggccatccccttccctatcttcaccctcccccttcctcatcttcctctcctccctcttcctccctccttgtcccttatctactccctcctctccttgcccttctcttcatctcccttcccctattactccctcctctccctatctgctcctgtccctccccttcccaccccaccttacccggccatcacttcattctcactaggtctcctctctcagggatgaccccaatgtccttctgctacttgaggggctcccagcttccttctttagcccagagccccttctgtgcccacaaccagaagcctcccgtggaatgtaagtccttcactcactccctgttggactccccaccagtggattccttgctacttagagcaaaacacaaagctcttcctgtggaactgagcttcgactggtgggggacataagaggcagccactggtccaaccagccaaggcctaaagcttgcagaagagaaattctcattagcagaattttcagtcgttggagctgagctgcaggatgtttgagtgtggacacctagcacaaaatgtaccaatggggggctggtccgagtcttcagtcccctaccatgctccccacctctactatgtgctcctgtcactctagcttccttctgcatggaatgcctcctttctgttttctgtggtcacacctctgcactgagccccatgagacccaccaacttcagaagctgcccctgacacctctggcagtaggcaggtgtgtcctgtgctgtccatgcccttcctttgtacctataagctggtgactctgttctgtagatagttaggtccctgtctcatcttcccagccggactgtgaggtattcatggtgggatctatgtctgatccatctcagggagtcccgtggagcttgacctaatgcccggcatgtgggaatcccggagaggaaacagcatgtgcaaatgctggagatctgatggcacctgtggcaatacggaagattccatgtgtgtaaagggcaacaaaatagagcagtattagataaaataaatattcttgagtgcatactgatataaataaatgattaaataagttaatgaatgagggaaaggagataaatttcccatgcaggatttcaaatgaattatgttatatattccatcccaaaggagagcgagaataactccccactccttaagtgtgggctgcacacagtgacttagtctccaaagaggacagtatggaatagagggaaaaagagaaactacagtggagaatcctgatgagcactacctctgccaggtctttagtgatgtcagtcatcccctttttatattcataattttctcttttttcccagtcaatccagctggagatttgtcattttcattgatttttcccaaagaacacgtttttggattcactgatttttttccttttcctatttcattgattcccattttgatctttattattccttttctgctggttactttagatttaatttgctcttcctcatatatattttgagacagagtcttgttctgttgcccaggctagagtacagtggcacaatctcggctcactgcaaccgccacctcctgggttcaagtgactctcatgcctcagcctcccaagtagctgggattacaggtgccagccaccatagccagctaatttttgtatttttagtagagacggagtttcaccacgttgggcaggctggtctcgaactcccaacctcaggtgatctgccgaccacgaccttccccaagtgttaggattacaggcatgagccactatgcctgggcgatattcttaaattagaaactgaggttgctgatctgagactcttcttcttttctaatacagtaatatcataaatttcccttcaggtactgcttcagtgacaatcgacaaattctatgttgtttttctatttccaataacttcaaatgaagtttttctaaaattcctttagatttcttctttgacctatgagttatttagaagtgagttaatttccaaatacttggggatttttaaaggatcttcctgttaccggtttttcattttatttcattgtcgtctgagaacatactttgtagttgaatactttttaatttatagaggtttttaatgggctataatgtggtctatctccataaatgttccatgcacagttgagaaaatgtgtattttgcttttatagggtggagtattctataaatataaatcaggtcaagttggttgatggtgttgttcaagtccaatacattcttgctgatttattgcctatttattctatgaactgttgagagagggactaaaatctctgatggttatctctatctctacgtattgttttattacttttcttcatacattttgaagctttgttattaggtacaaaaacacataggtttgttatgtcttcgtctttaactaaccacattatcagtaagaaataatctctttaatccctggtaatagtctttgctctgaagtctattttggcattcgtatagccacctcagctttcttttgactagtcttggcatggtatatctttctccatctttttacatctaacctgtttgcatctttatatttaaactacatttcttggccaggtgtggtggctcacacctgtaatctcagcactttgggaggccaaggcaggtggatcacctgatttcaggagtttgagaccagcctggccaagatggtgaaactctgtctctactaaaaatacaaaaattaccggggtgtggtggtgggggcctgtattcctagctatttgggaggctgaggctggagaatcgcttgaacccgggaggcagaggttgcagtgagaccgcaccattgcactccattgcactccagcctgggcaacaggaacaaaactccatctccaaaaataagtaaataaataaagtacacttcttgtaagcaaaatacaaccaactttaaaaatatccaatctgacaacctgtcttctaaatcaatttaaatgtaatgtaattcctaatatggttgagtctcttatcttgctattgttttctactcatcccatctgtcctttattctcttttacatctttttctgtcttcttttggatttacccaatatatttttatgattccacttgatctcctttgttagtttaatagctgtaatcttttggtttgttatcttagccgtggctccagggtttacagtgtacacctttaacggatcacagccgaccttcaggtgacagtagatcacatcatgtacagtttaagaatctgagaatagcaaacttctccccttttagtctttaagctcttattgtcatccattttacttttacatgtattgaaaagtgcatattactttattttctaaacaattatcttttagagaagtttaaataatagtaaagtatatatccatgtcgttactatttctggtatagatacacgatgttactatttctggtgtagatcatttctttgtgtggatccagatttccatctggtattgttacgggatccttgcggtattacttcatcagccaaaagcctctatggccagtggcgcctttgcccgagttttgatctggatcgcaggtctcgttccacccactcggcctggcagtctgcgctcagctcccactatgagcctggatcgcatgtctgccaagggtgagccaggcacggagcagcaaggggtgtgtgagcaatcatggggtccggccactgcacacagccaggcatgccagctgagggtggataggcgatgggcaggcagcttcaggcactggcacgggtgccagctccatgcaaggctgcagctagaccaggcataccataagcagcttccacggctgacaccagggaatgtggtggtgcccagaaccttggagatgccaggaacccacagagccctaaacagggtgtcacagccctggctcagggatttcctaggtctgggctccatgaagagccacagctctttcctccttctctcttctcgttgcctgcaatgtgacaaacaagggacatgtttcagcactgtttgtgttatagctattttagctccgccattcagcaggtctccaggtcttgttctgcgtccaggaagaatgatatatgcagacaagtggaaggtgaacaagatgaagaggagctttactgagagataagacagctcagaggagacccacagtgggtaactcctctccatagccagggtgtcctgttgagtgctgagctctcagcagagagggcagctcctctctgcaggcaggtcatcttgttgtctcttcagctctcagcagagagggtagctcctccctgaagactggcggcccaccccccaggcttcagccccaccccagcttgcaggtggggcttcattgggaacctgcccccttccacccaagagcctgtttgcctcctggcattgttcatggcacccaggttattcatgccaaggagtacctgtaggccagtgccaagctgtcctcagccccacttcagcctccttcccatgcttgtcagcctccacagtccgaagggggccaaggggttgacatgtcagcactaccccaagcatgcacacatgcagctgggatgcgaaagtgctgagagagagacagtgccccaggttgtgatctgtgacgggagcagatgctaacagtgaggagatcccagacagtgggagcaggcacttcctagcctgcagggacaggggtgccttcctgggcccccaagagtacaaagattcctgggtccacagctgcagcttgagtggctgccgctgcacttgggagggcagggttcctgcctactcttggctcccaagagcacaggagtgccctggtagcagccacagcttgggtggctgcagttgcgcctgggaagctcccactctaccaactttctggcttaataaagcacgcagccctggccataccactggtctgcattttccccttagtggcagcaggcaaggtgcgggtggctggtggcctcagccaaccccgcgcaaacaaacccaatgctcctggggcctccctcccccccgcccacgagtcctggctgcactatcagctcacaggctcctgagactcagcagacagtgaggttgaaggtgcggcggaggttctgggcctgcagcgggtcctgcctagttgtgcaagggttggggtggtgcagtcagctgcctcagggatgtagggcacaggggacccaccactaccactgctgctcccacagccactcctgccaccaccacttgtgcctccactctgcagctggtgtgataacagtggctgctccagatggcacactgctgccattagtatccttttctttatgcctgaaggacatcccttaactttttttatagtgcaggtctccaggtagtaaattcgttcagctttttcgagtctgaaaacttctttatttcttcatctattattctctttttgatgaccgttagttaagccaatccattgaactttccatttcaattacgatacttttcatttcgtttccacttggtacttttcccaatctatttggttattttcatgctcaagttatttcaactcctttgtttctttaagtataaaacacactttgtactgtctttgctaacttgactgtcttaagtttttgcaggcctgctccttctgtccattgtttctggtggctcttgccaatttaacatttgtgattttttattgtgaacttatattccttgaaagtatctcagagttcctccaaagacaatccattttgcatctgtcagtcacctagaaggcaccaaaaagctgatattgctgtaaattttaagcttgagacattttagaccacccggcttgggtgaacaaatcagttaaaggactatataaatatatatatgtgtgtgtgtgtgtatatatatgtgtatatatatatatacatatatatgtatatatatgtatatatatacatatatatgtatatatatgtatatatatgtatatacatatatatgtatatatatgtatatatatgtgtatatatacatatatatgtatatatatgtatatatatatgtatatatatgtatatatatacatatatatgtatatatatgtatatatatacatatatatgtatatatatgtatatatatatgtatgtatatatatacatatatatgtatatatatgtatatatatacacacacacacacatatatatatacataaaactctcaggggagatgttttctctcaggatacccaatgttcctcactgttcctagggaagcaggggtcaagggcagcatacagggggaggcggacaggtttattcatagttcacccttacactaagtctgtccttttggatctcactttatgatgtctccttttagcccctcccacttggccaggccctcagctttgtcagctgttctgctgccccttttccacctcaggctgtgaaaaacagcaaagtttagtttgacaggcaaatatcttaagggtgaaaagtggcatcagtgccttagttacttctttgggtttcacttccattttaaaacttttttagctttttggaactcttattttgtagctcattgacacatttttaagaggttcttgatatgttttccagaagcttaagttgttttcagctggtccttatcagccctactgttggaaataaaattctttcaacttgttctttagcaatgtacaggctccatagagctctcgctgctcctgaggcaacagggtaagaacgccacttaggaatcaggctggcctgagatcaagtctcagatccaccagcagtgtgacatcagtgcctcgctttctttatagggttggtgatatggtttggctctgagtccccagccaaatgtcatgtcgaattgtaatttccaattacaattggaaattgaatcttacaattggaaattgattattgaatcataggggtggacatcccccttgctgttcttgtgataggactctcatgagatctggttgtttaatactgtatagtaacttcccctgtgctcctgctgtccatatgaagatatgcttccttccctttcaccttccaccatgattgtaggtttcccgaggcctcctcagccatgcttcctttacagcttgtggaaccatgagccaattaaacctttttttctttataaattacccaatctcaggtacttctttatagcaatgtgagaacaaactaatacagaaaattggtaccagagaagtagggcattgctacaaagatacctgaaactgtggaagcgactttggaactgggtaataggcagaggttggaacagtttggaaggtttataagaagatacgaagatgatggctgggcatggtagctcatgcctgtaatcccagcactttgggagagtgaggcaggtggatcatttgaggtcaggggttcaaagccagccaggccaacatggtgaaactctgtctctactaaaaatagaaaaaaaaattaggcgggcatcatggcacatgcctgtaatcccagctactcaggaagctgaggtaggaggatcatttgaacccaggaggcagaggttgcagtgagccaagattgtgccactgcattccagcctggataacagagtgagacttcatctgaaaaaaacaaaaatgaaaacaaaacaaaaaaacagaagacaggaagaaaagtttggaacttcctagagacttgctgaatggttgtgaccgaaatgctcatatagtgatatggacagtgaaatccaggctgaggtggtcccagatggaggtgaggaacttattgggaactggagtttgcagtcactcttgctatgttttagcaaggagattggtggcattgtgctcctactctagggatctgtggaacttcgaacttgagatgatttagggcatctggcagaagaaatttctaaatttctaaacagcaaagcattcaagatgtaacttggctgcttctaacagcatatgctcatatgcattcacaaagagatggtctgaaattggaacttatatttaaaagggaagcagagcataaaagattggaaaatttgcagcctgaccatgtggtagaaaagaaaaaccaaatttctggtaagacattcaactcagctgcaggaatttccataagtaaagaggagcagaatgtgaatagccaagacaatggggaaaatgcctccaggacatttcagagatcttcacagtagcccttcccatcacaggcctgaaagattaggagggaaaaatggtttcgtggcctaggcccaggaccccactgttgtgtacagcctcgggacatgtcacccggaatcccagctgctccagctccagctgtggctaaaagggccccagatacatctcaggccactgcatcagagggtgcagccataagaagcctttgtggcttccatgtggttttaagcttacaggtgcaaggaaggcaagagttgaggcttgggagtttccacctagattgtaaaggttgtatgataatgcctggatgcccaggaggaagtctgctgtagggtcagagccctcatggagagcctttactaaagcagtctggaggtgaaatgtgggtttggaggccccactcaatgtccgcactggggcactgcctagtggagctgtgagaagagggccactgtcctgcaggccagagaatggtagatccactgaaagctttcactgtgtgcctggaaaagccacaggcactcaatgccagcccatggaagcagtcactggggctgtaccccgcagagccatggggcggagctgcccaaggccttgggaccccaccccttgcatcagtgtggcctggatgcacaccatgagcagtaatgggaaaattcttattgaaaaagacaagaacaaatcagcccagtgagatgaattacatgttgcactccttcctgtgatggaagaattcaacaatgacaggatcttctacattttggtttttacttttactgactcatgggcagtggccaattgcctggccatgtgactaggcagaggggcaatggcaaactgggctgtgaaaggatccccacatggagcacagcactgcaggaatttaaagggcacattaaagtaggtcatgtcaattcccacctgaagaacccctcccaggatcagtgatcagttctggtaggtggatatcctggtgaccttgaggtggccacctgggcttaatgaaggagtggacacaggggagctgcagccgtgcagagatgggctgctcagcaacacatccctcctctaccctcagaggcaccaaatgccaacaagaactgtcctacctgacagcaggaagacagagaccgcaggtggctataggacagattcccagtgggaaggcaccactcatagctaacaagtagattataccagactgaagccagtatccctgggaggctataatgggtcctgacacattctctggactgggctttgcatagttattagattcaaatgccaaaaatactataaaagagctggaacagatgataagacatcaacttggaccaccaagttttatttcttcaggccaaagaacacatttatggcccacagtgtcctataatggacataccatgttgcatattgtcttcatctcctagggctgccataacaaagtgccacaaaccatgtggctgacttacaaaacaaaatgcactgtctcacagttctggagactagaagtctgagatcaagttcttggcagggctggttccttctgagggttgtgagaaagaatctaatccacacttctctcctagcttctggtggtttgctggcaatctttggcattcctgggcttgtagaattctgccttcatattcatatggcatatcccctgtgttatctctgtgcacaaatttcccttttttataaagacacaaatcatactggattagggggcccaccctattacagcatgacctcatcttaaataattacattaacaacaaccccatttccaaataaggtcatgttcttaggtactgggggttctgagttcagcatacaaattttttatttacggtaacatatatcccttttttcagttttcattgtgttaaaacacacataaaatttaccatcttaaccattttaagtgtacaattcagtggtattaaatacattgatagtgttgtacaagtatccccacaacccatcggcaaaactctcttcatcttgtaactgaaataatatttattaaaacctaacccctaccccctcctcccagcccctggcaaccaccattctaccttctgtctatgaagttgaatattctaggcccttcatttaaatggaatcatgcagtatttgtttttgtgactggcttatttcacctagcataacgtactcaaggtgcatccatgttatagcatatgtcagaattttcttccttttggaagctgaataatattccactgtatgtatgtatatgtcagattctgtttttccattcatccctcaatgaatgcttagattatttccacttttggctattgtgtctaatgctgctatgaacatgggtgtacagatatctctttgaggccctgctttcaattattttggtattccacccagaagtggaaatgctggatcatagggtaattctgtttctaatttcttgaggaatcaccgtactgttttccatactagatgtacggttttatattcccaccagcaggaatataagcattccaaacatgaattttgtgggaacatatttcaaaccatagcagtcaccaaaagctcaagcaacaaaacaaaaaatagatcagttcgatttcattaaaaacttctgtgtttcaaagttgacatggtttggctgtgtccccacccaaatctcatcttgagttgtaactaccagaattctcatgtgttgtgggagaaacccagtggaagttgactgaattatgggggcaggtctttcttgtgctgttctcatgatagtgaatgggtctcaggagatctgatggttttaaaaatgagagtttccctgcacaagctctctctttgcctgctgccatccatttaagacgtgacttgctcctccttgcctttcatctttcaccatgattgtgtggtctccccagccacatggaactgtgagtccaataaaactccttcttttgtaaattgtccagtctcaggtatgtgtttatcagcagcatgaaaacagactaatacaatggttacataagaaaataaggacaaccacagaatgggacaaaaacttataagtcctatatctgataaggaacacatgttccagatgatataaccactcttacaactcaataaaaagaaaactcaatttaaaaatgggcaaaagatgaatagacatttcttcaaaaagatgaaaaatggccaataagcatgtgagaaggtgctcaataacattcattattagggaaatgcaaatcaaaacacaatgatacaccacttcaccccaacgagataactaaattcaaaagacaaacaataagaagtctcagcaaaaacaggaaactggataagaaccttcattcaatgctgagggaatgtaaaatcttgtctgttgtggaaaacattttggtagtttctcaaaaattaaaacagagttatcatatgatccagtaattacactccaaggtatatacttaaaagaaatgaaaccacacaaaaacgtataccttaatgttcacagcagcattattcatcatagccaaagtggaaacaagaccactcaagccagccctgcctcagaacctgacaaagttaaatggaagcctacagagctgagccacatttccatgggagacattttggtcattccaggtgatgatgaactacaccaattgttagtggctgagaagaacctcaggaatgtgccagcatcttttgacttttattttggggggctgcatctactaccacgacatgcaatatgggtaacactggcatggctgcttagatttgattacctcatgcaaataagtcatgtggtaatactgatattgatgatcaaatgtattgggagattgagttaaagtctcctcaggatgtaataccaatggaaaatgagtctttagaagaactatatttagttaaccatcacctaatttccagataaatagttctgcacaggtcatataagatacaaagagcagtatatcaagggggaggatgatcttggggactcctgaaatatactgtaaataacccagatatcctccagtaaataaatggatatacaaatgtggtatacatacatatgtacatacaatggaacgttattcagccataaacaggaatgaagtactgatacagcctacacaatgaatgaacctcaataaactgtagaatcctgctaagtgaaagaagccagtcagaaaagaccagatattggatgacacatttatataaaatgtccagaataggcaaatctagagacagaaagcagattcatggttgtcaggggttgagggaaggaggaaatgaggagtgattaagtgaattaatgcatgttaacactataaactttgggcaactgcccaatcacacagacagtgcagtctcattcatgcgttacatgacaaaacaaagagaaaagcctgggtagaaataccaacatgtatgttatgaaaaatataacacctaaataaacagagaaactatgttccttaatgagcaaattcaatattataaggttgccaattctcctcccatagtttctcaaaagttgcaatgtaatgcaattttaatccaaatggcatggttatctagacaagaaaaaaattgattgtaaaatttatatgaaataataaaggtgtgagaattgcaaggaaaattttcaaatggaaaattattacaggagaaaggagtgtggagaccttgctctgtatggtagaagtcaaagacagctaccatcaattctttcccttcctcaacacacattgcttctcaagaggtgaggaatagctcccctccccttgaatctggctgccttgcaacttgctcaatccatagaatatgacataaattccattctgggaattctactattggattatttttttttctcagatggagactcactctgttgccaggctggagtgcagtggtgcaatctcgccttactgcaacctccgcctcccaggttctagagattctcctgtctcagcctcccaagtagttgggactaccatcacacaccaccatgcccagctaatttttgtatttttttttattagagatgggtttcactatgttggccaggatggtctcaatctcttgacctcgtgatctgcctgccttggcctcccaaagtgctgggattacatgcgtgagtcatcgcgcctggcccgattttttttttttttttaaagaaactgaatcctgtattttggtctcttggtagccttgctcctgggaagctcttccttgaatctagtcaccattccattccaccaggccacatatgtcttcaggcaacaggcaacatcaattgtcagccgtgtaggtgagtttcagatgactgtggccccagctaatgcttgactatagcacatgtgagagccccatgcagaaccccctagaaccatggagagcagtcaccctgcagaaccatgagtaagttaagcttaggggtggttaattacacagaaataagtaaacagagcactccaacaggtattaaagattattacaaagattatgtaattaaaacaatacagaacagaccagggttgactacaagatcaatgggacagaataaagttacatatccaatgcctgctgctgaccacagggatttgtcacagatctcatcacttagaaaccctacagcggtttccccggtcaccttccagtcaccactacaccttggctccttttagcactcctccctagcttatcactatatgaaattgctttatctctttgtattgtctgtcacctgccaccataatgtgaatttctagacctccatagcatgtaaagctctagaacagttcttagaacacagaaggtgcttgacaaatattttctgaaagaaaaagaagatacttcaatgcctcagtttactaatgaggtggggctaccatatggctgcctgaacaaatacagcttgacattcactttcttgctagtgattgaagtgtattaacttgtgtaatcacacaactaccctacggggtaggtgcccttatttctccatttagcagaaaggggctaagtatcttaaccaaggtcacacggctttcaagtgccagagccaggactcagatctacacaggtctggctccagagcccccagtctaacctcttaacctctctgctttactgggctaaaccttcaccacctatcatatggaaaaagaaattcaatagaaatttatatggaaaaaatacaactctgtgttaatattaaaaaatccatagtaacatgtacaatgaggaagcttcctcaagcccaactatacaggtcagatcggttgaaaaaataaaactaacacatttttacatgtcaaaatatgcaatatttgaaaatccaaggctaatatctttaaataggcaaagatttattaataccccttgacacagaaacaggaagtgagaaaatgggcaactgacacaaatcaataattaactgtgcggacataggtggtggagtctctcctaatcctctattcttggagatctggatgcctgccatttgcgtatgggaagaacagagacggtcatggagaacagcatttaatctagaaaggaccacaatgaggtcaaagggcagtctcagggcagtcttaagagctccccatccccaaagaactggcaaggactctccaggtgctcgtaagcgactgctgcccaactcccatcacgaactcagaagacctgtcattttctgaaattttcatgactcctaagacactagttattggggaaaacttcaaattatttaaataacgagaggcgaataacattgctaaactcatgaatactctgtatttaaaacctctactggcgatcagagcacatagaatctctactactgatccctgacgctggccatcccccaacccgtcggcccacggaccccagccctgatcccacctcctcccagcatcttacacaaggattctcaccatactccccagagactcgcctgcccagggcccctctctcaccccatatagctcaggtctctgaccccgagacagcatcaccgacctctcccactacctatttccagattagagtccctgatcccagaggcattgtctaaaataactagctcttacaactacgtccacttcaggaaccgccctgtgatgtcagaactttgaggccgcccggccagggctgcacatgctcagtgaggccggcgcccgccagtaacaaacatggctccctgaagccgctcaggctcaagagcaacatggaggtctgcacttaatcgctcctctccggggacggccatactgaggaggcatctcttccgtgcaggcaggctctcctggggacctcagagattctctccagtggcagcggaaaatgagcaatgggtggattcgggtccagattctggcaggagggagtttgggatcgagatctggaaaaaagcactagactggaagaggacgcgatggagtcggagccgctggcggggacaaaaaccagaggcccgggaaggcgccggtgggaggcaaggcgcgcatggactttacctgcgcacgcgtcgcagccatctccgcgcacagtggtggccaccgcgactggtgctgaagagtcggcgcgtgccaggcgctccgctgaaacggggttgctggccctgaatctcagctttctcatctgtacggttgggacaagtacagtaaccctcgcccgtcaagacgggccagggctgtcgcgagggtccacgccttagagcaggcacctatcttctgcagggccctgagatggggtctgactcagttcctgcggggaacttcaccagtgacccagtcagtgcccttcagttaaagaccaccaggagcacacttgtaattacattgcagcaaggaatggggtactatgggtcatctcagtgggaggagttagagagaaactgttatacgatttgggctttaattggttgatttcggataggatctcagaaagtgaagactttagattggatgctgtcagaaagcaggagcaatatgattattaagtatttgtgggtgacatcaagaccttgttttttatctgcacttagacaacattataaagtgcccttgtttttgtttgcatttatcacggtctcagattaaccttctgaagttgatattatgctgtgagattgtttatgtccaacaggaaaacaaaatgtcctggccataagcatcagaccaccgtgtaataacattaaggcctaactgtgacccaaatattgacagaattgaagttagaaatagttctacagtaatagagtcttcaatactccatataaaataatgcatagaagctggacatggtggctcatgcctttaatctcagctacctgggaggctgcggcaggtggattgcttgaggtcaagtgttcgagaccagcctgggccttttggcctgtctcggcttttaacataccttcctcactcagcttaatcatttctcacttttgatttataataagagatgtgtgactcctactttcacttgaacacatagagacctttatagagttattaattggcctaatttcaatactcctgtgtctcagaaaacagggagacctgaggagagggggagatggaggaagggtagatcgatggaaccattcgaatacacacatgtatcaattaagctcattgtcttttggaccatggcttgtgatgccccaaaacaatgacaatagtaatatcaacgatcactgataacagatcaccataacagatataataataacaaaacatttgaaatattgcaagaactacaaaaatgtaacacagaggtacaaaataagcacatgctaccagaaaagtggcactggtagacttgcttgatgcagggttgccacaaaccttcaacctgtaaaaactgcaatatccgagaagcataataaagtgaagttcaacaaatcaaggtaagcttgtatatgtatgcatgcacacaccaatacacatccacctatccgcacacaaatctttgtacaaacaaatcctgtattttcaattccaacaatacatcatttgtaccttaaaaatatctgtcatccttgtagcgtccttttctgtctttgttatcagggtaatgctggcctcataaaaaaatgtttggaagtgttccctcctcttcaacttttggaagtgtttgtgaagaaatggtattaattcttctttaaacatttggtagaattctccactaagctatctggtcttggatattcctttttcaggagctttttgactactgactcaatatttttactcattatttatctgtttttattttctatttcttcatgtttcagtcttagtggatgtatgtttctagaaatttctctattctaagttaaacaatttgttgacacatagttgtttagagtagactattattatcctttgtatttctatggtaccaattttaatatctccttttttgttctaattttatttacttgagatttcttttttcttagcctagtgaaaggctggtcaatttttattatcttttcaaaaaatcagctcttcgtttcattgatcttttctgttgtttttcttgtctatttcatttatttctgctatgatctttgttatttccttcttctaattttgggcttgatttttttttctattttttgaggtttatttgagatcttttttcttcatttagcacttatctgtataaacttccctgtcttagaacggcttttgcttcatctcataagttttagtatgtcgtgctttcattttagtttgtctcaagttattttatttcttttttggtgttttctttgatttattggttattcaggagtgtgttggttgatttccacatatttgtcacttttctaagttttctcctgtttttaattttcagtttcatgccactgtagtcaaaaagaatacttgataagatttcaatcttcttaaatttgctaagacttgttttctggcctaatatatgacctgtgttggagaaagtactgtgtatgctcgagaagaatgtgtattttgctgttttggaaaggaatgtcatgtatatgtctggtccatttgatctatagtgtagttcaagtcatctgtttccttattgattatctgtctgagtgatcaatccattgttgaaagtgggatatggaagtcccctactgttattgtattattgttgtccacttctctcttcagatttgttaatatttgctttatataattaggtgctccaatgttgggagaatatatatttgcagtagtcatatcctcttgatgaattgacccttgtatcattctatgactttctttgtctcttgttacagtttttgacttaaagtctattttgtttgttgtaagaatagctactctttgtctttttttgttccctctctttcagtctgtgtgtgtctctaaaggtgaagtgagtctcttataggtggcatatatttggttcttgttttactatccattcagccactctgtggcttttgtttcactaatttggtccactgatatttaaagtaactattgataggcattttgtaggttttttgttcttttatttctctcttgctgtgcatgatttgattactttgattattttctgtagtggtatactttgattctttgctgtgcctttgtattaattcttttttaaatgtggtaaaattctcatatgtgtatctattacttattttgtctttgtgattatcatgacgcttacataaaacattgtatgctatcatctgccacataaggatgttttggtcaatgatgggccacatatacaacggtggtcccataaggttataacatttttattgtacctttcatatgtttagatacattagatacacaaatgcttatgattgtattacagttgcctatagcattcagtatagtacagtgctgtacagatttgtagcctggaagcaataggttataccatatagcctgggtgcgtattacgtagtattatctaattttgtgtaagcacactctataatattcacaccatgacaaaattgcataatgaggcattattcagagcatatccacattaagaaatgcatgattatagttataatggtctattttaagttgataacaacttaacttcaatcatatacaaaaaccctacacttacctccactttttatgttttttgatgtcagagtttctttctttgtatattttgtaattatatttatttgtagtattttttatcttttaaccttttaaaagctaaagtgattatactgcatcattacagtattaggagtattttgaatttgactgtatagttacttttaccagtgactttttataactacatatggtttcatgatactaattagtcttattgcatttcagtttgaggaactccctttagggtttcttataaagcagatctagtgacagtggactcccctagattattttggggtttttctgaaaaagtctgtaagtcctagccagagcagttaggtaagaaaaagaaataaaaggcatccaaattggaaaagaaatgaaagtgtctctgtttgaagatgacatgatcttatatagagaaaattctaaaagctccaataaaaaagtgttaaaattaagaaacaaattcaacaaatttacagaacacataattaacattaaaaaaaaaaaacctgttgcatttctatatactaacagtgaactatcccagaaagaaattaagaaaacaatcttgggccgggtacagtggctcacgcctgtaatcccagcaatttgggaggctgaggcaggtggatcatgaggttaggagattgagaccatcctggctaacacggtgaaaccccatctctactaaaaatacaaaaaattaccgggcgtggtggcggccgcctgtaatcgggaggctgaggcaggagaatggtgtgaacctgggaggcagagcttgcagtgagctgagatcatgccactgcactccagcctaggtgacagagcgagagtccatctgaaagaacacaatctcatttacagtagcatcaaaaaattaacttaggaataaatgtaaatcagaaagtaaaatttctatataccaaaaactataaaacactgatgaaagaatttgaagaagacacatatctctattactcagtgtgatctacagatataatgcaacccctatcaaaatttcagtggcatttttcaaagaaatggaaaaaagcaattctaaaatctgtgtgcaacagaccccaaacagtcaaaacatccttgagcagaaaaaacaaaagtggaagcatcacattaccttattccaaactaaattataaagctatagtaatgaaaatagtacggtactggcataaaaacagacatgtaggccaaggaaaaagaatagagagcacagaaataaatccatgcctttacaatcaattgatcttcagcattggtgccaagaatacacaatgataaaagtttagtctctttaataaatggtgttgggaaaactagatatccacatgcagaagaatgaaactgaacccttatctcaccctacatacaaaaattgacacaaaatggatgaaagacctcaacctaggagcaatactgtaaaactcttagacataaatataggagaaaagctccttgacactggcattggtaataaattttcagatttgacaccaaaagtatagacaacaaaagcaaaactagacaaatgggactaaatcaaagtaaaagattcagcacagcaaaggagacaatcaatacaatgaaaagacaacctaaagaatgggagaaaatatttacatgctatatatctgataagaagttaatatccaaataaattaggaactcagacgattccaaaggaccttgtattagtctgttttcatgctgctgataaagacatacctgagactgggtgatttataaagaaaaaagaggtttaatggactcacagttccacataggtggggaggcctcatgatcacagttggaaggtgaaaggcacgtcttacatgacaacaggcaagacaggatgaaagccaagcaaaaggggaaaccccttataaagcaatcagatctcatgagatttatttactaccacgagaacagtacgggagaaactgcccccatgattcaattgtcttccaccaggtcccttccacaacatgtgggaattatgggaactacaattcaagatgagatttgggtagggacacagccaaatcatatcattctgccctggctcctcccaaatctcatgtcttcacatttgaaagcaaattacaccttcccaacagtcccccaacatctaaactcatttcagcattaactcaaaagtccactctccaaagtcttatctgagacaaggcaagtcccttccagctatgagcccataaagtcaaaagcaagtcagttgctttccagatacaatggaggtacagggagggggtaaatatacctgttccaaatggttgaaattggccaaaacaaagaggctacaggccccaaatccaaaatccagcagtccagtcaaatcttaaagtgccaaaatgaactcttttgactccatgtcttgcatccaggtcacacttatgcaagaggtgggctcccacggccttgggcagccgcacccccgtggctttgcaggacatatcccccctcctggttgctttcatgagctggcattgtctgtggtcttcccatgcacatggtcaagctgttggtggatctaccattctggggtccggaggacggtggccctcttctcacagctccaggaggcaataccccagtggggactctgtgggggcttcaaccccacatttcccttctgcactgtcctagcagaggttttccatgagggccccacccctgcagcaaaattctgcctggacctctaggtgtttccatacatcctctgaaatctaggcagaagttcccaaatctcagttcttgacttctgtgcacccacagactcaacaccatgtgaaactgccaaggtttggggcttgcgcctctgaagccacagtccaagctgtaccttggccccttttagccgtggctaaagtggctgggatgcagggcatcaagtcccaaggtggcacacagcaggggggtcctgaatccagcccaggaaaccattttttccttttaagcctcctggcctctgatgggaaggactgccacaaaggtctctgacatgtcctggagatattttccccattgtcttggggatgaacatttgggtccttgttgcttatgcaaatttctgcagctggcttgaatttctcctcagaaaattggtttttcttgtctatcacatcgtttggctgcaaattttccaaagttttatgctgcttccttttaaaactgaatgcttttgacagcacccaagtcacctcttgaatgctttgctgcttagaaatttcttccgccagctaccctaaatcatctctctcaagttcaaaattcctcaaatctctagggcaggggcaaaatgctgccagtctccttgctaaaacatagcaagatttacctttactccagttcccaacaagttcctcatctccatctcagacaacctcagcctgaatttcattgtccatatcattattagcattttggtcaaagctactcaacaagtcgctagggagttccaaattttctcatgtttttctgtctttttgtgagccctccaaactgttgcaacctctgcctgctacccagttccgaaattggttccacatttttggataactttacagcagcaccccactctaccagtaccaatttgctgtattcatctgtttgcatgctgctgataaaggcataccaaagactgtgtgatttataaagaaaaagaggtttaatggactcacagttccatgaggctggggaggtcttacttatggtgggaggctaaaggcacatattacacagcagcaggcaagacagaatgaaagccaagtgaaaaaggaaatcccttatagaacaatcggatcttgtgaggcttatttactaccacaaaaacagtgtgggggagactgctcccatgattcaactatctcctactgggtccctcccataacacatgggaattatgggagctacaattcaacatgagatttgggtggggacacagtcaagcatatcagacctgaagagatacatttctaaaagacatacgattgacaataggtatatactaagaaaaagaggtttgccatcactaatcatcaggaaaatgcacaatcagatatcacttcacatctattaggatggctattataacagtaaaaaggtaacaaatgttgctgaggatattgagaaaatgaaacccttgcgcttagttgatagttgatgggaatgtaaattggtacagccattacagacaacagtatggagtttcctcaaaaaattacaaatggaactcccatataatccagcaatccccatctaggtatatatccaaagtaaagaaaatcactatctcaaagagatatgtatacttacatgttcattgcagtgttatgtacacagccaagatacggaaactacctgtgtccattgacagatgaatggatgttttaagtgtattacacacacacacacacacacacacacacacacagacacacacacatatgtaatggaatatcatttagcctttaaaaatgaggaaatgctgccatttgtaacaagatggataaacctggagtttattatggtaagtaaaataagccaggaacacacacagaaatatcctgcatgatttcacttatatgcatacttaaaaaatgtcaaactcatggtaagagagtaaaatagtgcttaccagggcctgggagttgggggaaaagaaaaaatgtttgtcacaaggtacaaactttcagttataagatgaataagttctggagatctaatgtacagcatagtgactaaagtcaataataatgtatacttgaaatttgctgaaagagtagatctcaagtgttctccaccacacaaacacaaataaaaaggtaaccaggtgaggtgatgaatatgttaccttgattgtggtaatcatcacttcacaatgtatatgtatatcaaaatatcacactgcataccttaactatatacaatttttctttgttaatcaataaaactggcaaaactatctgttatatgttgccttgactccatttcttcttattttgtcaaaatagatagtcctcactgtttgcataagtttagaaacttgtgctacatctagaagccaggagcggggtagggtgaactaagttactgattctttaggaaccttagggtgtgaggtgggactggagttcaaggcctaggagccgagtctggtcttgatcagtctctttttttgttttgttttgttctgttttgagacggggtctcactttgttgcccaggctggagtgcagaggcacgatctgggctcactgcaacctctgcctcccaggctcaagcaatcctctcacctcagcctcccaagtaactggaaccacagccatgtgccactatgcctagctaattttgttgtatttttggtagagatggggtttcaccttgctgcccaggctggtcctgaactcctgagctcaggtgatccacccactttggcctcccatactgctgggattacaggtatgagccaccacgccttgccatgagcagcctcttctgatatccctggtgtgttctgtacacattttttttgtctgaatgcacctttcctttctcttcccttgcactccagaaccgtggatactcaagtctatcctgaaccatatagaggaggagctttgagtgttatatgaaattcatttatgatatcatcgttcattccttcgcagaagtaactcagagttcacttagggattcacatggtaaatttgtcttaatgctccaagtgggcttaaaggaactttcttcttgtcggccatcatgtttgtatacaactgtaatgggaatttgagtttgtatgagtagtgtcatgagcacgcatgtttgtgagcacacctctgcatctgctatttcttctattggcctacagacttttccttctttaggatattatcaacttgaattccaatttttatcaaaaattggacctagctctttttattgatattttcctgctacattttttccactaatttatttttgataggttatattgtgtgttttttgacacttaaaaaattttacctaacaatcttaacctttgatttatgtaatttttgttccattatgacttctttctgtcatctcgtttatgatttttcatactttctttactgtttcttttttcctatttgtacctctcactctatagatcaaatctttttccacttgtttgaaatctggaaatttttaacattgtaatggtggttatatcattatttatgttaattttctcaatttccgaaatgtgtccgacatgtgtcaaaattaatatcatctcagcaaaccaaataagtactctagcctcctcttgccacctctgctttgctttctctgttacgacagcactttgtctaagggggtgctttctgaagtttactcggggttgttttcaatatgttatgttttcatgtattttttaggtatgataaacaccactaccattgattcttgaaccctcaattctaacaccacggtttatttctcttcttagtggagtatgtctaggcattttcaaagggatttatttgaaataaaacttttgaggccttattttataatgtctttttctgtgctttcatatttaaaagattttggctgcaaataattcaaggattaaaatttgtttccttttaatccttgaaagatattacttcattttattcttgtctccagcattgctgttgcaaaggctgatgccaatcaaaaccaatttttccctaaacgatgatctgtcttctagccattttgacaggatgttacaaaacaaaggaggcttcaatgttctgagtataaatcattttgcaattataaacttaatgtaaatattaatgcaatacaaaaagaattaaaaccttcttgagacatgcaagtgcacaggaaaattaactatcatgcactcattcaggaagaaaaggtgcaaaagaaatttaatgaaagagacggtcgttagatgcaagtgtggttgaatgtagggatgcgatgctgacacgtggcagcaggcctggcaagctgtctgtcccaattcaacgacttcagaaagagaagaatattaactaggctatcttggtgatgtgctgaaaaaagtactgtgtttcctttttaatcattcaaaacaaaggtaagtaaaattcctgggaaataagaaataatgcatcataaatgtataaaaatagaagaaaatactatatttttatgaatttaaaatgccagctattgtagattgttatctcttttcagaagtgctttaaaattgatgacacatagtgaaaaaatgacataatttcaaacaactaatggaaaaacattaatccatcttcttaagtcttggaaccaggattcttttgggaggcttcggtgtatctttgtatcatttcattgccttcacacaaatcaagtcacgccacctgcgactgtagtttgaaaaaaaaagaaaacataataatgatgctgtcaattcacttgagattccatgatcaaaattaacctatgaacaaagcacagactttattataactacaaaataggatgtaatttacataaaatgtgaaaatataagcatagaaccatatttgatacaagtcgaaagctataacagggacggttggaggggagggaagttttacactaatctccacatcctactgagccaatcagtggtattcaaattggatggaccatatattatttaaacagtatattatttaagcaaagaattaagcactgtaagtatattatttagaggaagcaaatttttaaaaatcccttaaaattatatattaaagactaaattggaaatatagttttagaagaagaaagtggggtaaatgggctaggcgcggtggctcacgcctgtaatcccagcactttgggaggcgaaggcagacggatcacaaggtcaggagaccgagaccatcctggctaacaccatgaaaccccttctctactaaaaatacaaaaaattagccgggcgtggtggtgggcgcctgcagtcccagctactcaggaggctgacacaggagaatggtgtgaacccgggaggcggaggttgcagtgagccgagatagcaccactgcactccaacctgggtgagggagtgagactacgtctcaaaaaaaaaaagaaaaaggaaaaaagaaaaaaaagtcaggtaaatgagctatattctctatcgttcataaaaagtcaagggatattacttaaaattgataaaacaaattaggtgattatataatattatttacagttcaagagaatagcatatagtaaaaaaaaaagagtatgataaaacctgcctcactctgaaaaacaggaccaaggtctgtggaaggaaaaaaaaagtttctggtttccatcgatttttttcccatcaaactgtttgaatgattttccatgcacatgtgttgctttaatttaaaaatgttcttactcacagatccccttgaattacgtgtaaaattaggtttcctttagtcaatggtgtatgaaaagtaatcaactcatctaattgaagttagacattaataaattataatttgggggataacataaatatacctattaaaaacaaccagaacataacagttggctctatgttctgcttatctaggaattcttaaaattataaaaaaaaaaaggagtttcacattttgaaagaaacattaggaataaaaatgcaagtgtttctcttgtataaagctcttaaaatcactagtagaataaagtcaatctagattaaaatttatattttcaaatttatagtatgaccaatattgccatctaaatgttcaggcacagaacattttaaagtagctattttattgtttctcaacatcctcttctttccttttatgattggcatcacaaatcatgattgggacatcttatcaaagaactatacttgtagtttttgagtgaaaagcaagggagaaattttatttgtgccttgaccttattgataacgtggaacttgtgatggccactatcaatagaactatcatcagatttgaagggcactgtttgtgtcctttagtatggagaaatatcacaaataactgggaaataatttaatgactgaagccttcatttttaatcatatagctgagtgatattttaagtttgatgaggataaacatttgaacaaaaatagccaattccctgtttcataatttaatacatttgtgttaaaaggtttagacaataaagttaattttgaaatgcattataaataactaagtagcaatcattaagttcatttttaaataactgtttagataacttagtaattagcaatcattaagttcatttttaaataactgtttagtccacaaaaaataaaaaatacattttagaaagagagggcattccaaaatcagtctcaggaatatttaatctcaaatatctttcaatgaagcagaaatgtaaatacatgtttagataatttaggttaaaaaaggtaaattttggttgcctgcttaacttttatgaaacagatattttcattcaagtccagcatatattttgctatgacttccacatcctttcctcagagaatatttacctaaacattaggataccaaaggaactaggaagcaaaaacttcttattagagagagaaatttttaagtgaggcacacattctaatgatattaatttgtttttgacattttattaatattttgataacactaataaaatccaaaggggcaagcaggtatcactctctcagcgtgggccctcttttgtcatcctctgtaaggtggcagtcatcaaagagcgtgacccaagaagaaagtaaaacagtggaacaaatgagcatttctctaaatacaaacagtagagtccttgagaaagaatcctttaaggccttagatttctttaaacatttttagataaatagtctggcctatgcagaacaaaatgaaatggtaataatgaacaggatagtgaagttttgtactaactgacataaatggcaagagttgattaatcgttaggatagtgtgaaagaagaattgaatgagaaatgaaaattgtaagaaaaaatatccagataggccctttcctaaaacatgtatcataaaatatttaaaagcatctgctttaatgcatgggctgagtcaaagtcaggacaattttcagatacctagaagagcaaaaaaagtctgaatccagaggtgtgggtgtctcatctggcatttgccctggggtgtctcccaggaactattggcccagacccatgagcacctaattcaggagagagagactgatgcccatgcagggaggaatataggctaaaatacctcctgcataaatctaggatttctaaaaagaagcatgttaagtgcctgggctaggaaaatcccacccccataagaagaaagtgaaaatatgtgcttgtcttggtcccaatagggcagacaaaaaaatgaaaaataaaaaacgtatggtaatttctaaatacaaaacaatagccatattggtttgggtttgaattcacactatctatgggcttgagaaataccagggtggaaattagtctctggtagcaagaggtgagaccagccggacttcctgggtcgagtggggacttggggaactttcctgtcttacaagaggatagtaaaatgcaccaatcaggaacttacctgtcttacaagagttctatgaaatgcaccaatcagcactctgtaaaacgcaccaatctgtgctctgtaaaacacaccaatcagcgctctgtaaaacacaccaatcagcaagctctgtaaaatgcaccaatcagcaggattctaaaagtagtcaatcgcagggaggattgaaaaaagggcactctgataggagagaaacgggacaaataagggaataaaacctggccaccccccacccccaccccagcagcagcgacctgcgtgggtgctcttctaggttgtggaagctttgttctttagctcttcccaataaaccttgctactgctcactctttgggtccttgccatctttaagagcggtaacactcaccgtgaaggccggcggcttcattcttcaagtcagcgagaccacgaacccaccagaaggaatcgactccggacacagcagtcctgagagctaattaatctgagtagaatcataaagataaatatatttttcacacatacttggaaacatattttgtaacacagcttttattgtagttaagtgaagatagtaaagtttacaataagcaacactgggaccactgatgtccataaggggaaaaaaaggaaattgaaacttaatcccatagaccaaacataaaaatatattttaatggataaagataccttctcaacattcttagaaaaaaactgtggagcatctcttttacctttacatggggaagaagaacaaactgcaagagtaaaaactaacttgatcacataaaaatttaagatttctgtttattggataccacaatgagaaaaaaatatgtaaaacttggcagagatatttgcaacacatgttgcctagaaaggtttagtatccagaatatataaagctctcctataaattaataagtgaaaaataacacctcaattaagaagttagcacaaatacccataagcatgtgaaaaagtgctcaacctcataataatcatgaaaatgaaaattaacaattagataccctttcacacatattgacaaaattttttggaagttctgaaaggtgtagtattggcaaggataaagaaccgtggaagcattcatcccatgcaagtagaaggacagccatttggaaaatggatgttagctcatacagcttatcataatgtaccctatgtcccagtggcttcactacaacctagtgcagcctagtcagcctgttacaggccccagaaaaattcttgcgtttgtttacctagggatatatgagaatgttcaccattttaaaatcctggaaacaatccaattatctctcaatatgggtagattgtggaataggtaactaaatgatcatatattccaataatagagtacctcgcagcactaagagtgaatgaactgcagctattcacattctcaaatacagcactgcaatgagatactactgcatgcgtattagaatggcaaaaatccagaaccctgacaacaccaaatgctgatgaggatgtgaagcaacaggagctctcattcagtgctgatggaaatacaaaatggagaatagttttgtggcatcttagaaaactaaatctactcttattatacgacccaacaatcttgtttcttggtatatacccaaaggagttgaaaacttatgtccacacagaaacctgcacacagatgtttatggacgttttatttataattgcaaaaatttggagacaagcaagattaccttcagtaggtgaataattaaacaaactgtattacatccagacaactgaataccattcagtgataaaataaatggctgtcaagccatgaaaagacacagaggaagcttacatgcatattgcagaatgaaagaagccaatctaaaaaggctacatactgtcacttccaactatgaccttctggaaaaggtaaaactatagaaatagaaaaaaaaaatcagtggttcccaggagttaggaggaagagagggatgaataaccagagcacagaggatggttagggcagtgaaagtacgtgtatgatattttaatagtgaatacttgtcattgtaaatttgtccaagcccaagtgtgaaccttaatgcaaactataagatgtatcatgtaggttctttaattgtaacaaatgcaccactctggtgggggatgtttattatgggggaggctatgcatgtgtgggggacagggagtatatgggaaatctatacctgctgctcagttttgctgtgaactttgaactgctcttaaaaataatgtgtgtatgtgtgtatatatatatacatatacatgtttgtgtgtatgaatatctgatcataagaaacaatacatagtttcacttatttaaaaagtcaaacgtgcaaaactaaacaatataaagtctgtaatgacaagcaatggaatgattaacaggaagttagggatagtggttacctcttgtggaaggagtgagtgacattgaagaagggcaatgggagtttctaagatactggaaatattctatttcataacctgaaggaaggacacatatgctcattttatattcttcttaagctgtacatacacacttttatatttatgatctacttcattaagtaatgacaattaaatatatgcatttgtaaataagtgagattaacaaatttttagatacatttaactgattaaagttgactcaaataattagaaaatctggatggaaatcataccattaaagtaatcgagttgatagttaataattctacaaagaaaacaggatgcccagatgatgtcacaagtagttccaatgttacactaattatttgcgaggggagaaaaaagagaccattcttcaattcatttgagactagggtaaccttgctattgtgtacctcatccatgcacacagagacaaatattgtaaacaaaatactaggaagtatacctagcaaagtataaaaaccatgaacaagctcggttagtaatgcaaatttagttcagtgttagaaaatctactgaagtcatctccttatcaatgaattaaagacaaaagttatatgattgtctcaaaaggcctataaaattattttacaaaaattaaataattcatgatatttccacctatgaataaagggtaacttccttaacctgataaaaggagtcgacaaataacctacagcatctatcatgttttgtgattaaaaatattgaaatcactccttttaaaatcaagaaaaagacaagaataccattgtcactaaactgcttccaaagcttatagggaagagaaaagggtccagtataactaagacaatcccatagaagaataaagtgtgcgaaggtgggaggtggagcttacgtaccagatttgctgtgaagttataattaccacagcaggaattgctattgtgaaagtgtatgcttgtgtgaaattttgatgtatgccctggctaacattacagaacagtcagaaagggtctatataatccatggtatgagcagttggtatccatatgggaaaatatcagaatggatctctatcccaaaaatggatccctgtcacacaaaggccagatctaaatggacaaaggacttaaatttgagatgcaaatatttaaaaatcttttagaagaaaatataggagagtaacttactacatgccacacctactatgtgtactttgtacgatgccagtgttgtatatgagtgtagtatgtaagtgtagatgcctctaagtagtatatgcatgcttgctactttacacacatgaaacactgggaatgggagcatgagaggaaaccctaggtcattctggtctccagactgctgctcctgcccacccccggttccagcactcccttccccattctcctatacagatcctctgttccaggcacagccacttacagcagctcaagccagtggcacccacggagaggccctcttcaccctactgctgggctgtcatgtcccctttcttttctttctgaaaaacagttttctctgcctatgactcctcatgtttcactctctctaaagcacatgaaagcctggttccctcctctgctttatcagacctgttgctgtgagttccactagtgaccctgcctgacaaattcagaggtttgctcccttttgcatagcgtaaaatgtttacctcgtgacatacttgataaatacaattttataattgttaagctatctatatattctgtatctgtttcaaaaattatgtataggccaggcaaggtggttcacgcctgtaatcccagcagtttgggaggctgaggcaggaggatcatgagttcaggagattgaaaccatcctggacaatatggtgaaactcagtctctactaaaaatacaaaaattagctgggcatggcggcaggaacctgcaatcccagctactcaggaggctgcggcaggagaatcgcttgaaccaaggaggtggagattgcagtgagccaagatcgtgccactgcactccagcctggagacagagcgagactccgtcctcacacacacccccaaaaatataaagacaatgtcagttatgccaaacagattgtttttattccataaaactgctctccatatgtgtaatatgtttctatttcacacatagttttgatcaaagattaatctattgcatagatacttttcttagtaataaaactcagcttggatttctctagccagataaaacaccttatactaaatgaatcaatcaaagctctttgttggagtgagatctgaaagctttcactcaagctggctgcctcagcttcacggcatcaaataatggagggagaagtggaggctgacatgcagcaagaattatcatgtgtgtgtgttggagagatattttgtttaattcatttgcaagatactcgtggtgtactgctacatgccaaacagctgttcttgctactttgtaaaaattaatcatctcatagctgaaaagttaattgttgtaatgtgacttcagtactgccaatctctgggatttgaagccaaaaaaaaagcttcaccatcatgattgagaaatagagttactggcagtagtggagcaaaccacgattctgcacttcgacacagaattattcctgacaagatcctggctcctaactcttccaccaaaaccaagtctgcagctcccacactgaaatgccactcatttcaccccaagtgtgttccagccgttccttcttcttctccttcctaccagctctgtaatgtctccattacaatgctaaggtcagggtcaatggcacttcatttcagaaactttctgagagccctggaaagtaatctcttcttgttcttattccatgatctcctgtacttttttttttttttttgagacggagtctcgctctgctgaaccttctttaaatcactgatgatcatttctgtagatgagttgtctccgtgtgtgtctgacctttctcccagttggtgagttctggaattcaggaagcattttagtatagtagtagtttttagtaatttatttcacctccatgcaccccatagccgtttctcacatgttggggctgcccagtgagcacttgctgagggaaactgcagggagacttgcaggtcaggttcactgagccagaaagtgaagcaaattgagagggcaaagtgcaagacactggctgaaatatatgaacacactggggaaacaaacatccccggcctctgtggaggcggaacacagtcgctgaggtctgtgattcagcagcacccacctggcaaatcatactcagcatcgggcttagttctcccatagtgctttcatggcgaggaagaaaagctatacatactaacatgagccagctggaaaccacaactatatagtatttcttttcagcttttcagctggaatcctgaaagaactctgaggtcatgtagaatgcggcatattgttagatggggcctgggtgggcttggtgttagaggacctgccccaggtcatggtctgtggtggggatggagggtgtgatttcccatccccttatctctttgtcccatactttttgccctgtacacacatgatcgtcctcaatatcttaagtaggatctcccatatagctaaaattgatattgggcatctgaagtatgcctaacttagctgaatatttggcctttgcctttaaaggatctgtaagttattgggatgagaccaaggagaaaaaggaagaccatagataactcaagcataatctgccatccaataatttcatgacatgcttatccttggaataaagttgacctgttatcaggaaactgtcccaccatcttttttgcatgtagagacctccattgctatggcctccattgtaatgggctgtcattgggtttgaaaaaagtctacatgttgattttgatggcaataaaagagtcagacggtgcaagctggagcaaggtgctcaccaaagctaggcctttcccctccctcaggaactggcaacaagagcaagagttagcttcctgaatgtttgcatttcaaagagacagctctcaggtctttgagaagacaattctgggatgtagatttacacttcaaaggtggagaaaaatttataattgtaagctttctaaggttctaagaggggattcggggctctacctgcccatcaccaggttttgcctgaaacaaacagtaaattctccttgcaagtgagctttttcaggcagtcattttaagagggctggggtcatccacgggacacccttgtgctgctggaagcctcactagagtttggtcctctctttggacagggatttggaagtagttaagtactgcgaggcctgtgttctcatgaccaaagctcacaaatgcccatttctttctttctttcattttaatatttgaaatatttatgtgtctcttaacacctcttggaaatttccatccctttcgagctatgttccagtcaaaccaaacaaagtgtggcccagcagccctggggagtctctgggtgaaggggagatgagcacacaaatgttgagagtttgagaaaccctggccttgatttttataatagttggtaaagtggtcatcagtgaaatccacagggattccctgagagtgtatagctttggcatgatggttgctgtaatctgaaggggaaagtagaagtttacatgtgagtactgaagaagcttgagacagagtctcgctctgtcacccaggctggatgaagtggggccatctgggctcactgcaacctgtgcaattctcctgcctcagcctccccagtagctgggattacaggctcctgccaccatgtccggctaattatttttttctttaaaattagtttttatttaaaaagtacaaatagcactctacttttacttttgcaaacagtaaagaaatggtgttttgttacaaaaattaaactgaaataaattttggattgtagaaaattcattaaaaactcaggttttaatttagttaaaatccatctagtgctgtaagtgtggctgttggcagatgtcttattttttatttattaattaatattattaataactaattttttatttattattcgtgagccctttcccatgacagcttcttggaaacttctttctctcccactgacctagaatgatctctcaggcattcttatttaaagtttttcctctcattattcccttcttcaccatcattcccaggttagttacaaagaactaatttaatgacccatttactctgaagggaggcacaagaagtgaagcttctttctgaggccttaagggatctcacctccttaaatctctgttttcctacccctacttcagatattattgagacattatgttttcttcctctaccttcagaaacttcagtatcaacaggtccagatctgcctaagccctcagatgagtctgcaaacaatcattgtatcaacatttgactaataccttgcagatgatcccaggcaccactgtcttaacctgtgaaaaccgcaaattcttggcacaaacaacttcttctgcacatccctcctcctcatacatacactaagagacttggccaaattccaacacagcgtctatcagctcagagccacatccctatgatgccccatgcccctctaaagcacctgcctgggaacattcaattctgccaaaagaatttactgtttgtcccacccaaaacttgactataggtccctgacctcccatttctaagagccttaactttagaaaacctgcaatggccagacgtggtggctcacacctgttatcccagcacttttggagaccaaggagggtggatcacgaggtcaagagatcgagaacattttggccaacatggtgaaaccctgtctctactaaaaagagaaaaattagctgggtgtcatggcacacacatgcagtcccagctactcagcaagctgaagcaggagaatctcttcaacccgggaggcggaggttgcagtgagccgagattgcgctcagagtgagattctgtctggaaaaaaaaaaaaaaaaagacagaaaacctgcagttataaaccctttctctgcccctttaaatctcctacaacatggaaatgtctttctgaaagacttgggagccatccctttggactataaggatcaagaaggatacaggattgtctcctggtctctgtttctgtgtaggaacctaattttgataagcactattagcaaacacagatggcctcatcacattgaccaacctttccccaaacatcagtccatgcttttcctttagcacactccaacatttgcagagcctcttgctttttgtttccgtgaagttgaggctttctaacatactataaattgatatgtctacttagtgattagaagacagaaattaatcactggatttcattatcacgctgacttttaggattaaaagcagcctgtggttacagatgcaacatctttacatttctaagaaaaacaggagagatttgtctttggctcctttggacctcactgattaatagaaaagagaggattgagcaggtttggatgatacagcacaactcagtttaaagttccaggcaaagaaagcaacggttatttttcactccagagagtgaatcattctttggggccacaaaagagaagatttgaagaataagcagggacatctagaaggtggctgagtgtactccattgggctaaatgaagctattttgttgttgttgttcaaatagcttccccacatggtacatttcatatctaaagtgctattccctctcccatcattttattacgtatgcaatatctggctgagaacctctttcttgccctccttcttactggttaagagcacagacagtcctctctttgcatagcagtgcagggccatacaaatcactatgtaagctgaagatctgtaaagtgacctaaataatccacgtgaaacatcgactgttctgtgtcatttaaaaattttggtcaaaacattaaaaatctcttactgttggttataaatgtataaggaaatgaaacatagtgaagttagtacttttttttttttttttgagatggagtctcactctgtcacccaggctggaatgcagtggcgcgatctcggctcactgcaacctccacctcctgggttcaagctattctcctgcctcagggtccaaagtggctgggactataggcacgtgccactacgcctggctgattttttatatttttagtaaaggtggggattcaccgtgttacccaggatcatcttgatctcctgacctcatgatctgtccaccttggcctcccaaagtgctgggattacaggagtgagccaccacgcctggccagtacttagtttatacactgtaatttaacacattaaacaacagccaatttaagtgctttatttatttatagacgtgtatcaagcccagtttgaacagtgcttgcctccctcttgtcgtatagcctatgataaggagccagcagtgtttctatgccttggtgaattctcgtgctgttttcggaacagcatctaacattgtcaacgtcatgaaatatctacaagagttcctttaatatgaagtttgttgctgtctttgccggcatcacttcctctggggcttcttcatccttttcatcacagctgtgttcctcattcatgtcagaacactgcgttgcgccgagttcctcttgccgcgtgtcctgtggtgagccgattctatgattccatttacgttgtatttgaatccacttccagggttatcacattttttatttctttgctgcacatcaatggttgctgaccagttttttcttctgattattcatatttataaatgtcacatgggtttctcactgggagacaaggaatcaacacgattgcagactttgctgtctgtgtgcgaactagcagatgcacagtgatcagtcactgacaggctttgaaagaagtgaattgtgtcccccaaaaaagatatgtttgaagttctaatccccaatatctcaaaataatatgagcttatttggaaatagcacatttacagagggtctccagttaaaatgaggtcattagggtgggtcctaatccaatagactaactgctgtcttataataaaggagaatttggatacagctccagacacacacacacaaaagacgatgtgaagacacatagagaaaacagagtgatatatctgtagatcagacaacaccaaggatggctggcaaacccaaacaggaaggagaggggaagaaggattctcccctagagccagcagagagcgtgaacctgccaacacattgatttctgacttctagcctccacaactatgagtcaatacatttctgttgttttaagcaacccggttttttgtactttgttgcagcatccccacaagattaatacagtccctgatcatgatgcttgcctgttatttaatcacataggcagttgtggaattaagagctgagaacgaagtttggattttatgcagttgctcacagttagcatattgtggtaactgaaattgtaaccatgttgttgggagactagtgctatttaactaaactatgttaattaaacctgtgcatattcaaatgcacaaagccaggactgtttttacttagtacaggtatttacaggaaaagaatgtttgcctcttttcagggccttagagcatgccctgtgccagcaggccccttccacagctacttaacatctcttctcatcttgccagccacctctcaacccagatgaccagcaaggccatcttggactatcaaaatgaagtagcccctctccgcttttgactacgttcacttgctttattgtctttatagcattttttatttactaaaataatatttttttcattacttgattcttatcttgattcagtacttctaaaaaatgcagattacaattcaaatgagaaaccaagttgactaacgttaaaaagtttgatactattaagttttggtgagcatatagatctaccagaacctttaacttctcatgggagcataaattggaaaacagttcattttaacatagtaaaaaaccaacagtatacaaatcttttgacacaatgatttcaatgttgggtttataccttagagaaaatctaacttttatgtccaggagactcatacaagaaaaggacatctactttttgtaatagaaaaaaatggataataaccccaatctaataaaatggaatgctcattatagtattatcctgtgatggaatactctaaatcaatgcacagaaagtacagataaacatatcataagaatgaatcttacaaattaaatattgaaccaaaaagcaatttcagaaaaatatagtcagtgtgattccatttgtttaaactgaaaaatatgtgaaacaataatgctcaatgtcctttactaatgcatttattttggcaaaattataaagataagaaatgggactaattaacaggacagtgttaaggactctaaaaatatgggtagtttttgattcttaggcaggtaatgtgtacatcagtgttcattttattatttcttacactgtcttcatgacttacacataatattttgctagttttaaaacataagatgtgataataatctaaacagaccaaaggaaataaatgaatatgattaaaaaaagacagagaataagccctgtctgatggaaagcataacaaagcaggtagaacaactgtcaggaatgcttgatccaataaagctaggtttgtgatccacaacacttcagcattttaatgtgatttttgatgtttgctttttgcaatggtgattctcagttgcctccctcctgtgtctttacaagctgaaatcaagtgaagctacttctgactttttctaaaacttaaacccaacatgaaggtctgcgtattctttcacatgtgcacgtatgtggcacttttccatgatgcaacagcagcgggtctctagctaagctacagcagcagctctaagaggcagaggaccctgaaatgaggctgaaagaaagaatagtccataactgacatcaggcaggctgctgttgtaagcacagaaaggaggctcacggcggcatggactcaggccaggtcacactattgtgggagaacacggagcacacgtgtcagctggaaaggggccggctcaggagacaaaataggcacgagaggaaaccgaaaaattgacatatgtgactatccttgtagaaatgtataaaggtttggattattttgcttatcgagttataataaagttattctaaaaatgtttatctaaagtattatgtacatttttgttaccttataaagattatttatatttgaattgtgtggttattggaatgacagtatttgtaaagttggtattgacattctctacgatgcttaatgaagaaactgacatttaaggcgattcattaattctctttggtcagtggctgagctgggacagagttcaggttttctgattctcagcctatgttgttttctcttcattttaatgtgaacctaaatatgtataggatctagacaaatatgacatgtagtgccttatttcttgttttctctgtaatgaatgccaggtgagataactttatttacagaagcccatccagtggctcaggttgcatctgtagttgcctttgaatcatttattcaacgtcaggatggtaaagtgaggagcttccccaaactgaagcagagtggcatctgtgccaggttgtagagtattccccgccatacataaagacatgctggttcttgttatttatacaggcactggggttcccattagctcttacatttcatatgcttagagcaagaagctagagagtgacttaggatacagtgtaaagatattagtaaattaaggcagttctgcaagatttttaggacttctatttttcttctattcatcatttatgaagtattcttgctggaaatagtttatgtctctctatcttgctgagtgatgaatactcggccaggatgctaaaatgtggtttcatgaagtatgttgtgtttctgtctgttcttgtttccttccttgaaatgtgtaaaagtgaaaaacatattaatcataaatcaagcattcatcataagcctaaaaaaagataaaataaccagtagtatcattgactaaaattattactcaccaaaagaaactcactccaaagttagcgcaatactaacagagaatacaagttttgccaggaaccactgaggcatagtacctcacatgggaaacatgggaagtaaaaccacctgaggagcctcttgatggtgagtcaggctgttcctcgaagagtaggctgtgactgccaaactttgtaggttaaggagtatttataatgatctttgaggaaactgcaactgacaattgagggaaaaaaatgttagttcatgactgcaaaatacatgacagaatcacaaaaactattttacaagtttaaaaaacaaacctgatgctgatgcatggcaggcgaaccccaaagtggggcttagcctgcaagggttcttggcttcacccaggaaaggattcaagggcaagccagtggtaaggtggaagaaaacacctttatcaaagcaacactgttacagctcctgtggggtcacagctcagtgactgctcccagggttgccccataggcagggtgccgagagtagcagctgagcccagttttgcagtcatatgtatacctacttttaattacatgcagattcaggggtggtttgcgcagaaattgttaggaaaagggtggtaacttttgggtcatcaggtcattgccgctgaaagtggtggtaatgcctgagttttgccatggcaatggtaaactgacaaggcacgctgctgggtgtgtcttacagaaagctgcttccgctctgtccttgtttagctagccctcgatcttttgtttgtaaatgagcaagagagtcacggccttggcgttttctcccagaagtacagtggaccccagagcactctagacccaggagccaaaccaaatcacagcatcccacagttatgtccagccctccatcactgattggctgcaatccaacaagtggcccagaggggagggttcattgaaagctctttgctaagtgacaggcctttaagaaggaaaaagctgttaacgattggtatgggatgggggaagtgtttgtggtcaccacggcaccccaaggctgtggccttctctgagcaccatgagactcagccatgtctttctctctgttttcccacaaaaccagccagtgctaaagcatatcctcctggcctacaaacagtggccatgacttccaactcatccaggctacttctgatttagtgttaggccgcccacttgatgtgtatgttcccatgccgtgtcaaccctattgcttaatgaaaacacgcagcactcgtttgcttctcgacttacttctcatgaaatattactactcctccccacccaatcacaatcctttgctgccaaaaatcccttgctaccctgtacattttgtccaataagggaacccctcagcacacacacacaatggtgctacagaaaccagatcactgtctcactctaggttagatgtgtcagaaacccttctctcctaagttgaccttatgctctatgtcaatggctcctacttctggaaggaggttgggaccttccagcctggatgtgccatcactcatctacacaaaactcttgaatgccaagctttgccacacgttaaatcagccaaagtggctaaattaactgttctcattcaggcttatataaggcagagggaattcagattagcatctacagtgacagacactgggtctttggtgtagtgcatgattttggtatgttttgaaaacagagaggattcatgacagcaacttgtccccagtcaaaggtaaaccccaaatagcagaacttctagagtcattgctattgccccagctagttgttacaattaaagctgagggatatagtataaaatactcagatgaggctcagggaaataaattggctgataaaggtgctaagctagcatcctcttccttggccgcctaagaaatccaggaagtctccaaaccttgtgactagatacctgggcttcatttcaaatacccacagtcctgctaggattatttaccctctttaaataaattgacagaagcaatgtctttacaaggcctctaaaggaaatgtaaaattcacacagcccagatagcaatttcagagtcagaaagaattggatgagaaaaaggtgaatgtttgatccacttaagtggacttcagaaatacccagatggccatttggtaactcctaagtctgtctcccaagtcattgtgtacaatttactcatccagatttaccacagaaaggacaaaatgcagtatatattaaacaaaacaatatggcttggactctttagattttatttggaccaagctgttgccatttgctgcatctaccaacaacataatcctccaaaaagcataaaggtggggcaaaaaagggaagtggctccttctacatccttccttcactggaaaataggcttccttcactggaaaatagaatgggaggctttccctgttgaaactcctcaaggacatcggttgccaaggtttattaagagtgaatcttccccacatgggttatcccctctactgcctctagtgacagaggatcacatttcattggcaaaattattcaggaaataggaatggtaacacacgccagccaaagattccactgtccttaccatcctcagtgataaagttctatacaaagagccaacagcatcctcaagctgaactggctaaactgtctgaagaaagaacttgccatggccacagatattacccatcatactgactctcagatccttgcccctaccttcacacaaacaatcctctttgaatcattacgggatactcatgagaataccctactaatgcaaactagaagaagattccaaactaactcagttcaacatcctcagatattgtcagggattaattaaatacacacagccccactatactccacaattgaggcttcttgtatctttaaactccctgatcagtccttacttgctttataagtaagtgatctggcattttgaaaaaacaccaacatcagaaaactaaccttgaacccagagggaggggaccttttattgtttcactcattgctaacactgctaacaaattacagaatgtttgaacttgggtgcatgtcttttagttgaaaaaatacaaaatctatttcgattggaaggcactctaaccagagactcacgctgagactctatgaacaacctccaggccaggcgcggtggctcacgcctgtaatcccagcactttgggaggccgaggcgggcggatcacgaggtcagcagatagagaccatccggtgaaaccccgtctctactaaaaatacaaaaaaattagccgggcgctaattggtgggctcctgtagtcagagctactcgcgaggctgaggcaggagaatggtgtgaacccgggaggcggagcttgcagttagccgagattgcgccactgcactccagccttgggaacagagtgagactcagtctcaaaaaaaaaaaaaagaaaaaaaaaaaaagaacctccaaactttgcagcgagcagagattgcaccattgcacttcagcctgggtgagagagcaagactcggtctcaaaaaaaaaaaaaaaaaaaaaaaaaaaaagaaagaaagaaaaggaaaggaaagaaaagaaaagaacctctaaaagtagccaacagctggagacagacatccatcctaagaactacggagcaagtaaatgatatgatgaagcagtccgcttctgccaaagatcatgaaacaagattcactccgattcccctcccctgtctctgacttcaattttgggtctacgcattctgctactactcctgtgtcctctacaacgtcccatcttcatcctagtgatgtgtcctacttacaacatatatactccatctccagcctcagcagccctgtcatgattcccctctgtttcctccttatcttaccctatcccgtgctttcctctcatgaccataattccctcggtctcttagctgacaaagtagccaatgaaattaaccaaagtaattgccgggtctatgcccattcccactctattctaaaactcgtattcccttaataattgtctcccttatgctttagatatggccttggcagaaaacattacaaatatacagccatttaggtctcccttttagaaagatattgggctatttcttaaaagcccttgtgactgggagtatgatgtggcctctttaacctaagaaacgtggtgttttactagaaatcagtctaataaatacagtcaccctgtggaacacagtagatgctctgtgtccttgtgaaaagatgaaacctattttcaagaaacagacattctttgtaagggccaaactcccattaaggacagcattgtctgcaatacccacgcaataccagtatcataggaaattattttactccagatcaatattttggtgaactgaaagactgggcaaaaaaattgctggctaaatggtaccaaagtacccagccatttagaagatgatgtttataactatctctttggagtctattccaggttagctcctctagcctctgttacaaccactagaggcaataaccaacactagtatgccctcaagggacattatttagtatgtggtcataaaaccatacaaagtacttccagcccattgggctggctgctgcgatgtggcttatgctgtccctcaaatggaaatgtatgaaaaatttcccaatggaaacattagaaacatgagcgctcccacaattgctgagcctgaaacttgtgaatggataatggctggatgacaagcagccttaaacaggtccggggagagccgcttgctcaggccaaacttacagggtgctctactcttgatattctaccctttgtcaccaacataggtcagcccactcctatgctgtaagatacatctgacaaaggactagtatccagaatctaaaaggaactccaacaaattagcgagaaaaaaaacacataatcctactaaaaagtgggcaaacgacatgaatagatatttctcaaaagaagatatggaaacggccaacaaataaatgaacaaatgctcaacatcactaatcatcacggaaattcaaattaaaatcacagtgagataccatctagtcagaattgtcttaccctagccaaaaggttaaaacacaaacaaacaaacaaaaacagatgttggcacagatgtgatgaaagagaatgctcatacactgttggtgggaatgtaaattggtacaacttctatgaaaaacaatgtggagatttctcaaggaactaaatgtagatctactattcaatcagcaatcccactactggtatctacccaaggaaaagaagtcattatatataaagaacacttgcacatggatgtttatcacagcacaattcacaatagcagagatagagaatcaagctgagtgcctatcaacagaggaatggataaggaaaatgtggtatatataaaaaatggaatactacaggcccagccaggttgctcacgcctgtaatcccagcagttgaggaggccgaggcaggtggatcacgaggtcaggagttgaagaccagcctggccaagagggtgaaaccccatctctactgaaaatacaaaaattagctgggcatggtggcgggcacctgtaatcccagctcctcgggaggctgaggcagagaattgcttgaacccgagaggtagaggtcgcagtgagctgagatcacaccactgcactccaggctgggcaacagagcgagactccatctcagcaacaacaacaaaaaggaatactacttagccacacacgcacacaaatgtcttttgcagcaacttggaactggaggccattaccataagtgaagtaactcaggaatggaaaaaccaaatactgcatgttcttacatataagtgggagctaagctatgggtacacaaggtatacagaggggcataatggacattggaggctcagagaggaagggagagggataaaaaaaaatcacctcttgggtacactgtaaattatttggtgacagatacagtaaaagcccagacttctccactatacaatttattcatataaccaaaaactatttgtaccccttaagctattgaaataacaatttaaaaaataattagtagagttcatctcaaacttaatataagcttttgtttcataaatccatgaggtattggagcttctcaaaatgactttacaaaactagctcaccttagactacatactgggttttcaagaaggtgcttgtgcactggtgagttcccaatgcttttcattcatgaatgataaagagaaatgaatcaagaagccgtggcagcacgtgcctgagaagcagccaacatagctcacgcccctctggagaggcttagtctctaaggagaaaatggtttccccagccaaatggcttaggagactttttaagggacttggctttttttttttttcttttaacttttattttaaggtcaggggcacatgtgaagatttgttacaaaggtaaactcatgtcatggggtcttgttgtacaggttatttaatcacccaggaattaagcccagtacccaacagttactgtttccactcctctcccacctcccacacggcatgctcaagcagaccccagtgtctgctgtttccctctttgtgttaataagttctcatcatttagcctccacttataagtaagaacatgcagtatttggttttctgttcctgcgttagttgctgaggataatagcctccagctctagccatgttcctgcaaacgacataatctcattcttttttatggctgcatggtactccatggtgtatatgtaccacattttctttatccaatctgtcattgatgggcatttaggctgattccatgtctttgctattgtgaatattgctgcgatgaacatttacatgtgcaagtgtctttatggtagactggtttatactcctctgggtatatacccagtactgggattcctgagttaaatagtaattctgcttttagctctttgaggaatcaccatattgctttccacaatggttaaactaatttacatcccaccaatatgtctaagtgttcctttttctctgcattctcaccagcatctgctattttttgactttttaaacaatagcctttctgactggtatgagacggtatgtcactatggttttgatgtgcatttctctaatgatcagtgatagatattgaagtctttttcatatgcttgttggatgcgtgtcttcctttgaaaagtttctgttcatgttctttgctcacttgttaatggagttgtttgtttttctcttgtaaatttgtttaagttccttataaatgctggatattacacctttgtcggatgcatagtttgcaaatattttctcccaatctgtaggttgtctgttaactctgtccatagtttcttttgttgtgcagaagctcttaagtaaattggatcccccttgtcattgtttgctttcgttgcaattgcttttggcgtctttgtcatgaaatctttgcctattcctatgtccaggattgtattgcctagtttgtcttcatgggttttcatagttttgagttttacactatgtctttaatccattttgagttgatttatgtatttggtgtaaggaagggtggtgtaaggaagagtggatgcttcagttttctgcatatggctagccagttatcccagcaccatttatcaaatagggaattgtttccccattgcttgcttttgtcagctttgttgaagatcaggtggtcataggtgtgcaaccttattctgggctcttgattctgttctgttggtttatttgcctgtttttgtaccactaccatgttgtttttgttactgtagccctgtaatatagtttgaaattgggtaacataatgcctccagcttttctcctctttacttaggattgtcttggctattcaggccttatttttttggttctatattaattttaaaatagttttcctagttttgtgaagaatgtcattggtagtttgatatgaatagtattgaatctgtaaattgctttgggcattatgaccattttaattatgttgattcttcctatccatgagcctgtgatattttttcatttgtttgtgtcatctctgatgtctttgagcagtgttttgtaattctcattgtagagaattctacacctccctggttagctgtttatcagctaaaggagcttttgggctgaaggtatgaggcttctggatataacatcatgtcatctgcaaacagagatagtttgacttcttcttttcctatctagatgctctttatttctttctctttcatgattgctctggctaggaatttcacaactattttgaataggagtggtgagagagggcagacttgttttgtgccagttttcaagggcaaaaagcttccagcttttgcccattcaaagtgatattggctgtggatgtgtcatagatgtctcttattattttgaggtatattccttcaatacctactttgttgagagttgttaacatgaaagggggttaaattttatcaagagctttttttctgcattgattgagataatcatgtggtttttgtcttcagttctgtttatgtgacgaaatcacatttattgatttgcatatgtagaaccaaccttgcatcccaggaatgaagcctatttgatcatggtggattagctttttgatgtgctgctggatttggtttgcaagtattttgctgaggatttttgcattgatgttcatcaaggatattggcctgaagttttctttttggttgttgtggctctgccaggttttagtatcaggatgatggtggcctcatagaatgtgctaaagaggagtcactccttctcaatttttcggggggtactttccctaggaatggtaccagttctttgtacatctggtagaattcagctatgaatccatcaggtcctgggctttttttggttggtaggctatttgttactggttcaattttggagcttgttgctggtctgttcaggcaatcaatttcttcctggcttagtcttgggtgggtgtatgtgtccaggaatttatccatcttttcaaggttttctagtttgtgtgcattgaggtgttcatagtagtttttagtggttatttgattatttttatttttgtgcagtcagtgttaacattttcttttcttttctttttttttatttgagacagagtcttgctttgtcatccaggctggcgtacagtggcaccatcttggctcactgcaggctctgcctcctgggttcaagcaattcttgtgcttccgcctcctgagtagttgggactacagttgtgtgccaccatgcccagctaatttttgtatttttagtagagagggtttcaccacgtttgtcaggctgctctcaaactcctggcctcaagtgatctacccgcttcagtctcccaaagtgctgggattacaggtatgagccaccacaccaggcctcaaaattttagtagtgtttatttggaacttctctctttttttctttattattctaggtgttggcctatcttattaattttttcaaaaaaaatcctggattcaacaatcttttgaattatttttgtgtctttgattttcttccattcagctccaattttggttatgtcttgttttctcctagctttggggttgatttgttattgcttctgtaattcttttagtggcgatattaggttgttaatttgagatctttctaactttttgagatttttctaactttttgatgtgggcaggtagtgctatgaatttccctcttatcattgccttacctgtgtcccagagatcctggtatgttgtatctttgttcacattattttcaaagaacttcttgatttctgccttaatttcattatttacccaaaagtcattcaggaacatgttgtttaatttccatgtaattgtatggttttgagtgattttcttagtctcaacttttatttttactgcactgttgtccaagagtgtgtttggtaagaattcggttcttttacatttgctaagcattgttttatgtccaattatgtggctgattttagagtatgtgccatgtggtgatgagaagaatgtatattctgttgtttttgagtggagagttctgtagaagtcaatcagatacatttgatctaatgttgagttcaggtcctgaatatgttttttaattttctgccttggtgatctgtctaataactgttagtggagtgttgaaatctcccactgttattgtgtgagactccgtgtctctttgtaagtctctaagaacttgctttatgaatctgggtgctcctgtattgggtgcacatatatttaggatagttagatcttcttgttgaattgaactctttaccattatgtaatgctctcctttgtcttttttgatcttgcacttggcttcttaaaaacatccttaatggcaatattctttgtctcttaagtacaccactattcttcttttttttttttttttcagatagagtctcactctgtcaccaggctggagtacaatggcactatctctactcactgcaacctccccctcctggttcaagcgattctcctgcctcagtctcctgagtagctgggactacaggcgtgtgccaccatgcgcagctaatttttgtatttttagtacagatgaggtttcaccatgttggccaagatggtctcgatctcttgacctcgtgatccacccacctcagcgtcccaaagtgttgggattacaggcatgacccaccaagtgcatctctattcttatgagacaattgtgccaccattgataatacaccaaacctcctcgattgttgcatttaccaccttgactcttcctgaattgcacaatgatgataaacaatggctgaacttttttcttttgaggactttggagtgcaacaactatatttattctacgagaaagaaattcattctttctcttgaacaagaggagggactgtgaacttccctgaagcaaaaaggatttgcctaaacactgtgctaagagacttgacctaacattagcctggcttccacttggagtagttaaccccaggccctgcgctgagtctttgctcaagaaaatacaatgctgccaaactacataatgtatattgtcgtaaccgatggtgtcaaatcattttcagtaattctctacttaccccccgcttttttttttttttttgagacggagtctccctctctccccaaggctggagtgcagtggcgtgatctcagctcactgcaagctccccctcccaggttcacgccattctcctgcctcagcctcctgagtagctgggagtacaggagcccgccaccatgtccagccaactttttgtgtgtttttagtagaaacggggtttcaccgtgttagccaggatggtctcgatctcctgacctcgtgatctgcccgcctcggcctcccaaagtgctgggactacaggcgtgagccaccgcgccagactcttacccccttttataatttgcattttcacgtagtcctcagtcccttttttaattcccctctttttacttttccatagtttctttttatttcccatttgttctatttttaaaaacatcagcctcctttgtcttacttggagttgagcttagtttatactgaagtctctccctcctgctgaaatagtctgagtaaaataggtctcattgcctttagcaagtatccagcactgctgtttttctttgacaatttctagggttgccttagatgaagtggggtgaaagggcattagaaggcacaggccaaaagatcagaactctggactctcagtcccaaattctactagcagaactcctttttcatattcttcatacactgggggctttgctgagagtttgctggactgaatataggaagaacaacagacttctgaagttagtcacatctgtccttgattcaattatacaaacatgaggattctcaaagttatgatttttttcctagaaatactttattttcaggaaatatttatttagcgttgatgacttgagtattaatctcaaggcaaggaaatgagggaaatgacctcctgatgtctttcccatgaatctgtaacttggtggtcagcttcttcccaagttatttttcttgtggcacctcagtgattttattagtttcaccacaagtactcccagcaagggaaatcagtgatcccaaaggcaccaggctggagttttcccacataaagatcactctttgaagcagctccttcctagaaatttgttatgtttacctttgccaatcatctatgattagtgtagtaattattctgtttttgcttttatttttgaaattcactgaaggcttcactgatcaacgattaaggcatgtgcttctgctttgattcagtgtcttcttagtatgagcgtggtggtataaatctcttgaatcagtgctgggatttatttgattatgaaaatttattttcattcaagtattttgaatgcacttttaatattaagtacatttaatattacatgtaatattaacttgaagtgtaactaatatgaacaaattccaaagtacatgaaaataacttttaatcctgtaagtatgactatttatttcttttcacaatataaaaagcacatgcgatattttgaaagactattaaaggtggggacaagaggttatttaaatctatgtttggatgcaacttttatggcttaaactacaaagaattatcctttttatatattaaatgattgtatagttcttttaatactgttttttgatacaagtgtgaaattcttaaagaaaatggcaaacatcactaacaaccattacaattctaatagctaacttttctgagccattacttggaaccatgcactgtttaaaatgcctcacttggccaggcacggtggctcatgcctgtaatcccagcactctggtaggccgaggcaggcagaacacgaggtcaggagattgagaccatcctggacaacatggtgaaactccgtatctattaaaaatacaaaaattagcctagtgtggtggtctgtgcctatagtcccagctactcagaaggctgaggcaggagaatcgcttgaaccggggagttggaggttgcagtgagccaagatcgcgccacaggactccagcctagcgacagagccagactccgtctcaaaacaaacaaaaaacaaaaaaaattcctcactcatctcactcatgtaatcatgacaataacattaattgtattatccctacattacagatgacaggtgacaaaaatatgcagagaggggttaaactgcataacattactcagagaatgcattctttttattccataggttttttgtattacagtactacattcacagaggccttccattggaaataacttataggaattattgtaggtctctttgcactttcttcagctcttggtttaggtctcaaattgtgagtgatttctctctttagtgaagttgtaatgcaattcattaccatagcagaaagcacagaaaatattacctatttattaactggaaatgcactcacatgttgtattagtccattctcatgctgctatgaagaaatatccaagactgggtaatttataaagaaaagaggtttaattgattcacagttccacatggctagggaagcctcaggaaacttacaatcatggcagaaggcacctcttcacagggtggcagcagaaataatgagttttgagcaaaggggaagccccttatgaaatgatcagatctcatgagaactcacccatcatcatgagaacagcatggggacaactaccccatgattcaattatgtccacccgatcctaccctttacacttggggattatggaaactgcaattcaagatgcgatctgggtggggacacagagctaaatcatatcactctgtccctggccccactccaagtctcatgtcctcacatttcaaaacaatcatacctttcctacacttccccaaagtcttagctcattacagcattaacccaaatgtccaagtccagagtttcatctgagtcaagtcccttccacctatgagcctgtaaaatcaaaagcaagttagttacttcctagatacaatggaggcacaggcattgtgcctgtaaatacacccattccaaatgggagaaattggccaaaacaaaggggctacaggccctatgcaagtctgaaaaacaatagggcagtcattaaaccttaaaagttccaaaatgttctcctttgattccaggtctcacatccaggtcacactgatgcaagaaataggctcccatggccatgggcagctccacccctgtggctttgcagggtacaacctccctcctggctgctttcatgggctggcattgagtgtctgtggcttttccaggggcacaatgaaagttgtcagtggagctaccatgctggggtctggaggacggtaaccctcttctcacagttccactaggtagtaccccagtgaggactctgtgtgggggctccaaccccacatttcccttctgcactgtcctagcagaggttctccatgagggctttgcccctgcagcaaacttctgcctgggtatccaggcatttccatacatcttctgaaatccaggtgaaggttcccaaacctcaattcttgacttctgtgaacccacaggctcaacaccacatggaagcctccaaggcttggagcttggaccctctgaagcaatggcctgagctgtaccttggccccttttaactgtggctggagctgaagcagctgggagacagggcaccatgtctcaaagctgcacagaacagggggtcctgggcccatgaaaccatttttccctcctaggtttccaggcctatgatgggaggggcttccaagaaggtctctgacatgccctggagacatttccctcattgtcttggcaattaatattccactccttgttctgcaaatttccgcagctggcttgaatttctcccaagaaaatgggtttttcttttctatcgccttgtcaggctgcaagttttctaaacttttatgctctgcttcctcttgaacactttgctgcttagaaatttctgccacgagataccctaaatcatctctctcaagttcaaagttccacagctctccgggtcaggggcaaagtgttgcagtctctttgctaaagcatagaaagaatcacctttatccgagttcccaacaagttccccatctccatctgagaccacctcagcctggacttcattttccatgtcactgtcagcattttggtagaagccattcaagtctctaggaagtcccaaactttcccacatcttcttgtcttccaagccctccaagtctctaggaagttccacacttccccacattcttctgtcttctttttttttgtttttgagatggagtttcgctcttgttgcccaagctggaatgcagtggtacaatctctgctcactgcaacctccacctcccatgttcaagccattctcctgcctcagcctcccaagtagctgggattacaggcatgcaccacgatgcccagctagttttatatttttagtagagatggggtttcaccatgttggccaggctggtctcaaactcctgacctcaggtcatccacctgcctcggtctcccaaagtcctgggattacagggatgagccaccacacccagcctttactgtcttcttctgaactctccaaactattccaacctctgcctgttgcccagttccaaagtcacttccacattttagggtatccttataacagcaccctatgtctgtggtaccaatttactgtattagtctgttttcatgctgttatgaagaactactcaagactgggtaatttataaagaaaagtttaattgactcatagtttgacatggctgggcatgcctcaggaaacttacaatcatggccgaaggcacctcttcacagggtggcagcagaaacaatgagttttgagtgaaggaagaagccccttataaaaccatcagatcttgtgagaactcactatcacgagaacagcgtggagaaaaccacccctatgattcaatcatgtccatctggtcccgcccttgacacatgaggattatgggaattacaagattacacattaatcttaaattacacattaataagtgtgtaatgaaacatcccctttttttatttgagttcatttcaatagatatggaaataatagaaaatgcatctgacatcaaattcctgggaagtacaggtaaaaaaaaaaataccagatgtttaaaggtatttgaataagtaaatgttgcagtctgtactttatcagttagctatgatacaaaaaacaatgcatggcagttgcttgtcaattttgtgatttgttcagaaacatacatctctgcatgcacttagttttatacggcagtgcaaaatgtcaaaagcactgatgttgctcaaaggaaatggtaaggaactaactaaggctcactccaaattccttcacaaacccgtccaatcctgtgagtgtcgaggggccttcacatcacagcctgcatcctgacaggccctgtgagacccatcccgcttcatggaacgtgagtcagcagctcagagaaggacaaggacatctacataactggctcgaaatattcaacttttcaaaattttatattttcatacatataaatatatattcttaaaatgcatttttgtttttctatccgaacagaagtgcaataattctttaaaaatattcctaaacagaccggggcagtggctcacacctgtaatcccagcactttgggaggccgaggcaggcggatcacgagatcaggagattgagaccatcctggctaacatggtgaaaccccgtctctactaaaaatacaaaacattagccagacatggtggtgggcgcctgtagtcccagctactccggaggctgaggcaggagaatggcatgaacctgggaggcggagctttcagtgagctatccagccactgcactccagcctgggtgacagagcgagactctgtctcaaaaaagaaaaaaaaaaaaatttgtaaacaaacgatgatgaaaacaggaaactgaatacaattacgaacaatgaatttaatctttagtttcttctgctttatactatatgtgaatttggtctagaaaatacaacataaaaggaaataagtaaaaaccaaacgttgagcattactaaggtaaaaatgttgaatggaatactttattatgtatttatgtatttatttgtttgtttattgagacatggttttaccctgtttcccaggctggagtgcagtggcatgaccatggctcactacagtcttgaactttcatgctcaagctatcctctgaccttagcctcctgagtagctggaactacaggtgcatgccaccatgcctggctaattaataataattttttttttttttgtagaaacaggctctcgctatatagccagggctggtctcaaactcctgggcttaagggagcctcctatcttcatctcccaaattactggggttatagatgtgagtcatcaggtgtcgcctgaatgatatattttaatgatgtacctagcacatgagtttcaaagttttcactctccaagaattttcataaggtcagtttaattattaatagcatgttttacagttatagaattaatgcataaatacagtaaaacaaaatgtgaaactatagaattgtatgaaataaaaaataagaatatttcttctatctctgtacattttccatctttaccatgttcaacatatctttattactattatgaaaaatttaaagaatatacaaaaggaaataaatagcataatgaatgaatagtataattaactcattgacctaatacccagcttcagttttagacagtcctgattcctctgatcccacttccctgacatagattaattgaagagcatttctggcatcctgtcatttcatccatgaatatttggaggtatccacctccaaagggtaaggatcccctttttaaaataatacatctaaaaattagccagaattacttacttttacccaaaatccagtcgctgttcaaatttccctgattgtcttacttttttttttttttgagatagagtctcgccctgtcacccaggctggaatgcagtggcaagatctcggctcactgcaacctccgcctcctgggttcaagcgattcttttgcctcagcttcccaattagctgggattacaggtgcccaccaccatgcctggttaattttttgtatttttagtagagacggggtttcaccatattggcatgttggtcaggcttgtcggccaggattgatctcctgacctcaagtgatccacccacctcggcctcccaaagtgttgggattacaggtgtgagccacgctgcctggccagtcctacatattttttcacaccatttttctttttttaaaagagcagaatccttgtacggatattacgatggattgcagagtctctaaagcattcttcattcttattcttccccttccatcttttttttcatgcaattcgttaaagaaactaggacagagtccacagtgtagatttttatgattgtgtcatcactgtggtatcatttaacacgctactctgacctcagtattttctgtgaaacccacatgtcaggggtgttgggcagatttgtttgcttctgggtttgtgtttccaacactcagactcaggacctggtaacaatcccctatagcagttcgtaactatttgcttgattttgactgaacaccagagggcagtgcaggtggacaccaagagcattgctgtcaacacacagaggcctgtgggcacaggggtcctgcactgcgaggccaaagctcccttctctgctcccaagcaatctctttccctcctctgaaggacagccacatactctaggtcctaacctctggagtgcactaatgaccaagaggtgcatgagcaccaaatgtgagaggacaggagtctggaaacctagcacaggagtcttctcagaaccttaggacattcctactgttgtgagggtaggagaagaatgcctagctaaggaaacaagtgtttagtgtccaatgtgagtaactgccatggggaagaataaagcagggaagggcaagaagatgcccagggtggacaaagaagctctcattgataaagagacattagaacacacatctgaaggtggcaagatagtcagcctttcagatatctggagcaagcttgttgcactaagaggaaaaagcaggtgcaaaggccctggggcaggaacgtgctagttgtgtttgaggggggcagccagctgttgtaactggaacagagagagaagggggaagatggtagtgaatgaaatctgaaaaggaacagattatgtacgatttttaggccattataaggactttggcttttactcctgtgaatcagaaagctacgtgactggggtggggtagtgctttactaagaggagtggcgctctctgataatttttaaaggctcactctggttgctgagttacaaatacatagaatgagtcagctgggagatcaatggggaggcgattgcaatcatctggggtggctgctacaatctatgttagaaacttgcatggttcatgccttttattttaggcaagttcatcagcatttgcttttcagatacttaatgaatccttcagtctattcagagaataaggcatgtgttgaaatgatcagtacacagtattagagaatggaaagtcatgaatataataacagagacgcctttaggggcaacgtgaggtcaagagaggaagggactgcagccagcttggcaggtgagcctggcataggacaggccttccttgagatggtcacaaatacagttttatcagttttccttgtgatggtcacaaatacagtcttatcagttttcacaaataaaaccttacaaatgttcactaataaaatgctacaacatatcctataccatatgccaatttaagataggttttactccagtgagttaggttatctgtaaataacacatggtcaaatcccatatgtctgtgtagcaaatactttctcagtgtcctgttgtttttaatccagcatgttccaccagcctggcctaggctagggctggcacctagatagtcattagggtaagtgtgtgtttgttttggggtgtgggtttcttttggggtgtgtgtgtgtgtgtgtgtgtgtgtgtgtctgtgtgtgtaagactcattggctctactccaggccccctctatcaaaatttctggaggtgggaatcaagtgtgatactgatttggaaaccaccaattcagctcacagttttctagtccagtctgtaacagctgccttcatgacaaactgaatgctgaaagctgtggaaggtgccggtaaacaaaaatagaggtggagggaaagccatttcagacaaaggggatagagcactaaacaacataggagtcagaccggattggttttgcagtgacttctgatggcctttgcaagtgttccataactggatttgcctggaatgtggggttcagggtccttggaagagagtaggtagaaataaggttttggagcgtgtgaaattagattgtggagggcctcacatgttgagcaaaggacactaaagtttattttctaggtaatagggagccaaccaaaatttttaaaatgaatgatgacaccagagaactatggttcaagaactccacacgtctgacagtcgtgtgtaataataactgttgtgttatgagtccagagatgagaaagctttctgcattcattcaggagagagggggttgggtgcttaaataggaataggccactgggatgtgtaggttggaatgaatgtgagagacagaagacgtgaacagcagaagagaaaggacaaggtcaaacgtggcactggggttttaaatacaggaaattgggaggatgaaccagcagacttagcaagatacagaagaaaaaagagatttaggaaaaacgtagtatgggtcagccagatttggggatgccgatgccataaccaactataaccaatggaagatgatttaacacagttgtaagtatcttgaagccaatggtctgtttagatgggaaacagtctttcattttcaaatttaaaactttattcttaaaatgtgtacatttaatccagaataatctatggatatgtattgaataaatgcgttcatttttaaatttatatttgatttgtagtgtcccatttcactatagttttctgaagaaatctcagttctttatgcaaactgtatcataatagtcaagaatttaagattactttcgtgttcaaggtcctatctccaattatcctcttgcttaacgtgattgccttttgacctactttccatcttaacattaacattatattttttaattatcctgaatcaaatttcgatttaagaaactccaaaaataacaaaaattggaaacagcctataacattttaggaaatcaagaaatatatttaattgtaacacccactttcatattccacaagagaaaaataaagcaaagcctgatcaagacgtgcctttaacacaactcaatcacctttgagccttcattctttaccagtctctctattctctgtgcctattttctactctccctgagcagaaatttaagtgtcacattttgccaaggcctccattacatgagtaatgagtgcttacatatattgatatcccctgattttctgttggtgaagtttccaggaacattcattctcttgggaggagtagagactcaggtaaaagtcatgtctcttcatcttccatccttcagagattactggtggccagaacacctatgtgggagagtgggtatgggaagtggggtgtgtggataaagaaactctgttcgggagaggctcccagggatctgtgagtcagaggagtcacctatctttagggttgcacaaatctagcaccttctatgaaaactgcattcacccagaatgtgaaaagaaaaaagggatggctgagaacttttaaaattcagcaacagacacctgcccacaaatcaaagaacctcagagaacaccagatgctactatcctgtcataaattaggtagttattttattaaaataaaaagatagggccgggcgcggtggctcacgcctgtaatcccagcactttgggaggctgaggcgggtggatcacaaggtcaggagatcgaggccatcctggctaacacggtgaaaccctgtctctactaaaaatacaaaaacattagctgggcgtggcggcgggcgcctgtagtcccagctgctggggagggtgaggcaggagaatggcgtgaacccaggaggtggagcttgtagtgagccgagatcgcaccactgcactccagcctgggcgacagagcgagactctgtatcaaaaaaaaaaaaaaaaaaaaaaaaattgagcagataatagagttcctataaacaatctccatttccccccacagttcctccattataaatatcttgcattaatgtggcacatttattacaatagatgagccaatatttatttataccatcaatttatactaacgtccccgctttgctttgtatagttctatgagttctgacaaatgtatatcgtgtatccactattacagtattacgcagaatagtttcactgatttaaaaatcccctgtgattgagcttttcatccttcttctgctctcctcaaggcccttgcaaccactgatcttactgcctctaaagttttgtctttgccagaatgtcatatggctggaatcatacagtatgtggctttttcagactggtttctttcacttagcaatatgtacttaaggttccccttgtctttttgtggcttcacagctcaatacctttcattgctaaataatattccaatgtatacgtgtaccatagtttgttcatccatttacctattggatatgttggttgcatctggttttagatgatacgaataaagcttctataaatagtcatgttcaggattttgtatggacgtaagttttcaattcaattgggcaaatacctgggggcatgactgctggattatatagcatgtttagtttttaagaaactgccaaactgtcttcccatgtgactgcaccattttgcattcccactagtaatgaaagagttttggttgcttcgcatccttgccagcatacagcactgtcagttttttggagtttagtcatgctaatagttgtatagaggtatctcattgttgttttaattttcaattcctttttaaataatttcaacttttattttagattcagggggttcatgtgcaggtctgttacctgggtatattgtgtgatactgaggtttgaggtatgattgctcccatcactcaggtactgcgcatagtacctaatggtttttcaacccttccctcatctactccccgccagtagtccccagtgtcagttgttgccatctttatgtccctaagtacccagtgtttagctcccagttataagtgaaaacatgcagtatttagttttctgttcctgtgttaatttgcttaggataatggcctccggctgcatccatgttgcaattccttgatgatctatgttattgagcatattttcatctgcttatttgccctttgtgtatctgtagtgaggtgtccagattttgcccactttttaactaggttttttttccttattgttgtgttttcagtgttttttttgtatatgttggatatattgatatattttttgcatatatgtatatgtcggtgtattttagtgatgtaaaatgaatggaatctatagccttaaacataatataaatatataatggttaagatttcccactcaacaatccaggcttgacagaaaatcataaaatgtatttaaatgtaaatgtttttttctttgttgatactagttcttagttttaacatgccgaagagggtatatttgatcaaggacaagattaaatgttctgattggctaactatcaaaccgctgcctccacttttttttgcaacttgaaaataatatttagttatcacgctagcacagccatattaatatataccccttcaaaactttaaacataaagctttaacggtttcaggaaaaagaaatattaatgatgctgagattggtggacacggattctgtgtagtgagacactaaaaagtaatttttcaaacaggaaagttaaagcactttaaaatcacaaagctattggtaattaaaaaaagaattagtatcaatttctgaaatacaagattagagggacacctaaaattctgaaaggtcttacagaattttttaaaaaagtaattgcaatttagatcaaagttccccacttttcattccaagtgtgacacaggtttaaataataaaccgacaaaaagtttagataaattcatgaattattgaaccagatgataaaaaatagggaagctatttagggcatagtctctagtgtgtaagggtgacatcctaaataataaatttatgctattgttgacaatattgctgacaaggctaaatggtcaatgtgcttgacatattgcctggtttttcatgttctattgcatgagctgattctctctctctcttttatttatatttttgaactctgccattatgttatcatggacattatgccaacaatttgatgcatctatgtatatgctttaaatctctgggaataaatttactgagtgctacttatgtgaacaaacttctcttaagcacaaatggaaatccacaaagaaagacagcctcttctatttgttttatgtgaggcaacagatacactgtagacaaaaagaccaagtataattaactcatattggtaactaacaatatctgcatattacatatttttctattatgttttctgagcaacttcgtggcttctgatttggaggggtaggatttcatagttaatacttttttctttttttttttttttttttttttggtgagatagagtctagctcttgttgtccaggctggagtgcaatggtgaaatctcagctcactgcaacttccgcctcccaggttcagatgattctcctgactcagcctcccgagtaactgggattacagacacccagcatcatgcctggctaatttttgtatttttagtagagatggggtttcaccatatttgccaggctggtcttgaactcctgacctcaggtgatccgcccgcgttggcctcccaaagtgctgggattacaggcgtgagccactgcgcccggcccatatttaacacttctataaatatttgtgcatattgaaaggaacattactccccacactgcaactgaacaaatgagtgataatgttaatttccttattcttgagcttttcttgaataaaagagggtcgtaggacatggaacaaaatagactagaaaatagggttgataaggtactgattctgccaacactgcttaatgctctccccaagcaattgtcttttagatatgttgatttcccagtgtgaatggtattttttaaatatgtcaagcaattaagaatataagtctattctcatctcagctaaacgtagaatctttacagagaatttgtggtatccttaaccctaatatgtggagagatatgattaaaaatgttcaccaccttattttcatttatttatttatttatttatttatttatttatttatttatttatttattattttgagacagagcctcactccacccagactggagtgctgtggtgtgacctcggctcattgcaacctctgcctcccaagttcaagtgattctcctgcctcagcctctcaagtagctagaattataggaattcaccgccatgcccaactaatttttcttttttttttttttttggtgagacagagtctcactctgttgcctaggctagagggcagtggcaccgttttggctcactgcagcctccgccttctgggttcaagcaattctcctgcctcagcctcctgagtagctgggattacaggcacccgctaccacacccggataattttttgtatttttcgccatgttggccaggttagtattgaactcctgacctcaagtgatctgcctgactcggcctcccaaagtgctgggattacagatgtgagctaccacatccagccatcacctcttgtaaagtgcagtaaagaaatagtgggcaatagacaggcaggggatagaggaaaatgttttgggagtgggacaatatgaacttattgtcatgacaggaccaaaaagggaagacgtctgcctatcataattaatactaactctatcagtcaacatttatgttttacaattgttctgtaaaagaaaagccagcaaacattacagattctagtccctaataactgatcaagaaagacactctaagcttgtgcatcagcattctctttttatctaaaagaaaatatattaaatacagggaggaatggcaggagtaaagagacttgaaggaaaagaaaatattgactttttaatgatattttacaatgctaagatctttagaaaccaactattccatatgtcctttaaatattagtttggtgcaaaggtaattacagtttttgtcataaaagtaatggcaaaactacaattacttttgcaccaacctaactgatacattcattccattttggaggtattgcaaatatgctgaatcaatgaatttcttcagtatttttcattgtattagtacaaatttaacctaatagtattcttctgcatgttatttccctttgtgcttcctttaatgcaatgaagttgtagttaccaaatagagtgccctaaaagggcaaggcttgtctgtgaattgagcctagcatagaattggctctcagtgaagatctgttgaacgttacatgaatgcatcaacgtcataatccttcatgtgcttgtaagcaattagtaaaattttctctggcctattcaggcctgtgttcttcaaaattcttcaaaatatatggacgtgtttgctgtttctattaggttttaacttctggtatcagaaaccagggctgtttttcttaatttgtgtcctaaaactacagtagggttgtatgcattgtgataatgcttaataaatatataaaaagattaatatccattcatttacattttcttaatcaaacccaatttctggaggagtagctgtgaaactctcaactggacgagctctgactagtgttaagtataggatattgggaaaagggcttctatatgcaacatatatgtgaggcaaatgagaaatattagctgggctacattaaatcccaatgacatgaatagaaattttattatccaggtagcaaaaatgaagtcaaaaaaataaataagagaatgaagtaaaggtatggggcaaaacaattagctttttctttaagtcaatattttagaaaatagcttttgaaggcccaatcacacagaaaattgacactttgacttttctttgcactgtgttagacataggtaaaaggatgtctcagcactgtaccttcatgtagaaaatgtaattaataccaaattgcataaaagtacactaaaattttaattcttacatcattttaataaatttcttgagattttactttatttagtgtgtcattaaaacacaggatttaaggaagatatatataataaaggaaaatggtaagttaccattcttgtgtaaacacgttttgtaaatactatttcaacaaagatttaaaagttaattacaaaggtataaagttatgaagtattatataaacaggattcataattttgttttaaatggtcttttcatgtatcaaaatactatcagtttaaaacaaccttttattttaaggcagtaggctctgtttaccatcatttacaattgctttaattagaattttcttcactttcagtatattcaagagctattctgttggccataatttttaagataaagtttatccaaatagaaaagtaattatataatgattaagtgccagaatgtgtgggttcaaattccagttctgctacttatcaggtataagaatttgggcaaatttcttagtttctctgtgcttcagtttcctgatctgtaaaactgggataacaagactacctgcctcaatctgtggttatgagtaaatgagttaatacataagagcaatgcaataatccttggcatgtggtatgcgttcaataaacattagctattattattatagtaaattagaaatttaattctagagaataaaaagctgaactcaaatatgtaactatttattcgatacaggcacattttccacaaaataaaaaaccgtcagtttgcacttgccttatataatgactattctggtgtttgtgtgtatctcttgtgggtcgggggtcttgggctgagtaaataatcacattaaaaattttaaagacttccgattaaaacagaaataagaacaaatggccattcgtggatcatttgcaaagctgaacgaatacttgacatgtctttctgtgattccttgcagatatcatggaaatcaggacagtggcagttcggattgtggcaatcaaaggggtggaaagtgaattctatcttgcaatgaacgaggaaggaaaactctatgcaaaggtattgataattgatagcttaggcttaatttttaaaactcatttttgttgaaatatctcaccattctgaaaagtaaacatggacttaatctatctccaactgtataatttaatgattttattaaaacactttatactcaaatgttaagaaaaaatgttttctgtgtgactttggacaaatggcttgttctttggattctggtttcttcatctgtaaaatgagttgaattagctgacctctaaggagccttccagctctaacattccatgtgcattttagatatttaaaatccaaaatttccatttgccagtattaaagctctttttgctaaagttcacccaatttgcacattgctgacatgaaaattcttgggaaaaaatcttgaaatgtttagttcattcatcaacatcaatctcacaatcatgggctttgaactgtaattattcacattgttcccacttcactacaatgcaaaatatgtaacagttcatcccactgtaataaaatataattggctttcctttgtattcccacagctcagcataatgcctggaacaggctaattatataatgatacaggtttaattgaatgaacaaatggttgcatggatgaacaaacaaattaaccttttatcttccattaccactgaagacagtgtacaagtaaataaagaaaagttgtgaaacaagtctctcacctgagggaggcagaggttctgctaattctaccaaatttccagtggttaaagaatgagtgatgtgggaagagtaatttgaggcctgttacttagggggaaataggtcctaattttaaagaatagttgacatgaacttccaaaaagctacacatatttcacactagctgtgcattatgtggtgtctttatttcaaatttaagatacctttttatgcaaatatactacataagtctagctaataaaccacattaggcctgctcaatctgagggttaaaaaaagttgtgtatgtttcaattctaccaaatattgctgcttactcttcgtttaattgagcctctctaaaaatcatttggataatgtttgtgtgtttgtttgtttgtttgaacagaaagaatgcaatgaagattgtaacttcaaagaactaattctggaaaaccattacaacacatatgcagcagctaaatggacacacaatggaggggaaatgtttgttgccttaaatcaaaaggggattcctgtaagaggaaaaaaaacgaagaaagaacaaaaaacagcccactttcttcctatggcaataacttaattgcatatggtatataaagaaccagttccagtagggagatttctttaagtggactgttttctttcttctcaaaattttctttccttttattttttagtaatcaagaaaggctggaaaactactgaaaaactgatcaagcttgacttgtgcatttatgtttgttttaagacactgcattaaagaaagatttgaaaagtatacacaaaaatcagatttagtaactaaaggttgtacaaaattgtaaaactggttgtacaatcatgatgttagtaatagtaatttttttcttaaattaatttacccttaagagtatgttagatttgattatctgataatgattatttaaatattcctatctgcttataaaatggctgctataataataataatgcagatgatgttatataaggtatatcagacctacaggctgctggcaggatttgtcagataatcaagccacactaactatagaaaatgagcagcattttaaatgctttctagtgaaaaattataatctacttaaactctaatcagaaaaaaagaatattctcaaaaaaatctattacgaaagtcaataaaatagataatttaacaaaagtacaggattagaacatgcttatacctattaacaagaacaaaatttctaatgctgctcaagtggaaagggtattgctaaaaggatgtttccaaaaatcttgtatataagatagcaacagtgattgatgataatactgtacttcatcttacttgccacaaaataacattttataatttctcaaagtaaaattgagaaatctttaagtttttttcaagtaacataatctatctttgtataattcgtatttgggaatatggcttttaataatgttcttcccacaaataatcatgcttttttcctatggttacagcattaaactatattttaagttgtttttgaactttattattttgttatttaagtttattttatttattaaaaaaaccttaataagctgtatctgtttcatatgcttttaattttaaaggaataacaaaactgtctggctcaactgcaagtttccctcccctctgtgaccgagactaagtctagcacacagcacttgggccagcaaatcctggaaggcagacaaaaatgagaacctgaagcaatgcttacagtagatgtctcacacagaacaatacaaacatgtaaaaaatctttcaccacatattcttgccaattaattggatcatataagtaaaatcattacaaatataagtatttacaggatttaaaagttagaatatatttgaatgcataggtagaaaagtatcatattttaaaactatgtatatttaaatttagtaattttctaatctctagaaatctctgctgttcaaaaggtggcagcactgaaagttgttttcctgttagatggcaagagcacaatgcccaaaacagaagatacagttaggaataaggggccttgaatgtcatgaaggcttgaggtcagcttacagataacaggattattaaaaagatgaatttccacttccaaagtctttcattggcagatcttggtagcactttatatgttcaccaatgggaggtcaacatttatctaatttaaaagctatgctaaccattgtggttttaatttcaaaatatttgtcattcaagtccctttacataaatagtatttggtaatacatttatagatgaggcttatatgaaaaggctaggtcaacaaaccaatagattcatttaattttcctgtggttgacctatacgaccaggatgtagaaaactagaaagaactgcccttcctcagatatactcttgggagagagcatgaatggtattctgaactatcacctgattcaaggactttgttagctaggttttgaggtcaggcttcagtaactgtagtcttgtgagcatattgagggcagaggaggacttagtttttcatatgtgtttccttagtgcctagcagactatctgttcataatcagttttcagtgtgaattcactgaatgtttatagacaaaagaaaatacataataaaactaatcttcattttaaaagggtaaaacatgactacacagaaatttaaatagaaatagtgtatatacatataaaatacaagctatgttaggaccaaatctctttgtctatggagttatacttccatcaaattacatagcaatgctgaattaggcaaaaccaatatttagtggtaaatccattcctggtagtataagtcacctaaaaaagacttccagaaatatgtactttaattattagtttttctcctattttaaaatttattatgcaaattttagaaaataaaatttgctccagttacacccacttagaattccagaatcttaaaactgtaaggggcctccatccctcttactcatttgtagtctaggaaatcgagattttgatacacctaaggtcaagcagctgagtagatatacaactgtcacaagagtctagatcagttggcacatgctttctatactagattattagtattattagctaatggtcttctgcatttttttgtttttttatttctattgagatatagcctttacatttgtacacaaatgtgactatgtcttggcaatgcacttcatacacaatgactaatctatactgtgatgatttgactcaaaaggagaaaagaaattatgtagttttcaattctgattcctattcaccttttgtttatgaatggaaagctttgtgcaaaatatacatataagcagagtaagccttttaaaaatgttctttgaaagataaaattaaatacatgagtttctaacaattagaaaggaaaaaattaaaatatgaaatgataacaaaagtaaacaaaagatactttcaaagcagtgaacaaaacattttgacataagccataatataaattataatataaaaatataaaaaccatagtataaattgtcaatctttgagttggctatgaattcaatttaatgacagaagagaagggatgctggaggtaaattcttagagtttctatctcatagagtttgctcttctgattctctagactgccaaagaacataaagatgtacaaggggacctagctgtagtaaaagcattgctataacaacaaaaactctaaaacagtgcccctcacgattttctactgaaatttctctaacagtagaggtataaaacaagaagttagagaataatgcagaaggggcccaccacagaaatcacatttcttttctgttaagactcatgtgatttttgcatcttactccataatgtattagtggttgcgttaatatgacaatgtctgcaattaaacaccagtaagcaaaatcgatacatcagaatgacttgcagggcttatcatgcagtttcatttacatccctatcccactgccatttacttgagcgtgaatgacacacgagagattctttgccttccatgatccaactttacacataaataacacaaggctaaagaaaaccagaactcaaattcaccatgcataggagtgataacaaaaatatttaacagtcagtatgggtgattactggccaatcagaatacgtcactgatatatcaaaatggatgcaggccactgtgactaacttgtgggtatcatttctatgatcaccctaaaacagagttgggaaaatatcaattaactggtctctctggtttgaattctcaatatgtatcttaatatgaaatagctcattaaaacttcatgtgtaactatttcagcattgttgtcagctactctttattccacttctgtacagtatttattcaaccaagctgctgctttcaatgaaggtcacttgttccttcagggacacatgtactcccacctatcctttaattttgaatggtttgtcaagaaaatttactttctcttgagttgaaaagacttgacaggaagcaagaaataatacagtcctagcctctttccagtaacatctgatttctccattctcaaactacacttctcagggaaccagatatttactctcgtctgggaagatgcctcttatgttttccttttacttcctggttatcatgtggttgcattttccaagttcttatcattgaatttatgagagcctatccaaatttattttcttttattttctaataattgaaatgtgagatgaaaataacatttcacttatgaaaaacgcttctcttgatgaatccttccatgtgttagttatctattgctctgtaacaaaggtgttagttatctattgctgtgtaacaaattaaaacttaatggcttgaaacaaatatttgttttctcatagtttatgtggctcaggagcctggacgtggttcagcacagtgtttttggtcagaattcctcatgaggctgcaatcaaggtgtagaccagggctgtagtcatctatctcaatattcaactcagaaagggatccaccttagatcctcactggctcttatcaggacctatcacttccttaccacatggacctctccatagcattgcttacaacattacagtctgtttcccacggagcaagaaatcagagagtgtgagataaagtacccaaaatggaagccacaggtttgtttgtttgttttaatatatataacctagtttcaaaagtgatgttacctctgcctacactcatgaggagggtattatacaagggcatacataccagaaagcagggatcactggaagtcattttacaggctgcctaatccaagtcatgaactagatgtttttaatgtcactgccataaactgggattctacagggtctaatgagagtaattaattcatggctttcagtggggatccattcagcagagaaagagatgaaatatgtatattctctgtggaaacactcttgattcttccttgagggatactgcgtggtccattcctacacaggataattaagaaaaggtttgaaccaatctggacttcctattagcctgagatgtggctacttagaactcccaatgtagctggaaaactaacaatatccctttgcctccacatgaagcaaattaccctgccatcagactcaacatgaagataatcctcccttcagctgctctacctcaagagaaaaagatcatagatgccagctggaattcctctgggccatagagtgttttattctagatgctgaaggcaatcagccaccatttacccaagaccatctgagaataagacctaaaaagacttgaaaacaattgatttcaatggtaggtacacactggtatcccctgttctgtatatatctacagatacttagatatatacaaaacaggatagatatatatatatatatatatatagagagagagagagagagagagacagagagagacagagagagagacagagagacagaaagagagagacagagagagagagagagagagaaagaaacacctaggccccaactcaggccaattacatcagtgtatatgacaggtggcccatgcagtcgtattttaaaaattccccagaatattctaatgtgcctctgcagttgagaactaattaggtaaatgcaaacaacaacaaagaccaaaaaatgtcttcagaaactatgcctgcttcttcatctttgtcgcttctttaaacaccttgaaaggccttattccctcccagcccctcctgcccctaggttttcctagatgcttccgtattttctgctatgcacaactggggctcataggaaatgtaggcactagaaagagagttacaattgtttttgcatcagaatgattatggaatagaaaaaggcatttcatgcaaatggacaccaaaagcgagcagcggtagctattctcatatgagacaaaacaaactttaaaggaacagtagctaaagtagacaaggacagacagtatataatggtaaaggtctcatccaacagaaaaatatgacaatcccaaacatacatgaacctaacaccggagctcacaaatttataaaacaattactagtagacataagaaatgagatagacagcaacacgataatagtgggggacttcaatactccactgacagcactagacaggtcatcaagagagaaagtcaacaaagaaacactggatttaaactacactttggaacaaacggacttaacagatacatacagaacatttcatccaacaaccacagaatacacattctattccacagcacatggaattttctccaagatagaccatatgataggccataaaacgagtctcagtaaattgaagaaaactgaaattctatcacgcactgtctcagatcacagtggaataaaactgaaaatcgactccaaaaggaatcttcaaaaccatgcaaatacatggaatttaaataacctgctcctgaatgagcattgggtgaaaaacgaaatcacgatggaaatataaaaaatttcttcaaactggatgacacaacctatcaccacctatgggatacagcaaaggcagtgctaagaggaaagtttgtagcgctaaacaccgacgtcaaaaagcctgaaagagcacaaacagacaatctaagttcacatctcagggaactagagaaacaggaacaagccaaacccaatcccagcaaacaaaggaaataaccaagatcagagcagaactaaatgaaattgatacaacaacaataacaaatacaaaacataaataaaacaaaaagttggttatttgaaaagataaataaaattcatagaccattagcaagattaaccaagaaaagaagagagaaaatccaaataacctcactaagaaatgaaacaggggatattacaactgacaccactgaaatattaaaggttattcaagggtactatgaacaccttttggcacataaactagaaaacctagaagagttggataaattcctggaaaaatacaaccctcctagcttaaatcaggaagaattagataccccaagcagaccaataaatcaagcagtgagattgaaatggtaattttaaaattaccaacaaaaaaagctgacgaccagacagaatcacagcagaattctaccagacattcaaagaatgtcttccttcattcaaagaagaaatgataccaatcctttcacactattccacaagacagagaaagaagaaaccctccctgattcattctatgaagccagcgtcaccctaataccaaaaccatgaaaggacgtaaccaaaaaagaaaactacagacaaatatccttgatgaatacagatgccaaaatccttaataaaatactatctaactgaatctgacaacatatcaaaaagataatccaccatgatcaagtgggtttcataccaatgatacaggaatggtttaacatatgcaaatcaataaatgtgatacaccaaatgaacagaattaagaaaatctcacacgattatatcaacagatgcagaaaaagcatttgacaaaatctagcattgctttatgattaaagctctcagcaaaataggcatacaagggacataccttaatgtaataaaagctatctaggacaaacccacagccaccataatactgaatgggggaaaggtgaaagcattccctttgagaactggagcaagacgaggagcatgctctcaccactcctcttcaacaaagtactggaagtcctagccagggcaatcagacaaaagaaggaaatagaggaaatcgaaatcagtaaagaggaagtcagactgtcactggttgctgacgatatgaccttttgccttgaaaaccctacggactcctctagaaagctcctagaactgataaaagaattcagcaaagtttccagatacaagattaatggacacaaatcagtagctcttctataaatcaacagctaccaggcagagaatcacatcaagaactcaaccccttttacaatagctgcaacaaacaaacaaacaaacaaacaaaaaacaaaacttaggaatatacctagcaaaggaatcaaaagacctctacaatgaaaattacaaaacactgctgaaagaaatcatggatggagccaagcacggtggcgcatgcctataatcccagctactcgggaagctgaggcaggagaatcgcttgaacccaggaggcagaagttgtagtgagccgagatcacaccattgcactcccacctcggcgacaagaccgaaactccctctgaaaaaaaaaaacaaaaaaaacaagaaagaaaagaaatcatagatgacacagacaaatggaaacgcatccccatgctcatggatgggtagaaccaatattgtgaaatttaccattctgttaaaggcaatctacaaattcaatgcaatccccatctgaataccaccgtcattcttcacagaattacaaaaacaattctaaaattaatatggaaccaaaagagagccatgtagccaaaccaaggctaagcaaaaagaacaaacctggaggcatcacactacttgatttcaaactgtacaataaggccatagttaccaaaacagcatggtactggtttaaaaataggaacatagaccaatggaacagacgagagaacccagaaattaacccaaatacttacagccaactgatcttcgacaaagtacacaaaaacataaagtggggaaaggacaccttttcaacacatgatgatgttgggataattggcgagccacatgtaggggaataaaactggattctcatctctcaccttatacaaaaatctactcaagatggattaagaacttaaacctaattcctgaactataaaaattctagaagataacactggataaacccttctagacattggcatgggcaaggatttcatgaccaagaagccaaatgcaaatgcaataaaaacaaagataaatagctgggacttaattaaactaaagagcttttgcatggcaaagggaacagtcagcagagtggacaacccacagagtgggacccctgaccctgacccctgacccctatcctctgaccctaactcctaacccctaacccctgacccttaaccctaaccccttaccccaaccctcaccctcaccctaacccctaatcccaaaccactaacctctcttaacccctaactctaaacgttgactcctaacccctaactctgaccccaacccctatctccaacccctaaccctaaacttaacccctaatccctaaccctaacaccaaccttaaccctgggttcgttactacgtttgtattgactatgtcaatgttgattattatgattgctgtcttaggactgcatggcagcgaggggattgcggatcttatattaatatttttgtattgaggcagtgcattagcattacaggtgcttgttacatgagcaatgggggtgtcatattttgggtgtcatgtctgcattaggaatgctgcatttgtcttctgaggctgtggtgtggatctcgcactgcggccgcctcgccttggctggggagaacgtcggtgggcaggattcagaggggcttttggtttcccgttttccacactgaacccttctaactggtctctgaccctgattattcagggctgcaaacaggaaggattttattcaccggggatgcggcccggagttgtcccaaagcgaggcagtgcccccaaggtctgtgctgagaacgctgctctgccttcgtggtgtcccccgggtctgtgctgagcagaacgcagctgcgcccttgcagtgcccccggcccgcccgcccggctctgtgctgaggagaacactgctctgcctttgctgtatctctgaagtctgtgcagaggagaactcagctccaccctcgcaagagggtgactgggtagctgatgaatggcagcccctcctgcctgaatgccctctattgctgggcactgctgcacagcacctttttcctggccttaatacttaacaatcttttagagagctccatgcctaacactgaatcttaaaatgtgacattcttcctataaaatcaatacttaaaccacattttgtaaattcataccaaaatagaaacccaggaaaaaaagcaccccttttgtcctctattttaataataagagggaaagggggctgggctaaagggaacggctgccctttctgtgtgtggaaagctataatttaaatatgcacaccagattttcaagcagcacactctaaagcatcagccctgttattcagatgatggagtttgcagactttctgtttgccctcctcttgcttttcccacctttggggcttttcactgtccccagaaacccaaccttagaatcgagaaagaaggcaaagaccatatctaatagactcataagctccttattaataatagttcagtaaagtgtaaatggggtaggtgcctttttttgcaaaacaaagtttctagattctctgtgttgcatttagccaggccctcatttctaaccacagggtagataatcaagttaacaaagactgttttgtccttctatttccatatggacgtcatgtttcacacctgcactcctgtctgctcggttccacaaagggacagtaaccactgaccgcattttaaatgttctttgactgcttgcattttcaaaagcacagcacacgagcatctcggtcaagatgagctggtaggacctctcctgacaccctattccctcacggtggacttctcactggaaacctccactttgctgcttagctcagtgtgtctctgcaaataggcatgtttaagcaaagaataaatgcctaaggcgatgcaggtgggtagcaggggagagtcagggagacaaaaagaacagtagcacttacatggagctctgccagcttttgggctaacagggtcatgaacagatcaggaacctgagacaatcaaaggacttcaccccacaaagccagggcactctcgggagctggaaaacccaggagaatttccacatattcctgagagttcctcgtacattacctttagtgcctcattagcaggaatgggtccttctgtagtttcaccagactgtttcgcagtagaaagaggacagaccaaggagccccagtcccacctgtgacctcaggcagtcacctgacacccctgagcctcagttttctcatctgttcagtggggatggtatattctccttacagggctgtggaaaggacaacataatcttacacagaaaaagtagtactaagctaacattggttgagtgcctattacattctacacaacgcgctaagtactttgcatattttgtctcattgaatcctgatgacaaccctgtgaagtaggaactcttactatcccccatgctatggatgtagaagctggggctcagagcagttaagtacctggccaaaggccagaaagtcaactagaattgatgtgtccattttcattcattcatcattgattgagtacccgttccatgccaggcaatgagaagcaaatcacaaatagtccctgccctcatggcactgacactcttgttactgcaaagtacaaggtgcagagtaaatggaagtcaaatcagattccaacttctactcaactcccagtaggccccagactaaactctccagaacaatggtactgctcctgtggttttgcctggtgctcacgattgagacatactcaaagaagagactgctggctctgcaggtcctccagggacagaaaccaggaatgctggccaatacagaaacatcataaacattttccttgtatttcatgcattcctggacccatagatctgaaagcaaccttgagaatgaactgaatttatttctctgcctctgaggaagattacatttgaactctgcgtgacagagatccagctagggaatcttcaccttaaaaacctggctaaacaaagctcgtattcataaacagtgaacttaagggcatccccatgcctttaaatagtgaacactctggtgcattttaagcaggactgattcagtgtattctcttagcacagttttcaggaatgcaaaatatacctgtgcccagcatcttaaggcttttaaaaagtagatgatgcctttctctctgttcacttacaagctcacgcctttaaaatcatttgtttggaagtccttccttaaatctaacctgaatccaacctgctgtgcttaaggttacctcagtaatctttctaatacaacccaagagagaaggactggagggaagaatttaagacccccatgagatgaggagcagactcctaagttagttgtatcacttgtggctaaatgttgaatcatttccctaattttttctagccactcccaggcactccaactgtctctgagaattttcttcttggacacacttaaagaagcatctgaaatttgtgccatgtagcttagcacttactcaacaaggatgaatcttagagaccatcaagttttgcccaagcaggagagaagaggaaactgagattcagagaactgtgacttaatcaaggacccatagcaaatctgtggcaaacctgggaaggtgacccaaactccagaccccaagcccggtgctttttttttttttccagatctatgtctcccccacatctgactctgtttccctgaggtccagagccattccctgttcctttttaggattctcacgacccaggtttaggcacattagttgtccaaagcacacttggcttgctctgacttgagcagtacaatgagctatgtcttagtttcaggcaagaccaccttgaccatgggacatgaaaaggcactctatggggcctctactatgatgtagcagggactgtgttagcacattgctatagccctgggaagcaagaattcttagcacccattgcccagatgaagaaactcactttcagagagggtaaagaatgtctctgtggtaccacagctatatagtggctaggctggaattcaaaaccaggtttgcctgcctccttctcctgtatgatactgcttcatacacagtccccagaaccttaacgaccaggtggaacgaaccaacaaggtcatactgaaattgtgcaccagtgccctaacgaccaagagaaaatacatttcatccaattcaaaggtataaagatgtaaggtagaagccaccaactgtggacatggaggagcctcagagcgacagcacctgctgtccagggtctcctcctcctctcttccctcgcagtttctctctcccttcctttaacacttattgactacgccagccacacagtaagcgctcaataagtgtttgggcccataaccttcctatgggaaagccccttcactttctgaacatggcctggtactgtccagatgcccttctgtcctgtgtggtcccaggcaggggcatctccttctcttccaggaccactctgaaccctaacttgatggcagctgcctggtgatctcatcatcctcctgacatggccatgtagctcctcagcttccatcattcctgaatctctgcaaggttatggggttgccttgctccagaggacacaaaagtgcttagctctgcttggatttgctcttggatggtggagacctgtgattgctcttccgctcccttgagccttcctcatggaggtttgctgaggcacagtctgtgattgattcctcatgcccctgctaggttttaacaactggtgaaaacgtctgcttatatttcactcacactcccctggctgcgggttcaagtcactgttgatttggtcattgggttacacacacgtgcagcctgggtggacctgtatgagtcttcccagcatcagcagccttgacctctcatgaggtcactcccctaggctttgagaaccactccttgaatatcatcttggaacgtgtaaaacaaacaacaagaagtttgaaagggctcaggactctgcatttgaagaatcaaactatactatcttctgggcaagtcactcccttccttggacatgagttattccattcataaaagggaagaacagggatagataagcttataggtcccttctgcacccaggctctgcctgattctgctgaaccacaacttcgggagggtggccaagaggtctttctggtccctggctgaccgctttcatctattcccttaacctgaggtctgaaaacacattttttttttttggcttcaaaatacaaaaagagaaaactgaaaaattgaaatagataaaagtttaattaaatgtctacataatggaatgttatgtaaacatcattgttaaggttgatgttcatacaaattgtattacacttaaaaacaattcgttccttagaattactcaccttgaaagggtttccaaatacgtccagcgattgctaaggcctcatagccatgagttagtcacagccaaccacaagcaaaatcattaaaacctcttttaaacatactacagcaaataataataataattaacgtgaaatgtgggtgactttcagtatgtttgataaaatgtggggtgaaatctccaaaaggaagagcgttcagggtcttcaaaagtcttaggattactctagaaccagagtatagaacatgcactcatatttataaatcacttactctgtgccaggctcttctgaagcccttcccatgcattaactcacttaattgatgagacagttcttgaggtagacacaattaccattcccattctacaggtgaggaaactggctaagcaagtaagtggcacagctagaatggaaatcaatggtgccagggctcatgttctcagccaccttaccacatacaaagcttgccatgccgggtgtttccccaggagaaaacaagtgctggcaggttgagaagggagggaggtgcatctccctaatgaggagtgcacttgacactgcgttaaatggaacccattcctctctcggctctactgctacttgctaactcctccgtggttctcttctgcccacagaggtctcctctgtagctgactctcagccttgcctaatgctattaataataaagaggtgatgttattgagagctctatcagcattttatataggacttaatctcattcaatccccatgacctccatttcataaacaagggaattgggggtttagagaactgaaacaatttgtccacagtcacatagtctcagaaatagtagaagccaggattcacactccaatcttattctaaagcccaaattctctcttttttttttttgagacggagtcttgctctgtctcccaggctggagtgcaatggcgccatctcggctcactgcaacctctgcctcccaggttcaagtgattctcctgcctcagcctcctgagtagctgggattacaggcacctgccaccaggcccagctaattttttgtatttttagtagagatggggtttcaccatgttggccaggctggtctcaaaattctgacctcgtgatccgcccacctcggcctccccaagtgctgggattacaggtgtgagccaccatgcccggccccaaattatcttttaattataaagatatacatattgtttaaacaattcaataaatatgtatactgaataacaaagtgaagccttccctttaccacaatcagcctactgttctctctctatctgaggctctcttcctacgttccactgtcccagacttctgcaaagtatttatgtatctgtttaggtatctgtccatctttccattcttttctcaattatatattctcgtggtttcactctccatgcggcaactctacatccaggatcaaaacggcatcaaaggaagcttggaacagtgacaacccctacctgagatgtctccattccgggggaaggctgcctggtgcctgatatccatgagattagggaaagcaggtggggtcctgtccaccccctctattccagaacgcttggcagggtttctgtggctaacatgccagttgtatcaactcccgcacagtctcatgtgaagtgccacactacgttctcaacctggaaggtttcagggctcagctggctcagatcccatgtgtggggagcattaagaaaaataggccacctgtataagactagtggcaaaaatctgactcggtgctacttctctgtttgtcctttacttaaaaggagaaccataattaaaatgatccagaaaagagaaccaagcaggagactgagttgcttggggaaaggaccatgttgcattgatttttacataaccaatgccagcagtgcatcgggtacacaacaggttctcaattaattgttaaatggataagttgatagaataaaaaacaaggtctcttcccactgctgcatgcaaaaaagctcagagtgaattcttatttgcaaagatgagagatttttagtcttctgatggctgtttcctcctctctgttttctttgccacagtttaggggcaaagaaaagtttctacctctctgaaatggtaggagaaacccttggggcttaggtaacaaatcaggctctctctttcacatgttgtgagaaaagaaatatttaaccatcagcaccaacaatgtcatttgcataagggagtgacttcctggctgagagatggtcagaataacatagagcctagagtgaaggcagtcaagtttgtgagcctagggctctgcttctggtgtctgcttcatggctgtgtgatcttgggcaagtttcctacattttctgcttctcagttttgtcatccataaaatgataacaacagtacctgcctcaaatagtgtgtggaagaggcttaaacaagctaatgtaagtcaaatcttgagcacaatccctggtgtagctatacatgtttgtgtatatatcagaagctcaaaattctaccattagtattaataacatactctgaaccctcattataatgctattctcaatatcccaacacttgatttctattgacaactcctaggctcaactgttcctcccacctcagcctcccgagtagctgggaatacagccaccatggatggctaatttttaattttttttttttgtagagacagggtcttgctatgttgcccaggctggtctcaaactcctggcctcaagaaatcctcccacctggacctccccaactgctaggatttacaggcatagccaccatgcccagctcccttcctcccctttgttctcctaaccccatctcagcatctgcccccgaggaccaatgcaacagggcaatcagtacatctgtgaacttcccaacagtcctgtggtggactaacccagggacaatggtcactgtcccctctggtgcattatttgtccccatcagcctagtaagctccgggggctggcagctggcacagagtacgaggctgcactccttgacctttctatgctgcacacagtcctgtgcccatcctgtcctcagatctgccagggccatgaccaacctgccaagagcgtgggaattggtatgtgacccagctctaggaggaggtggagcaagcgaatgtaggggaagctgctcccccagtaggtttagagggagggtggggagggggtgcagaagggccaggtgggtgagggtgtgcgggtaagggtgtgggggtgtgcaggtgagggtgtgcaggtgtgggtgggggtgtgtgggtgagggtgtgtgggtgtgggtgggggtgtgtgggtgtgggtgagggtgtgtgggtgggggtgggcgggtgagggtgtgggggtgagggtgtgtgggttagggtgtgagtgcctgtctggctctcctgggtggggctggatgaatgtttgggcacaggcagcggctgtcacatggcctggctgcaggtttgggacagaagccaggcgggtgggctgtgtcaggcacagctacaaactgtgccaaggaagtggaccagagcaggggcccagggaaacctctgccttagcagaagatactggggagacgggatcaatcggggaggtcttccgaggcacatggtgcttcatggagccatggcccaggacagggagggtgtaaccctggcttgcctgattggctgagcacagacagatagaagagggtgtgggcagcccgctaggtggatgcctaagtgaggaaggaatgggtggccaggtgactgagacccccaagaccaggaccccgctgtcaggtctgtggcttccaaacgcctgtgggaagtgttcccctttggacactgaggccatcagcttcagcttcacacccttttccagaaaaagtccctcgggtaacctcaaaagtcacttctggccttccccagaggggaaaggagaggggtgcctgtgggcaggtgaccctcagtgctggtggagggcacagcagagagactgcctgtatgtgggaggcccccagcagaccttgcccagatgccagccctcatttgaggcaaactgtaaaattattacaatttaggccaggcgcagtggcccatgcctgtaatcccagcactttgggaggccatggcagaaggactgtctgagcctgcagtgagctatgactacacccctgcacttcaacctggtcaacagaggaagacactgtatctaaaataaataggcttggcatggtggctcacacctgtaatcccagcactttgggaggccgaggcaggtggatcacctgaggtgaggagttcgagaccggcatgatcaatatggtgaaacctcgtctctactaaaaacacaaaaattagccggtcgtggtggcccgtgcctgtaatcccagctactcaggaggctgaggcaggagaaatcgcttgaacccaggaggcagaggttgcggtgagccaaggtcgcgctactgcactccagcctgggcgacagagtgagactccacctcaagataataaataagatgggaaagctacgttcctaacatttttcaaatgataattcatactaaagaatgttaccaagactaacgcacaaagcattttataacttttagactattaataaaaagtaagacatgaaaactgaagtatttgtaatcatgcttaatattggaagttcctatacctgcaatgtagcagctaattatacaaaaatttaataaacgacaaaataaaattttgcaaacagatttgtaaaaaccagaaagaaatttgtattggcaattaatgtaacataattaaaaataatttgttatggtcatctgctaaatgctaattaatgtaaaatgttaaaagattattttaattatgacatcttaatttttaatggctttaaatattataaatataaaaaacaggtttctaaatttaaaagaaaaatgactaaattttcagaattatttcgtatttcttgtcatacaacataagaacaccatccatgtttccttttagattaggaaccctcccttattagctcactgaaaggagaatgctggaaggtgctagtaagatgactgtctaaggactccagaactgaaagaatggttttgtggcaatgcatgtcacttccctaactcaactggaaaaggagaaaaaaacctagtgttttcaaccctcaagctagcaagaaaacacagcccaggtaagttcatctcttctccaatggagctggagtctactcaacaagaggtgaccatttagaatagaattgttcagaagtttgctaacaataagcagccaacatagacacattctccattaaatctaaaattcccttttcccccactagggtgcctgaggggcatgtagcaaaagtgatcccaaccacaccacgcaaactagccaggaaacctttttgccttcacacatctgagagtccctgagaagccggagacaacacggaggcagcagaacaccaacaggagagtcccagcatcacttcctggccatagaagccctcctgagcagcaggcagaacagaatccactacagcaatcagcctgccagagaagcctctgcccctgtggcctgaggttccactttccccaggtgacaccatgggcaggtgggctgaagaagtgggaaggtcaaatcaactggcccagccaggatgcctctttgatgatacaagtgataccggtctaagcctcccctcttccgcagggaaactaggtggcccaaagggtgcccagaggcaggggacctgccacagcagccatcctcctgagaggttccctttcttccccttggtgaactccctccaacacacagcttgccagcaaagcaccctttgtcttacatggggggatcccaccacaccaaaacccagccaaagaagccttttgtcccttaagggttatcacaaccaaaaacaaaaagatacacaatagtaagcccctaaattctgttaagaatgaaacagtgctgccactcacacctggctcagatgccagcaggagggcaccctccagagaccgcaggagaagggggcggactccttgctctggctgcacctccaccactgtcactgaggcctgtggtacagaaccagcagcttcttacccaccccaggccggaccgggccccaaagctctcctactcccccttcctggcccctagacttgctgctgctgccaccattagcgccgatgccaaaggaaccagcgctgctgtcaccctccatgcacctgcccaccctccaaggctcctaccacttggcctccacgggtaccctcctaccgctcctgttgagctgccgtctccatcaccgtggccgccacaacagcaggagatgaatcacagagctgtgccatcttcaggctccaacctccagtcaccacaggggactcctccttcatcagcctggcttggagtagctgggcagacaatgccagaaaaacctacaacaggatgcagaaagtggcagtgttagagcctcaccttgtcatgctggccactgggtggctggggccagtttcagcaaaggcactcacacccaccctccaaagtccagcctctcctcctagaccaagctggcctcctgacctggggtggggactggagacaccacagtgcccggggctccttggggagcaagaatagcagaaactcagacccagccagtcttccccacccaagtaccagttcccattcctgaatcctccacccacaggaccctgagcctccgtggtgcccactactccatgcctggggctcccagatagtctccacaacacagagcaagagggcaagggctgggtaaccatggtgggtgtgagggccctgcggtggtcagaggattgctgcgaaaactctgtgcaccctccgtgctccaacacgagcagaaattgttcaccctctagagccttgagtccgggaagaggagaagggccccttcctcagaggccaccactgtcgtggccacctccacaacctactgctggcagcagaagtgcaacctccccccatagcgcccctaacctgcccccccccaccacaaacttagcccctggattgtgcccacaacacacccagagactgctgcaggcagtgtaaccctgatagcgcccccaaaccacccctctgctcctggcagtgtaacactcgatagtgtccacaacccatccccaccacgggtgttgcagcaccaaatagtgccccatcaaacctgccccccacccggaccacaagcagcacagccccagatagcacccccaatctgctcctgtcgcgggcagtgaacgccaggggtagtgcacccaaccaaccccccgaccccaccttcccctttcccccacggacaatgcaacatttgacagctcccctaaagcacccccgactgcctgccagttggcattgctgctgacattgtagctcacgatagctcacccaacccgccccctggatcggccagtgcagcagctaataatgcccctaaccccccgccacttgccgctggtagtgcacgacagcacacacaacctgcctccaaccccccgccaccttaggcagtgtagactctgatagcgcagcaaacctgccccactgccagcaattcaacacccgatagcgccacccaccagccacccacggcaggcagtgcagccccaaaagcacaccaaacccactcccccaccaccccacaagcgggcagtgcagccgcagagagcgcacctaccctgccacctttctactacttgacagagatgcagtctccgtcgccaccaccaaccgcagccaggcgagccgccagggccaaggctccagccgccagcattgggcatggtccccaccttctcctagacctctagctggtcaagagcagctccagctgccagccaccccactaccgctccggctgccagccacccccctaccgctccggctgccatcttactgctccagcctcccgcctagcgctccggccgccatcttactgctccagcccccctcctactgctcagactaccctcctaccgctcaggccgccctcctaagacttcagccgcgctgccatctctgttgccaccaccatccagagcgagacgagccatggtgttacaggctccagcctccagctcccccttctcctggtcctctaagccgggaacagagcagctcggcaggagatactggagagcctaaactggcgtgaggcctcctcaacatgcacatggggttacgtgggtggtttctggactacatgttctgattgggtgagagaaaacctctaggccttctctgattggactttattttcatactctgattggttgtcctaagactttctttcatccaatcagaacataacaaagtccaatcagagtaggcctccaggctttctcttatccagtcctggaacgtgtagtccaggaacggcatatgcataacttcagtacataagtggtgctgaagaagagtcaggccactccaggttcttctgtgtctgctcactgagctgctccaagcccggcttagaggaccaggacagactggaggctgtagcctgcagcactgtggcttggcctccctgcagttggtggcgacagagactgtagtgtggctggagcggtaagaaggggaaaatacttttgggatagatggaagggtaaagagggtggttagtgccaaaaggaaaaaaggatggtgagccggagaaggcattgcataaagacagtaaggaaaagatgttggggggaaaaaatggggggtagatggagggggaaaaacagggtggtgaacaggagggagagaaggtttcacagaaaggcagtggggaaaaagtttttgggtagatggaagggggtaagagagggtcgtgaggggggaacagggatgagcaggaaggagagaaggtttgcaaaaatacggtggggagaaaagaaagggaaagaagactgtgggtaaaaagattttgagtggatggaggggggaaaagggtgacaagtgggaggagaaaagagggtgcagagagggagggggaagagagagtggcgagcaggagggagagaaggttttgcgaaaagacagtgaggagagaagcttttaggtagatggaggggggaagagggtggccattgggagaaagataaagagggtggcgagtgggaaagagaaaaggttttgcgaaaagacgataggcagaaaagaaagtgtagaaagaaaagacagtgggtaaaaagtgtttgggtagatggagggggaaaagagggtagcaagtgggaggagaatagaaagtgtggccaaagggagtggggaaagaggactgggaaaaaggcgatggggaaaatagtttggggtagatggagggcaaaaagagggtggcaagcaggatagaggaaagaagagggcgagcgggaagcggggaaggctttgtgaaaagatggcagggaaaaattggggaggtagctgggttaaaagagcgtggtgagcaggagtagagaagaggctttgcaaaaagatggcgggaaaatgtttttgggtagatggagaagggaaagggtggcaaggaggaagggagaaaaagacaatagggaaacagtttttgggtagatggaaggggaaagagggtggcgagcagcaggagtggggagaaggctttgggagaagatgagggaaatgtttttggggagatgaaggagcaaaagaggatgatgagaacgggaggcggaaaaaagggtggccagggagagggagaaaagacggtggggaaaagttttggagtagatgggtggggaaaacggaagtgagtggtaaagtatagaaggctttgcaaaaagacagtggggaaaaaatggtggggaaaaagttttggggtagatggaggaagaaaaagggtggcaagagagggagccaaagacggtcggcaaaaaaattcctcctgttactgattttttaatacttttccactccggtcagaaaaaataattgatatgatttcagggtttttttgttttgttttgttttgctttggtttggtttggtttggttttttgagatggagtctcgctctgttgcccaggctggagtgcagtggtgtgatcttggctcactgccacctccacctcccgggttcaagccattcttttgcctcagcctcctgagtagctgggattacaggcatgcgccacaacgcccagctaattttgcatttttagttctaaatggggtttctccatgttggtcaggctggtcccaacctctgttgattggcccacctctgccttccaaagtgctgggattacaggtgtgagccaccacatctggcaaggatgttgaattttgttgaattttttttctgcatctattgagataatcatatgatttttgttttaaattccgtttatgtggtaaatcacatttattgatttgcatatgttaaatagtccttgcatcccaggaataaaacctatgtaatcacgatgagttacatttttgatatgctgatggatttggtttgctagcattttgttgaggatatttgcatctatgttcatcagctattggcctgtagtttgttgttgttgtttccttgctagattttagtgtcaggatgatattggttttgtagaatgagttagagaggaattccttctcctcaatgttttagaatggttgcagtaagattgataccatctgtttttttgtatggtaaaattcagctgtgaattcatctagttctgggcttctcctgcttgataaatatttttattacaaattcaatttcataattaactactggtctgttcagatttttttaaatttatagagaaaaaatatttatttggtttatagttgtgcaggcagtagaagcatgggaccagcacctgctcaggtttggatgagacctcagaaagcatccaatcacagaggaaggcaaagggagggccagtgtatcacgtgtcaagagagaaatcaagagcaagaaggggaacatggcaggctgttttaaacaaccagctctcgtgtgacacaacagagcaaggactcgcttatcgccaaggggatggagctaagcaatttatgaagggtccacccccatgattcaacaccttcaactaggcccaccaccaacatttaagatcacagtcaacaagaaatttggagggtaaacacatccaaacaatgtcatttcacccctatggcccccaaatctcatgtccttctcatattgcacaattatcctctcccagtagtccctaaaaatctcaagctgtttcagcatcaactcaaaagtccgaagtctcatctgagcttcaaggtatgttcctccatctatgagcctataagatcaaaaccaagttatttgcttccaatattcaatgcagtacaggtgttgggtaaatattcccattcctaaatggagaagttgggcaaaagaaaggggcaacaggcctcaggcaaatctgaaacccagtagggcagacattaaactttcaagctccaaaataattcttgatttcatgtcctgcatccagggcacacttgtgcaaggggtggattcccaagaccttatgcagctctgcctctgtggctttgcagtgcacagtcaccatggctgctgtcttggatcagagttgagtgcctgtggtatttctaggctcaggatgaaagcttcccgtggctctaccattcagggatctcgaggtggcggccccattcccacagctccagtaggtagtgccccagtggggactctgtgtggaggcttcaatcccacatttcctattggcactgccctagtggacttttggtttctttctgattcagtcttggaaggtggtgtgtttgcaggaatttatccgttttctctaggttttctagtttatgctcacaaagatattctgaggatctttttttatgtcggtggtatcctttgcaatgtctcatttgtcatttttgactgtgcttatttgaatcttctttttttcttgcataatctaactagcaatctatcatttttatgtgtacttgcaaagaaccaactttttaattttgctgattccttgtatggtttttttggtcccgatttcattaacttattctctaacttttgttatttccttctactagctttgggtttggtttgttcttttttagtgtgtttggctattttagcttgttaatttgagatctttctctctttttatgtaggcatttagtgttataaactctcctcttaacattgttttttctgtatcccagacgttttggtatgttacgtttctattttcatttgtttcaggaatttctttaaatttctgccttaattctgttatttacacaaaagtcattaaggagcagattgtttagtttccatgtacctctgtggttctgagagttcttgatattgacttctaattttattccacagtggtctgagaagatacttaatatagttatgacttttaaaaatttattgaggcttattttatgactgagcatgtggtcaattttagggaatgttccatgtgcaaatgagaaaaatgtacattctgtggtttctgggtagagtattctgtagatatctattaggtctgtttggtcaagagcccaatttgagtccacagtttcattgttagttttctgcctaataatctgcctaactaataatctgcttactactgtcggtggggtgttgaagtcctccatgattattgtacagctgtgtatctcttttcttaggtctagtaatatttattctaaaaatccggttgcttcaatgtaggctgcatatatatttgagacagttaagtcttcttgttgaattgaacactttatcattatataatgccattctttgtattttttttgtactgttgttagtttaatgtctgttttatctgatacaagaatagcaatacctctctgtttttgtttttcatttatgtgatgaatctttttctatccatttactttgagcctgttggtatcattacacatgagatgggtctctcaaaggcagcagaagtgtcttgtttttttattcagtttgccactctgtgtcttttaagtggagcatttcagccatttgcactcaagcttaatattgatgtgttaggttttcttccttttatagcattagctagttaccttgtagtctcaattgtttaattgctttataggttccgtacattttgtattcatgtatgcttttatggtagcaagtatcattcttttattttcactagtgaaactcctttaaacatttcttttagagtcagtctggaggtaatgacttcccttaacattttctcgtctggaaataccttattttcctttctttatgaagctcagtctggcaggttatgaaattcttgcgtggctgggtgcagtggctcatgcctgtaaccctagcactttgggaggccgaggcaggcagatcacctgaggtcaggagttcaagaccagcctggccaatatgaagaaactccatctctattaaaaattagaatttgccaggcgtggtggcgggcatctgtaatctcagctactggggaggctgaggcaggagaattgcttgaacccaggaagcggaggttgcagtgagctgagatcacaccactgcactccagcctgggtggcaaagtgagactctgtctccaaaaaaaagaaattattggatggcattttttttttctttaagaaggctaacgctaggccccaatcttttctaggttgcagggtttctgctgataagtctgttgttaatctaatttacttcataggtaatttggccctttctttgagctgcctttaatatattttcttttgcattgaccacggctattctaatgactgtggatgccttaggaatgggcatcttgtttactatgccacaggtgttctctgaatttcttatatctgaatatcaacctttctagcaagactagcgaaattttcctaaattattcccttaaatatactttcctagttggttgctttttattcttctgttgtagtaatgccaataagttataagtttggtcactttacataatctcatatttcttaagggctttgtttttcagttcttttttcttttatttttgtctgactgggttactttgaaagaccagttttcaaaatctaaaattatttcttctgcttagtctagtttattgttaaagattccaactgtgttttgaaattccattagtgaatgttttaattccagaagctctatttgtttttttcttaatccagttatttatttttccatatttcaaattgtacttaatgattgttttgcacataaaattaaagtatacatgattaatgctttaaaggaactaagcacccaccagactcaagaaaaagtgatgccctatgatacatctgaaaaaaatttaacctttctattaattacagttatgcaaattaagataatatgtatttttgtctagcaaaataaaatataagtatcagttttggtgaagcaaaagcataatggacattaatttgccgattggtgctgaaagtataaattgattcaacattttgcagggatgttagtcaataagtgtgaaaattatatactaatatctctttacacagtaattaaagtgctaggactttttgaaaagaaaacatgtctcaatgtgcccagatttgtttctgtgaaatgtttataaaaaatattgttcattgaaagcaatacaatatttaacaatagagagagtaggcctgtaaatcatggaatttattcaacaggggatgcctgaagagggtctaaaaataatctatatgtttaaataaataaattaaaagaaatttattttaaaatcctacatttaattatattaaaaattatcaatttacgtgataggattattggtaaatttgaatttttttagcatttgtgttcctttatgtgccaatttttctattactgtcttttactccttttgtagataaaatatactgttttaacataaaataaatgtcattcataatttcttatacagtaagaacatttttttgagacaggttcttgctctgtcacccaggctggagtgcaatcatagctcactgcagcctcagcttcccaagatcaagctatcctcccacctcaacctcccaagtgtctgggaccatggctgtgcaccaccatacctggctaacttttaaagaaagattattgtagagccagtgtctcactgtgttgcccaggccagtctcaaactcctgggttcaaacagtcctcctccctcagcctccacaaagtgttgggattacaggcgtaagccaatgcacacaggcagagctttttttaagaaaagtatgcaatatatttggtctttaaaaaatgtttttgtttgaagagcaaggtactcatgcaggaaaataatccaatttatggtgcagtttaatttaaaatgaaatcacttggcattattaaaaaataaaattttgcccaggcacagtggcttactcctgtaatcccagcattttgggaggccaaggcaggtggatcacctgaggtcaggagtttgcgaccaggctaacatgatgaaaccccatctctactaaacacacacacacacacacacacacacaaatagccggctgtggtggcgcatgcctgtaattggagctacttgggaggctgagacaggagaaatcacttgtacctgggagacggaggttgcagtgagccgagatcgcgccattgcactccagcctgggcaacaagagtgaaactctgtttttaaaaaaattgaaattaaaataaataaaatttcgagtgtccatttgttaacaagaaaataatttagaaaaacattattctaatgcaatctacaattgtgtagaatcactgtagaatataccacagcatactgttgagttttatttgctattaagattaagtggggccgcacggccagacaggccctcctcctgaggccgggcaggctgcacgcctgcaatcctgcccctgtggtcctggggaagcccggaccagctcaggagaacccgcgagcccagcggcgcctgccctgggctggagccctgcttgccggcgcaccggctgggagcggcttctgggagccgggcggcccccgcggtgcaggcgcgctgctaatggccttgcgaggctcactgggtctgagaggtcagaggctgcgagtgtcgctgctgaaggctgtggtggacccggctggattgcggattctgggctagatcgcagatttgggatcacggattggggattggatcgcggattgggggttggatcggggatttggagatggatcggggatttggggctggattggggatttggggctgggttgggggcagtgaaaaggtgacagggagttgccgcggctcaggagccggtggtcgggtgtctgagaagactacaggcgcccgccaccacgcccagctaatgtttgtatttttagtagagacggggtttcaccgtgttggccaggctggtctcaaactcctgacctcgtgatctgcccgcttcggcctcccaaagtgctgggattacaggcgtgagccactgcgccccgctatcacttcctttcttatctgtgtaccttatctgtatacccggccttatcactactattatggggtttttttttattttttgttgttatcgttttttttttttttttgagatggagtctcgctctgtcgcccaggctggaggtcagtggcggagcagtgttctcctcagcacagacccgggcgggccagggtctccacgagggcggagcggcgttctgctcagcacagacccgggggacactgcgaaggcagagccgcgttctcctcagcacagaccttgggggcactgcctcgctttgggacaactccgggctgcatccacggtgaataaaatccttcctgtttgcagccctgaataatcagggtcagagaccagttagaagggttcagtgtggaaaacgggaaaccaaaagcccctctgaatcctgcccaccgaggttctccccagccaaggcgaggcggccacagtgcaagattcacaccgcagcctcggaagacaaatgcggcattcctaatgcagacatgacacccaaagtatgacacccccattgctcatgtaacaagcacctgtaatgctaatgcactgcctcaatacaaaaatattaatataagatccgcaatcccctcgctgccctgcagtcctaagacagcgatcataataatcaacattgacatagtcaatacaaacgtagtaacgaacctagggttaagttggtgttagggttaggggttaggggttaagtttagggttaggggttggaaataagggctggggtcagagttaggggttaggagtcaacgtttagagttaggggttaagagaggttagtggtttgggattaggggttagggttgggttagggtgagggttgtggttaggggttagggttacaggttagggttaggatcaggggttggggtcagggttaggggtcagggtcagggatcagggtcagggtcaggggtcccactctgtgggttgtctatttactctgctgactgttccctttgccatgctaaagctctttagtttaattaagtcccagctatttatctttgtttttattgcatttgcatttggcttcttggtcatgaaatccttgcctatgccaatgtctagaagggtttatccagtgttaccttctagaatttttatagttcaggaattaggtttaagttcttaatccatcttgagtagatttttgtataaggtgagagatgagaatccagttttattcccctacatgtggctcgccaattatcccaacatcatcatgtgttgaaaaggtgtcctttccccactttatgtttttgtgtactttgtcgaagatcagttggctgtaaatatttgggttaatttctgggttctctcttctgttccattggtctatgttcctatttttaaaccagtaccatgctgttttggtaactatggccttattgtacagtttgaaatcaagtagtgtgatgcctccaggtttgttctttttgcttagccttggtttggctacatggctctcttttggttccatattaattttagaattgtttttgtaattctgtgaagaatgacggtggtattcagatggggattgcattgaatttgtagattgcttttaacagaatggtaaatttcacaatattggttctacccatccatgagcatggggatgcatttccatttgtttgtatcgtctatgatttcttttctttcttgtgttttttttttttccagagggagtttcagtcttgtcgctgaggtgggagtgcaatggtgtgatctcggctcactacaacttctgcctcccaggttcaagcgattctcctgcttcagcttcccgagtagctgggattataggcatgcgccaccgtgcttggctccatccatgatttctttcagcagtgttttgtaattttcattgtagaggtcttttgattcctttgctaggtatattcctaagttttgttttttgtttgtttgtttgttgcagctattgtaaaaggggttgagttcttgatgtgattctctgcttggtagctgttgatgtatagaagagctgctgccttgtgtctgttaatcttgtatctggaaactttgctgaattcttttatcagttctaggagctttctagaggagtccgtagggttttcaaggcgaaagatcatatcgtcagcaaccagtgacagtctgacttcctctttaccgatttggatttcctctatttccttcttttgtctgattgctctggctaggacttccagtactttgttgaagaggagtagtgagagtaggctcctcgtcttgtttcagttctcaaagggaatgctttcaccttttccccattcagtgttatgttggctgtgggtttgtcatagatggcttttattacattaaggtatgtcccttgtatgcctattttgctgagagctttaatcataaagcaatgctagattttgtcaaatgctttttctgcatctgttgatataatcgtgtgagttttttaaattctgtttatttggtgtatcacatttattgatttgcatatgttaaaccattcctgtatcactggtatgaaacccacttgatcatgttggattatctttttgatatgttgtcagattcagttagatagtattttgttaaggattttggcatctgtgttcatcaaggatattggtctgtagttttcttttttggttatgtcctttcatggttttggtattagggtgatgctggcttcatagaatgaatcagggagggtttcttctttctctgtcttgtggaatagtgtgaaaggattggtatcatttcttctttgaatgaaggaagacattctttgaagtctggtagagttctgctgtgaatctgtctggtcttcggctttttttgttgtcaattttaaaattaccatttcaatcttgctgcttgctttattggtctgcttggggtatctaattcttcctgatttaagctaggagggttgtatttttccaggaatttatccaactcttctaggttttctagtttatgtgccaaaaggtgttcatagtacccttgaataacctttaatatttcagtggtgtcagttgtaatatcccctgtttcatttcttagtgaggttatttggattttctctcttcttggttaatcttgctaatggtctatgaattttatttatcttttcaaataaccaactttttcttttatgttttgtattttttgttgttgttgttgtgtcaatttcatttagttctgctctgatcttggttatttcctttgtttgctgggattgggtttggcttgttcctgtttctctagttccctgagatgtgaacttagattgtctgtttgtgctctttcagactttttgacgtcggtgtttagggctacaaactttccccttagcattgcctttgctgtttcccagaggtcttgataggttgtgtcatccagtttgaagaaattttttacatttccatcttgattttgtttttcacccaatgctcattcaggagcaggttatttaatttccatgtatttgcatggttttgaagattccttttggagtcgattttcagttttattccactgtgatctgagagagtgcgtgatacaatttcagttttcttcaatttactgagactcgttttatgacctatcatatggtctatcttggagaaaattccatgtgctgtggaatagaatgtgtattctgtggttgttggatgaaatgttctgtatgtatctgttaagtccatttgttccaaagtgtagtttaaatccagtgtttctttgttgactttctctcttgatgacctgtctagtgctgtcagtggagtattgaagtcccccactattatcgtgttgctgtctatctcatttcttatgtctactagtaattgttttataaatttgtgagctccggtgttaggttcatgtatgtttgggattgtcatatttttctgttggatgagacctttaccattatatactgtctgtccttgtctactttagctactgttgctttaaagtttgttttgtctcatatgagaatagctaccgctgctcgcttttggtgtccatttgcatgaaatgcctttttctattccataatcattctgatgcaaaaacaattgtaactctccttctagtgcctacatttcctatgagccccagttgtgcatagcagaaaatacggaagcatctaggaaaacctaggggcaggaggggctgggagggaataaggcctttcaaggtgtttaaagaagcgacaaagatgaagaagcaggcatagtttctgaagacattttttggtctttgttgttgtttgcatttacctaattagttctcaactgcagaggcacattagaatattctggggaatttttaaaatacgactgcatgggccacctgtcatatacactgatgtaattggcttgagttggggcctaggtttctctctctctctctctctctctctctgtttctctctctctctctctctctatatatatatatatatatcctgttttgtatatatctaagtatctgtagatatatacagaacaggggataccagtgtgtacctaccattgaaatcaattgttttcaagtctttttaggtcttattctcagatggtcttgggtaaatggtggctgattgccttcagcatctagaataaaacactctatggcccagaggaattccagctggcatctatgatctttttctcttgaggtagagcagctgaagggaggattatcttcatgttgagtctgatggcagggtaatttgcttcatgtggaggcaaagggatattgttagttttccagctacattgggagttctaagtagccacatctcaggctaataggaagtccagattggttcaaaccttttcttaattatcctgtgtaggaatggaccacgcagtatccctcaaggaagaatcaagagtgtttccacagagaatatacatatttcatctctttctctgctgaatggatccccactgaaagccatgaattaattactctcattagaccctgtagaatcccagtttatggcagtgacattaaaaacatctagttcatgacttggattaggcagcctgtaaaatgacttccagtgatccctgctttctggtatgtatgcccttgtataataccctcctcatgagtgtaggcagaggtaacatcacttttgaaactaggttatatatattaaaacaaacaaacaaacctgtggcttccattttgggtactttatctcacactctctgatttcttgctccgtgggaaacagactgtaatgttgtaagcaatgctatggagaggtccatgtggtaaggaagtgataggtcctgataagagccagtgaggatctaaggtggatccctttctgagttgaatattgagatagatgactacagccctggtctacaccttgattgcagcctcatgaggaattctgaccaaaaacactgtgctgaaccacgtccaggctcctgagccacataaactatgagaaaacaaatatttgtttcaagccattaagttttaatttgttacacagcaatagataactaacacctttgttacagagcaatagataactaacacatggaaggattcatcaagagaagcgtttttcataagtgaaatgttattttcatctcacatttcaattattagaaaataaaagaaaataaatttggataggctctcataaattcaatgataagaacttggaaaatgcaaccacatgataaccaggaagtaaaaggaaaacataagaggcatcttcccagacgagagtaaatatctggttccctgagaagtgtagtttgagaatggagaaatcagatgttactggaaagaggctaggactgtattatttcttgcttcctgtcaagtcttttcaactcaagagaaagtaaattttcttgacaaaccattcaaaattaaaggataggtgggagtacatgtgtccctgaaggaacaagtgaccttcattgaaagcagcagcttggttgaataaatactgtacagaagtggaataaagagtagctgacaacaatgctgaaatagttacacatgaagttttaatgagctatttcatattaagatacatattgagaattcaaaccagagagaccagttaattgatattttcccaactctgttttagggtgatcatagaaatgatacccacaagttagtcacagtggcctgcatccattttgatatatcagtgacgtattctgattggccagtaatcacccatactgactgttaaatatttttgttatcactcctatgcatggtgaatttgagttctggttttctttagccttgtgttatttatgtgtaaagttggatcatggaaggcaaagaatctctcgtgtgtcattcacgctcaagtaaatggcagtgggatagggatgtaaatgaaactgcatgataagccctgcaagtcattctgatgtatcgattttgcttactggtgtttaattgcagacattgtcatattaacgcaaccactaatacattatggagtaagatgcaaaaatcacatgagtcttaacagaaaagaaatgtgatttctgtggtgggccccttctgcattattctctaacttcttgttttatacctctactgttagagaaatttcagtagaaaatcgtgaggggcactgttttagagtttttgttgttatagcaatgcttttactacagctaggtccccttgtacatctttatgttctttggcagtctagagaatcagaagagcaaactctatgagatagaaactctaagaatttacctccagcatcccttctcttctgtcattaaattgaattcatagccaactcaaagattgacaatttatactatggtttttatatttttatattataatttatattatggcttatgtcaaaatgttttgttcactgctttgaaagtatcttttgtttacttttgttatcatttcatattttaattttttcctttctaattgttagaaactcatgtatttaattttatctttcaaagaacatttttaaaaggcttactctgcttatatgtatattttgcacaaagctttccattcataaacaaaaggtgaataggaatcagaattgaaaactacataatttcttttctccttttgagtcaaatcatcacagtatagattagtcattgtgtatgaagtgcattgccaagacatagtcacatttgtgtacaaatgtaaaggctatatctcaatagaaataaaaaaacaaaaaaatgcagaagaccattagctaataatactaataatctagtatagaaagcatgtgccaactgatctagactcttgtgacagttgtatatctactcagctgcttgaccttaggtgtatcaaaatctcgatttcctagactacaaatgagtaagagggatggaggccccttacagttttaagattctggaattctaagtgggtgtaactggagcaaattttattttctaaaatttgcataataaattttaaaataggagaaaaactaataattaaagtacatatttctggaagtcttttttaggtgacttatactaccaggaatggatttaccactaaatattggttttgcctaattcagcattgctatgtaatttgatggaagtataactccatagacaaagagatttggtcctaacatagcttgtattttatatgtatatacactatttctatttaaatttctgtgtagtcatgttttacccttttaaaatgaagattagttttattatgtattttcttttgtctataaacattcagtgaattcacactgaaaactgattatgaacagatagtctgctaggcactaaggaaacacatatgaaaaactaagtcctcctctgccctcaatatgctcacaagactacagttactgaagcctgacctcaaaacctagctaacaaagtccttgaatcaggtgatagttcagaataccattcatgctctctcccaagagtatatctgaggaagggcagttctttctagttttctacatcctggtcgtataggtcaaccacaggaaaattaaatgaatctattggtttgttgacctagccttttcatataagcctcatctataaatgtattaccaaatactatttatgtaaagggacttgaatgacaaatattttgaaattaaaaccacaatggttagcatagcttttaaattagataaatgttgacctcccattggtgaacatataaagtgctaccaagatctgccaatgaaagactttggaagtggaaattcatctttttaataatcctgttatctgtaagctgacctcaagccttcatgacattcaaggccccttattcctaactgtatcttctgttttgggcattgtgctcttgccatctaacaggaaaacaactttcagtgctgccaccttttgaacagcagagatttctagagattagaaaattactaaatttaaatatacatagttttaaaatatgatacttttctacctatgcattcaaatatattctaacttttaaatcctgtaaatacttatatttgtaatgattttacttatatgatccaattaattggcaagaatatgtggtgaaagattttttacatgtttgtattgttctgtgtgagacatctactgtaagcattgcttcaggttctcatttttgtctgccttccaggatttgctggcccaagtgctgtgtgctagacttagtctcggtcacagaggggagggaaacttgcagttgagccagacagttttgttattcctttaaaattaaaagcatatgaaacagatacagcttattaaggtttttttaataaataaaataaacttaaataacaaaataataaagttcaaaaacaacttaaaatatagtttaatgctgtaaccataggaaaaaagcatgattatttgtgggaagaacattattaaaagccatattcccaaatacgaattatacaaagatagattatgttacttgaaaaaaacttaaagatttctcaattttactttgagaaattataaaatgttattttgtggcaagtaagatgaagtacagtattatcatcaatcactgttgctatcttatatacaagatttttggaaacatccttttagcaataccctttccacttgagcagcattagaaattttgttcttgttaataggtataagcatgttctaatcctgtacttttgttaaattatctattttattgactttcgtaatagatttttttgagaatattctttttttctgattagagtttaagtagattataatttttcactagaaagcatttaaaatgctgctcattttctatagttagtgtggcttgattatctgacaaatcctgccagcagcctgtaggtctgatataccttatataacatcatctgcattattattattatagcagccattttataagcagataggaatatttaaataatcattatcagataatcaaatctaacatactcttaagggtaaattaatttaagaaaaaaattactattactaacatcatgattgtacaaccagttttacaattttgtacaacctttagttactaaatctgatttttgtgtatacttttcaaatctttctttaatgcagtgtcttaaaacaaacataaatgcacaagtcaagcttgatcagtttttcagtagttttccagcctttcttgattactaaaaaataaaaggaaagaaaattttgagaagaaagaaaacagtccacttaaagaaatctccctactggaactggttctttatataccatatgcaattaagttattgccataggaagaaagtgggctgttttttgttctttcttcgttttttttcctcttacaggaatccccttttgatttaaggcaacaaacatttcccctccattgtgtgtccatttagctgctgcatatgtgttgtaatggttttccagaattagttctttgaagttacaatcttcattgcattctttctgttcaaacaaacaaacaaacacacaaacattatccaaatgatttttagagaggctcaattaaacgaagagtaagcagcaatatttggtagaattgaaacatacacaactttttttaaccctcagattgagcaggcctaatgtggtttattagctagacttatgtagtatatttgcataaaaaggtatcttaaatttgaaataaagacaccacataatgcacagctagtgtgaaatatgtgtagctttttggaagttcatgtcaactattctttaaaattaggacctatttccccctaagtaacaggcctcaaattactcttcccacatcactcattctttaaccactggaaatttggtagaattagcagaacctctgcctccctcaggtgagagacttgtttcacaacttttctttatttacttgtacactgtcttcagtggtaatggaagataaaaggttaatttgtttgttcatccatgcaaccatttgttcattcaattaaacctgtatcattatataattagcctgttccaggcattatgctgagctgtgggaatacaaaggaaagccaattatattttattacagtgggatgaactgttacatattttgcattgtagtgaagtgggaacaatgtgaataattacagttcaaagcccatgattgtgagattgatgttgatgaatgaactaaacatttcaagattttttcccaagaattttcatgtcagcaatgtgcaaattgggtgaactttagcaaaaagagctttaatactggcaaatggaaattttggattttaaatatctaaaatgcacatggaatgttagagctggaaggctccttagaggtcagctaattcaactcattttacagatgaagaaaccagaatccaaagaacaagccatttgtccaaagtcacacagaaaacattttttcttaacatttgagtataaagtgttttaataaaatcattaaattatacagttggagatagattaagtccatgtttacttttcagaatggtgagatatttcaacaaaaatgagttttaaaaattaagcctaagctatcaattatcaatacctttgcatagagttttccttcctcgttcattgcaagatagaattcactttccacccctttgattgccacaatccgaactgccactgtcctgatttccatgatatctgcaaggaatcacagaaagacatgtcaagtattcgttcagctttgcaaatgatccacgaatggccatttgttcttatttctgttttaatcggaagtctttaaaatttttaatgtgattatttactcagcccaagacccccgacccacaagagatacacacaaacaccagaatagtcattatataaggcaagtgcaaactgacggttttttattttgtggaaaatgtgcctgtatcgaataaatagttacatatttgagttcagctttttattctctagaattaaatttctaatttactataataataatagctaatgtttattgaacgcataccacatgccaaggattattgcattgctcttatgtattaactcatttactcataaccacagattgaggcaggtagtcttgttatcccagttttacagatcaggaaactgaagcacagagaaactaagaaatttgcccaaattcttatacctgataagtagcagaactggaatttgaacccacacattctggcacttaatcattatataattacttttctatttggataaactttatcttaaaaattatggccaacagaatagctcttgaatatactgaaagtgaagaaaattctaattaaagcaattgtaaatgatggtaaacagagcctactgccttaaaataaaaggttgttttaaactgatagtattttgatacatgaaaagaccatttaaaacaaaattatgaatcctgtttatataatacttcataactttatacctttgtaattaacttttaaatctttgttgaaatagtatttacaaaacgtgtttacacaagaatggtaacttaccattttcctttattatatatatcttccttaaatcctgtgttttaatgacacactaaataaagtaaaatctcaagaaatttattaaaatgatgtaagaattaaaattttagtgtacttttatgcaatttggtattaattacattttctacatgaaggtacagtgctgagacatccttttacctatgtctaacacagtgcaaagaaaagtcaaagtgtcaattttctgtgtgattgggccttcaaaagctattttctaaaatattgacttaaagaaaaagctaattgttttgccccatacctttacttcattctcttatttatttttttgacttcatttttgctacctggataataaaatttctattcatgtcattgggatttaatgtagcccagctaatatttctcatttgcctcacatatatgttgcatatagaagcccttttcccaatatcctatacttaacactagtcagagctcgtccagttgagagtttcacagctactcctccagaaattgggtttgattaagaaaatgtaaatgaatggatattaatctttttatatatttattaagcattatcacaatgcatacaaccctactgtagttttaggacacaaattaagaaaaacagccctggtttctgataccagaagttaaaacctaatagaaacagcaaacacgtccatatattttgaagaattttgaagaacacaggcctgaataggccagagaaaattttactaattgcttacaagcacatgaaggattatgacgttgatgcattcatgtaacgttcaacagatcttcactgagagccaattctatgctaggctcaattcacagacaagccttgcccttttagggcactctatttggtaactacaacttcattgcattaaaggaagcacaaagggaaataacatgcagaagaatactattaggttaaatttgtactaatacaatgaaaaatactgaagaaattcattgattcagcatatttgcaatacctccaaaatggaatgaatgtatcagttaggttggtgcaaaagtaattgtagttttgccattacttttatgacaaaaactgtaattacctttgcaccaaactaatatttaaaggacatatggaatagttggtttctaaagatcttagcattgtaaaatatcattaaaaagtcaatattttcttttccttcaagtctctttactcctgccattcctccctgtatttaatatattttcttttagataaaaagagaatgctgatgcacaagcttagagtgtctttcttgatcagttattagggactagaatctgtaaagtttgctggcttttcttttacagaacaattgtaaaacataaatgttgactgatagagttagtattaattatgataggcagacgtcttccctttttggtcctgtcatgacaataagttcatattgtcccactcccaaaacattttcctctatcccctgcctgtctattgcccactatttctttactgcactttacaagaggtgatggctggatgtggtagctcacatctgtaatcccagcactttgggaggccgagtcaggcagatcacttgaggtcaggagttcaatactaacctggccaacatggcgaaaaatacaaaaaattatccgggtgtggtagcgggtgcctgtaatcccagctactcaggaggctgaggcaggagaattgcttgaacccagaaggcggaggctgcagtgagccaaaacggtgccactgccctctagcctaggcaacagagtgagactctgtctcaccaaaaaaaaaaaaaaaagaaaaattagttgggcatggcggtgaattcctataattctagctacttgagaggctgaggcaggagaatcacttgaacttgggaggcagaggttgcaatgagccgaggtcacaccacagcactccagtctgggtggagtgaggctctgtctcaaaataataaataaataaataaataaataaataaataaataaataaataaatgaaaataaggtggtgaacatttttaatcatatctctccacatattagggttaaggataccacaaattctctgtaaagattctacgtttagctgagatgagaatagacttatattcttaattgcttgacatatttaaaaaataccattcacactgggaaatcaacatatctaaaagacaattgcttggggagagcattaagcagtgttggcagaatcagtaccttatcaaccctattttctagtctattttgttccatgtcctacgaccctcttttattcaagaaaagctcaagaataaggaaattaacattatcactcatttgttcagttgcagtgtggggagtaatgttcctttcaatatgcacaaatatttatagaagtgttaaatatgggccgggcgcagtggctcacgcctgtaatcccagcactttgggaggccaacgcgggcggatcacctgaggtcaggagttcaagaccagcctggcaaatatggtgaaaccccatctctactaaaaatacaaaaattagccaggcatgatgctgggtgtctgtaatcccagttactcgggaggctgagtcaggagaatcatctgaacctgggaggcggaagttgcagtgagctgagatttcaccattgcactccagcctggacaacaagagctagactctatctcaccaaaaaaaaaaaaaaaaaaaaaaagaaaaaagtattaactatgaaatcctacccctccaaatcagaagccacgaagttgctcagaaaacataatagaaaaatatgtaatatgcagatattgttagttaccaatatgagttaattatacttggtctttttgtctacagtgtatctgttgcctcacataaaacaaatagaagaggctgtctttctttgtggatttccatttgtgcttaagagaagtttgttcacataagtagcactcagtaaatttattcccagagatttaaagcatatacatagatgcatcaaattgttggcataatgtccatgataacataatggcagagttcaaaaatataaataaaagagagagagagaatcagctcatgcaatagaacatgaaaaaccaggcaatatgtcaagcacattgaccatttagccttgtcagcaatattgtcaacaatagcataaatttattatttaggatgtcacccttacacactagagactatgccctaaatagcttccctattttttatcatctggttcaataattcatgaatttatctaaactttttgtcggtttattatttaaacctgtgtcacacttggaatgaaaagtggggaactttgatctaaattgcaattacttttttaaaaaattctgtaagacctttcagaattttaggtgtccctctaatcttgtatttcagaaattgatactaattctttttttaattaccaatagctttgtgattttaaagtgctttaactttcctgtttgaaaaattactttttagtgtctcactacacagaatccgtgtccaccaatctcagcatcattaatatttctttttcctgaaaccgttaaagctttatgtttaaagttttgaaggggtatatattaatatggctgtgctagcgtgataactaaatattattttcaagttgcaaaaaaaagtggaggcagcggtttgatagttaaccaatcagaacatttaatcttgtccttgatcaaatataccctcttcggcatgttaaaactaagaactagtatcaacaaagaaaaaaacatttacatttaaatacattttatgattttctgtcaagcctggattgttgagtgggaaatcttaaccattatatatttatattatgtttaaggctatagattccattcattttacatcactaaaatacaccgacatatacatatatgcaaaaaatatatcaatatatccaacatatacaaaaaaaacactgaaaacacaacaataaggaaaaaaaacctagttaaaaagtgggcaaaatctggacacctcactacagatacacaaagggcaaataagcagatgaaaatatgctcaataacatagatcatcaaggaattgcaacatggatgcagccggaagccattatcctaagcaaattaacacaggaacagaaaactaaatactgcatgttttcacttataactgggagctaaacactgggtacttagggacataaagatggcaacaactgacactggggactactggcggggagtagatgagggaagggttgaaaaaccattaggtactatgcgcagtacctgagtgatgggagcaatcatacctcaaacctcagtatcacacaatatacccaggtaacagacctgcacatgaaccccctgaatctaaaataaaagttgaaattatttaaaaaggaattgaaaattaaaacaacaatgagatacctctatacaactattagcatgactaaactccaaaaaactgacagtgctgtatgctggcaaggatgcgaagcaaccaaaactctttcattactagtgggaatgcaaaatggtgcagtcacatgggaagacagtttggcagtttcttaaaaactaaacatgctatataatccagcagtcatgcccccaggtatttgcccaattgaattgaaaacttacgtccatacaaaatcctgaacatgactatttatagaagctttattcgtatcatctaaaaccagatgcaaccaacatatccaataggtaaatggatgaacaaactatggtacacgtatacattggaatattatttagcaatgaaaggtattgagctgtgaagccacaaaaagacaaggggaaccttaagtacatattgctaagtgaaagaaaccagtctgaaaaagccacatactgtatgattccagccatatgacattctggcaaagacaaaactttagaggcagtaagatcagtggttgcaagggccttgaggagagcagaagaaggatgaaaagctcaatcacaggggatttttaaatcagtgaaactattctgcgtaatactgtaatagtggatacacgatatacatttgtcagaactcatagaactatacaaagcaaagcggggacgttagtataaattgatggtataaataaatattggctcatctattgtaataaatgtgccacattaatgcaagatatttataatggaggaactgtggggggaaatggagattgtttataggaactctattatctgctcaattttttttttttttttttttttttgatacagagtctcgctctgtcgcccaggctggagtgcagtggtgcgatctcggctcactacaagctccacctcctgggttcacgccattctcctgcctcaccctccccagcagctgggactacaggcgcccgccgccacgcccagctaatgtttttgtatttttagtagagacagggtttcaccgtgttagccaggatggcctcgatctcctgaccttgtgatccacccgcctcagcctcccaaagtgctgggattacaggcgtgagccaccgcgcccggccctatctttttattttaataaaataactacctaatttatgacaggatagtagcatctggtgttctctgaggttctttgatttgtgggcaggtgtctgttgctgaattttaaaagttctcagccatcccttttttcttttcacattctgggtgaatgcagttttcatagaaggtgctagatttgtgcaaccctaaagataggtgactcctctgactcacagatccctgggagcctctcccgaacagagtttctttatccacacaccccacttcccatacccactctcccacataggtgttctggccaccagtaatctctgaaggatggaagatgaagagacatgacttttacctgagtctctactcctcccaagagaatgaatgttcctggaaacttcaccaacagaaaatcaggggatatcaatatatgtaagcactcattactcatgtaatggaggccttggcaaaatgtgacacttaaatttctgctcagggagagtagaaaataggcacagagaatagagagactggtaaagaatgaaggctcaaaggtgattgagttgtgttaaaggcacgtcttgatcaggctttgctttatttttctcttgtggaatatgaaagtgggtgttacaattaaatatatttcttgatttcctaaaatgttataggctgtttccaatttttgttatttttggagtttcttaaatcgaaatttgattcaggataattaaaaaatataatgttaatgttaagatggaaagtaggtcaaaaggcaatcacgttaaacaagaggataattggagataggaccttgaacacgaaagtaatcttaaattcttgactattatgatacagtttgcataaagaactgagatttcttcagaaaactatagtgaaatgggacactacaaatcaaatataaatttaaaaatgaacgcatttattcaatacatatccatagattattctggattaaatgtacacattttaagaataaagttttaaatttgaaaatgaaagactgtttcccatctaaacagaccattggcttcaagatacttacaactgtgttaaatcatcttccattggttatagttggttatggcatcggcatccccaaatctggctgacccatactacgtttttcctaaatctcttttttcttctgtatcttgctaagtctgctggttcatcctcccaatttcctgtatttaaaaccccagtgccacgtttgaccttgtcctttctcttctgctgttcacgtcttctgtctctcacattcattccaacctacacatcccagtggcctattcctatttaagcacccaaccccctctctcctgaatgaatgcagaaagctttctcatctctggactcataacacaacagttattattacacacgactgtcagacgtgtggagttcttgaaccatagttctctggtgtcatcattcattttaaaaattttggttggctccctattacctagaaaataaactttagtgtcctttgctcaacatgtgaggccctccacaatctaatttcacacgctccaaaaccttatttctacctactctcttccaaggaccctgaaccccacattccaggcaaatccagttatggaacacttgcaaaggccatcagaagtcactgcaaaaccaatccggtctgactcctatgttgtttagtgctctatcccctttgtctgaaatggctttccctccacctctatttttgtttaccggcaccttccacagctttcagcattcagtttgtcatgaaggcagctgttacagactggactagaaaactgtgagctgaattggtggtttccaaatcagtatcacacttgattcccacctccagaaattttgatagagggggcctggagtagagccaatgagtcttacacacacagacacacacacacacacacacacacacacaccccaaaagaaacccacaccccaaaacaaacacacacttaccctaatgactatctaggtgccagccctagcctaggccaggctggtggaacatgctggattaaaaacaacaggacactgagaaagtatttgctacacagacatatgggatttgaccatgtgttatttacagataacctaactcactggagtaaaacctatcttaaattggcatatggtataggatatgttgtagcattttattagtgaacatttgtaaggttttatttgtgaaaactgataagactgtatttgtgaccatcacaaggaaaactgataaaactgtatttgtgaccatctcaaggaaggcctgtcctatgccaggctcacctgccaagctggctgcagtcccttcctctcttgacctcacgttgcccctaaaggcgtctctgttattatattcatgactttccattctctaatactgtgtactgatcatttcaacacatgccttattctctgaatagactgaaggattcattaagtatctgaaaagcaaatgctgatgaacttgcctaaaataaaaggcatgaaccatgcaagtttctaacatagattgtagcagccaccccagatgattgcaatcgcctccccattgatctcccagctgactcattctatgtatttgtaactcagcaaccagagtgagcctttaaaaattatcagagagcgccactcctcttagtaaagcactaccccaccccagtcacgtagctttctgattcacaggagtaaaagccaaagtccttataatggcctaaaaatcgtacataatctgttccttttcagatttcattcactaccatcttcccccttctctctctgttccagttacaacagctggctgcccccctcaaacacaactagcacgttcctgccccagggcctttgcacctgctttttcctcttagtgcaacaagcttgctccagatatctgaaaggctgactatcttgccaccttcagatgtgtgttctaatgtctctttatcaatgagagcttctttgtccaccctgggcatcttcttgcccttccctgctttattcttccccatggcagttactcacattggacactaaacacttgtttccttagctaggcattcttctcctaccctcacaacagtaggaatgtcctaaggttctgagaagactcctgtgctaggtttccagactcctgtcctctcacatttggtgctcatgcacctcttggtcattagtgcactccagaggttaggacctagagtatgtggctgtccttcagaggagggaaagagattgcttgggagcagagaagggagctttggcctcgcagtgcaggacccctgtgcccacaggcctctgtgtgttgacagcaatgctcttggtgtccacctgcactgccctctggtgttcagtcaaaatcaagcaaatagttacgaactgctataggggattgttaccaggtcctgagtctgagtgttggaaacacaaacccagaagcaaacaaatctgcccaacacccctgacatgtgggtttcacagaaaatactgaggtcagagtagcgtgttaaatgataccacagtgatgacacaatcataaaaatctacactgtggactctgtcctagtttctttaacgaattgcatgaaaaaaaagatggaaggggaagaataagaatgaagaatgctttagagactctgcaatccatcgtaatatccgtacaaggattctgctcttttaaaaaaagaaaaatggtgtgaaaaaatatgtaggactggccaggcagcgtggctcacacctgtaatcccaacactttgggaggccgaggtgggtggatcacttgaggtcaggagatcaatcctggccgacaagcctgaccaacatgccaatatggtgaaaccccgtctctactaaaaatacaaaaaattaaccaggcatggtggtgggcacctgtaatcccagctaattgggaagctgaggcaaaagaatcgcttgaacccaggaggcggaggttgcagtgagccgagatcttgccactgcattccagcctgggtgacagggcgagactctatctcaaaaaaaaaaaaaagtaagacaatcagggaaatttgaacagcgactggattttgggtaaaagtaagtaattctggctaatttttagatgtattattttaaaaaggggatccttaccctttggaggtggatacctccaaatattcatggatgaaatgacaggatgccagaaatgctcttcaattaatctatgtcagggaagtgggatcagaggaatcaggactgtctaaaactgaagctgggtattaggtcaatgagttaattatactattcattcattatgctatttatttccttttgtatattctttaaatttttcataatagtaataaagatatgttgaacatggtaaagatggaaaatgtacagagatagaagaaatattcttattttttatttcatacaattctatagtttcacattgttttactgtatttatgcattaattctataactgtaaaacatgctattaataattaaactgaccttatgaaaattcttggagagtgaaaactttgaaactcatgtgctaggtacatcattaaaatatatcattcaggcgacacctgatgactcacatctataaccccagtaatttgggagatgaagataggaggctcccttaagcccaggagtttgagaccagccctggctatatagcgagagcctgtttctacaaaaaaaaaaaaattattattaattagccaggcatggtggcatgcacctgtagttccagctactcaggaggctaaggtcagaggatagcttgagcatgaaagttcaagactgtagtgagccatggtcatgccactgcactccagcctgggaaacagggtaaaaccatgtctcaataaacaaacaaataaatacataaatacataataaagtattccattcaacatttttaccttagtaatgctcaacgtttggtttttacttatttccttttatgttgtattttctagaccaaattcacatatagtataaagcagaagaaactaaagattaaattcattgttcgtaattgtattcagtttcctgttttcatcatcgtttgtttacaaatttttttttttttcttttttgagacagagtctcgctctgtcacccaggctggagtgcagtggctggatagctcactgaaagctccgcctcccaggttcatgccattctcctgcctcagcctccggagtagctgggactacaggcgcccaccaccatgtctggctaatgttttgtatttttagtagagacggggtttcaccatgttagccaggatggtctcaatctcctgatctcgtgatccgcctgcctcggcctcccaaagtgctgggattacaggtgtgagccactgccccggtctgtttaggaatatttttaaagaattattgcacttctgttcggatagaaaaacaaaaatgcattttaagaatatatatttatatgtatgaaaatataaaattttgaaaagttgaatatttcgagccagttatgtagatgtccttgtccttctctgagctgctgactcacgttccatgaagcgggatgggtctcacagggcctgtcaggatgcaggctgtgatgtgaaggcccctcgacactcacaggattggacgggtttgtgaaggaatttggagtgagccttagttagttccttaccatttcctttgagcaacatcagtgcttttgacattttgcactgccgtataaaactaagtgcatgcagagatgtatgtttctgaacaaatcacaaaattgacaagcaactgccatgcattgttttttgtatcatagctaactgataaagtacagactgcaacatttacttattcaaatacctttaaacatctggtatttttttttttacctgtacttcccaggaatttgatgtcagatgcattttctattatttccatatctattgaaatgaactcaaataaaaaaaggggatgtttcattacacacttattaatgtgtaatttaagattaatgtgtaatcttgtaattcccataatcctcatgtgtcaagggcgggaccagatggacatgattgaatcataggggtggttttctccacgctgttctcgtgatagtgagttctcacaagatctgatggttttataaggggcttcttccttcactcaaaactcattgtttctgctgccaccctgtgaagaggtgccttcggccatgattgtaagtttcctgaggcatgcccagccatgtcaaactatgagtcaattaaacttttctttataaattacccagtcttgagtagttcttcataacagcatgaaaacagactaatacagtaaattggtaccacagacatagggtgctgttataaggataccctaaaatgtggaagtgactttggaactgggcaacaggcagaggttggaatagtttggagagttcagaagaagacagtaaaggctgggtgtggtggctcatccctgtaatcccaggactttgggagaccgaggcaggtggatgacctgaggtcaggagtttgagaccagcctggccaacatggtgaaaccccatctctactaaaaatataaaactagctgggcatcgtggtgcatgcctgtaatcccagctacttgggaggctgaggcaggagaatggcttgaacatgggaggtggaggttgcagtgagcagagattgtaccactgcattccagcttgggcaacaagagcgaaactccatctcaaaaacaaaaaaaaagaagacagaagaatgtggggaagtgtggaacttcctagagacttggagggcttggaagacaagaagatgtgggaaagtttgggacttcctagagacttgaatggcttctaccaaaatgctgacagtgacatggaaaatgaagtccaggctgaggtggtctcagatggagatggggaacttgttgggaactcggataaaggtgattctttctatgctttagcaaagagactgcaacactttgcccctgacccggagagctgtggaactttgaacttgagagagatgatttagggtatctcgtggcagaaatttctaagcagcaaagtgttcaagaggaagcagagcataaaagtttagaaaacttgcagcctgacaaggcgatagaaaagaaaaacccattttcttgggagaaattcaagccagctgcggaaatttgcagaacaaggagtggaatattaattgccaagacaatgagggaaatgtctccagggcatgtcagagaccttcttggaagcccctcccatcataggcctggaaacctaggagggaaaaatggtttcatgggcccaggaccccctgttctgtgcagctttgagacatggtgccctgtctcccagctgcttcagctccagccacagttaaaaggggccaaggtacagctcaggccattgcttcagagggtccaagctccaagccttggaggcttccatgtggtgttgagcctgtgggttcacagaagtcaagaattgaggtttgggaaccttcacctggatttcagaagatgtatggaaatgcctggatacccaggcagaagtttgctgcaggggcaaagccctcatggagaacctctgctaggacagtgcagaagggaaatgtggggttggagcccccacacagagtcctcactggggtactacctagtggaactgtgagaagagggttaccgtcctccagaccccagcatggtagctccactgacaactttcattgtgcccctggaaaagccacagacactcaatgccagcccatgaaagcagccaggagggaggttgtaccctgcaaagccacaggggtggagctgcccatggccatgggagcctatttcttgcatcagtgtgacctggatgtgagacctggaatcaaaggagaacattttggaacttttaaggtttaatgactgccctattgtttttcagacttgcatagggcctgtagcccctttgttttggccaatttctcccatttggaatgggtgtatttacaggcacaatgcctgtgcctccattgtatctaggaagtaactaacttgcttttgattttacaggctcataggtggaagggacttgactcagatgaaactctggacttggacatttgggttaatgctgtaatgagctaagactttggggaagtgtaggaaaggtatgattgttttgaaatgtgaggacatgagacttggagtggggccagggacagagtgatatgatttagctctgtgtccccacccagatcgcatcttgaattgcagtttccataatccccaagtgtaaagggtaggatcgggtggacataattgaatcatggggtagttgtccccatgctgttctcatgatgatgggtgagttctcatgagatctgatcatttcataaggggcttcccctttgctcaaaactcattatttctgctgccaccctgtgaagaggtgccttctgccatgattgtaagtttcctgaggcttccctagccatgtggaactgtgaatcaattaaacctcttttctttataaattacccagtcttggatatttcttcatagcagcatgagaatggactaatacaacatgtgagtgcatttccagttaataaataggtaatattttctgtgctttctgctatggtaatgaattgcattacaacttcactaaagagagaaatcactcacaatttgagacctaaaccaagagctgaagaaagtgcaaagagacctacaataattcctataagttatttccaatggaaggcctctgtgaatgtagtactgtaatacaaaaaacctatggaataaaaagaatgcattctctgagtaatgttatgcagtttaacccctctctgcatatttttgtcacctgtcatctgtaatgtagggataatacaattaatgttattgtcatgattacatgagtgagatgagtgaggaattttttttgttttttgtttgttttgagacggagtctggctctgtcgctaggctggagtcctgtggcgcgatcttggctcactgcaacctccaactccccggttcaagcgattctcctgcctcagccttctgagtagctgggactataggcacagaccaccacactaggctaatttttgtatttttaatagatacggagtttcaccatgttgtccaggatggtctcaatctcctgacctcgtgttctgcctgcctcggcctaccagagtgctgggattacaggcatgagccaccgtgcctggccaagtgaggcattttaaacagtgcatggttccaagtaatggctcagaaaagttagctattagaattgtaatggttgttagtgatgtttgccattttctttaagaatttcacacttgtatcaaaaaacagtattaaaagaactatacaatcatttaatatataaaaaggataattctttgtagtttaagccataaaagttgcatccaaacatagatttaaataacctcttgtccccacctttaatagtctttcaaaatatcgcatgtgctttttatattgtgaaaagaaataaattaaatagtcatacttacaggattaaaagttattttcatgtactttggaatttgttcatattagttacacttcaagttaatattacatgtaatattaaatgtacttaatattaaaagtgcatttaaaatacctgaatgaaaataaattttcataatcaaataaatcccagcactgattcaagagaattataccaccatgctcatactaagaagacactgaatcaaagcagaagcacatgccttaatcgttgataagtgaagccttcagtgagtatcaaaaataaaagatagcaaaaacagaataattactacactaatcatagatgattggcaaaggtaaacataacaaatttctaggaaggagctgcttcgaagagtgatctttatgcgggaaaactccagcctggtgcctttgggatcactgatttcccttgctgggagtacttgtggtgaaactaataaaatcactgagatgccacaagaaaaataacttgggaagaagctgaccaccgagttacagattcatgggaaagacatcaggaggtcatttccctcatttccttgccttgagattaatactcaagtcatcaacgctaaataaatatttcctgaaaataaagtatttctaggaaaaaaatcataactttgagaatcctcatgtttgtataattgaatcaaggacagatgtgactaacttcagaagtctgttgttcttcctatattcagtccagcaaactctcagcaaagcccccagtgtatgaagaatatgaaaaaggagttctgctagtagaatttgggactgagagtccagagttctgatcttttggcctgtgccttctaatgccctttcaccccacttcatctaaggcaaccctagaaattgtcaaagaaaaacagcagtgctggatacttgctaaaggcaatgagacctattttactcagactatttcagcaggagggagagacttcagtataaactaagctcaactccaagtaagacaaaggaggctgatgtttttaaaaatagaacaaatgggaaataaaaagaaactatggaaaagtaaaaagaggggaattaaaaaagggactgaggactacgtgaaaatgcaaattataaaagggggtaagagtctggcgcggtggctcacgcctgtagtcccagcactttgggaggccgaggcgggcagatcacgaggtcaggagatcgagaccatcctggctaacacggtgaaaccccgtttctactaaaaacacacaaaaagttggctggacatggtggcgggctcctgtactcccagctactcaggaggctgaggcaggagaatggcgtgaacctgggagggggagcttgcagtgagctgagatcacgccactgcactccagcctgggggagagagggagactccgtctcaaaaaaaaaaaaaaaagcggggggtaagtagagaattactggaaatgatttgacaccatcagttacgacaatatacattatgtagtttggcagcattgtattttcttgagcaaagactcagcgcagggcctggggttaactactccaagtggaagccaggctaatgttaggtcaagtctcttagcacagtgtttaggcaaatcctttttgcttcagggaagttcacagtccctcctcttgttcaagagaaagaatgaatttctttctcgtagaataaatatagttgttgcactccaaagtcctcaaaagaaaaaagttcagccattgtttatcatcattgtgcaattcaggaagagtcaaggtggtaaatgcaacaatcgaggaggtttggtgtactatcaatggtggcacaattgtctcataagaatagagatgcacttggtgggtcatgcctgtaatcccaacactttgggacgctgaggtgggtggatcacgaggtcaagagatcgagaccatcttggccaacatggtgaaacctcatctgtactaaaaatacaaaaattagctgcgcatggtggcacacgcctgtagtcccagctactcaggagactgaggcaggagaatcgcttgaaccaggagggggaggttgcagtgagtagagatagtgccattgttctccagcctggtgacagagtgagactctatctggaaaagaaaaaaaaaaagaagaatagtggtgtacttaagagacaaagaatattgccattaaggatgtttttaagaagccaagtgcaagatcaaaaaagacaaaggagagcattacataatggtaaagagttcaattcaacaagaagatctaactatcctaaatatatgtgcacccaatacaggagcacccagattcataaagcaagttcttagagacttacaaagagacacggagtctcacacaataacagtgggagatttcaacactccactaacagttattagacagatcaccaaggcagaaaattaaaaaacatattcaggacctgaactcaacattagatcaaatgtatctgattgacttctacagaactctctactcaaaaacaacagaatatacattcttctcatcaccacatggcacatactctaaaatcagccacataattggacataaaacaacgcttagcaaatgtaaaagaaccgaattcttaccaaacacactcttggacaacagtgcagtaaaaataaaagttgagactaagaaaatcactcaaaaccatacaattacatggaaattaaacaacatgttcctgaatgacttttgggtaaataatgaaattaaggcagaaatcaagaagttctttgaaaataatgtgaacaaagatacaacataccagaatctctgggacacaggtaaggcaatgataagagggaaattcatagcactacctgcccacatcaaaaagttagaaaaatctcaaaaagttagaaagatctcaaattaacaacgtaatatcgcaactaaaagaattacagaagcaataacaaatcaaccccaaagctagcagaaaacaagacataaccaaaattggagctgaatggaagaaaatcaaagacacaaaaataattcaaaagattgttgaatccaggattttttttgaaaaaattaataagataggccaacacctagaataataaagaaaaaaagagagaaggtccaaataaacactactaaaattttgaggcccggtgtggtggctcatacctgtaatcccagcactttgggagactgaagcgggtagatcacttgaggccaggagtttgagagcagcctgacaaacgtggtgaaaccctctctactaaaaatacaaaaattagctgggcatggtggcacacaactgtagtcccaactactcaggaggcggaggcacaagaattgcttgaacccaggaggcagagcctgcagtgagccaagatggtgccactgtacgccagcctggatgacaaagcaagactctgtctcaaataaaaaaaaaaaaaaaaacagaaaggaaaatgttaacactgactgcacaaaaataaaaataatcaaataaccactaaaaactactatgaacacctcaatgcacacaaactagaaaaccttgaaaagatggataaattcctggacacatacacccacccaagactaagccaggaagaaattgattgcctgaacagaccagcaacaagctccaaaattgaaccagtaacaaatagcctaccaaccaaaaaaagcccaggacctgatggattcatagctgaattctaccagatgtacaaagaactggtaccattcctagggaaagtaccccccgaaaaattgagaaggagtgactcctctttagcacattctatgaggccaccatcatcctgatactaaaacctggcagagccacaacaaccaaaaagaaaacttcaggccaatatccttgatgaacatcaatgcaaaaatcctcagcaaaatacttgcaaaccaaatccagcagcacatcaaaaagctaatccaccatgatcaaataggcttcattcctgggatgcaaggttggttctacatatgcaaatcaataaatgtgatttcgtcacataaacagaactgaagacaaaaaccacatgattatctcaatcaatgcagaaaaaaagctcttgataaaatttaaccccctttcatgttaacaactctcaacaaagtaggtattgaaggaatatacctcaaaataataagagacatctatgacacatccacagccaatatcactttgaatgggcaaaagctggaagctttttgcccttgaaaactggcacaaaacaagtctgccctctctcaccactcctattcaaaatagttgtgaaattcctagccagagcaatcatgaaagagaaagaaataaagagcatctagataggaaaagaagaagtcaaactatctctgtttgcagatgacatgatgttatatccagaagcctcataccttcagcccaaaagctcctttagctgataaacagctaaccagggaggtgtagaattctctacaatgagaattacaaaacactgctcaaagacatcagagatgacacaaacaaatgaaaaaatatcacaggctcatggataggaagaatcaacataattaaaatggtcataatgcccaaagcaatttacagattcaatactattcatatcaaactaccaatgacattcttcacaaaactaggaaaactattttaaaattaatatagaaccaaaaaaataaggcctgaatagccaagacaatcctaagtaaagaggagaaaagctggaggcattatgttacccaatttcaaactatgttacagggctacagtaacaaaaacaacatggtagtggtacaaaaacaggcaaataaaccaacagaacagaatcaagagcccagaataagattgcacacctatgaccacctgatcttcaacaaagctgacaaaagcaagcaatggggaaacaattccctatttgataaatggtgctgggataactggctagccatatgcagaaaactgaagcatccactcttccttacaccacccttccttacaccaaatacataaatcaactcaaaatggattaaagacatagtgtaaaacccaaaactatgaaaacccatgaagacaaactaggcaatacaatcctggacataggaataggcaaagatttcatgacaaagacgccaaaagcaattgcaacgaaagcaaacaatgacaagggggatccaatttacttaagagcttctgcacaacaaaagaaactatggacagagttaacagacaacctacagattgggagaaaatatttgcaaactatgcatccgacaaaggtgtaatatccagcatttataaggaacttaaacaaatttacaagagaaaaacaaacaactccattaacaagtgagcaaagaacatgaacagaaacttttcaaaggaagacacgcatccaacaagcatatgaaaaaaacttcaatatctatcactaatcattagagaaatgcacatcaaaaccatagtgacatactgtctcataccagtcagaaaggctattgttaaaaagtcaaaaaatagcagatgctggtgagaatgcagagaaaaaggaacacttagacacattggtgggatgtaaattagtttaaccattgtggaaagcaatatggtgattcctcaaagagctaaaagcagaactgctatttaactcagtaatcccagtactgggtatatacccagaggaatataaaccagtctaccataaagacacttgcacatgtaaatgttcatcgcagcaatattcacaatagcaaagacatggaatcagcctaaatgcccatcaatgacagattggataaagaaaatgtggtacatatacaccatggagtaccatgcagctgtaaaaaagaatgagattatgtcgtttgcaggaacatggctagagctggaggctattatcctcagcaactaacgcaggaacagaaaaccaaatactgcatgttcttacttgtaagtgaaggctaaatgatgagaacttattaacacaaagagggaaacagcagacactggggtctgcttgagcatgcagtgtgggaggtgggagaggagtggaaacagtaactgttgggtactgggcttaattcctgggtgattaaataacctgtacaacaagaccccatgacatgagtttacctttgtaacaaatcttcacatgtacccctgaccttacaataaaagttaaaagaaaaaaaaaaaagccaagtcccttaaaaagtctcctaagccatttggctggggaaaccattttctccttagagactaagcctgtctggaggggcgtgagctatgttggctgcttctcaggcacgtgctgccacgacttcttgattcatttctctttatcattcatgaatgaaaagcattgggaactcaccagtgcacaagcaccttcttgaaaacccagtatgtagtctaaggcgagctagttttgtaaagtcattttagaagctccaatacctcatggatttatgaaacaaaagcttatattaagtttgagatgaactctactaattattttttaaattattatttcaatagcttaaggggtacaaatagtttttggttatatgaataaattgtatagtggagaagtctgggcttttactgtatctgtcaccaaataatttacagtgtacccaagaggtgattttttttatccctctcccttcctctctgagcctccaatgtccattatgcccctctgtataccttgtgtacccatagcttagctcccacttatatgtaagaacatgcagtatttggtttttccattcctgagttacttcacttatggtaatggcctccagttccaagttgctgcaaaagacatttgtgtgcgtgtgtggctaagtagtattcctttttgttgttgttgttgagatggagtctcgctctgttgcccagcctggagtgcagtggtgtgatctcagctaactgcgacctctacctcccgggttcaagcaattctctgcctcagcctcccgaggagctgggattacatgtgcccgccaccatgcccagctaatttttgtattttcagtagagatggggtttcaccatcttggccaggctggtcttgaactcctgacctcatgatccacctgcctcggcctccccaactgctgggattacaggcgtgagccacctggctgggcctgtagtattccattttttatatgtaccacattttccttatccactcctccgttgattggcactcagcttgattccgtatctctgctatcgtgaattgtgctgtgataaacatccatgtgcaagtgttctttatatataatgacttcttttccttgggtagataccagtagtgggattgctgattgaatagtagatctacatttagttccttgagaaatctccacatcgtttttcacagaggttgtactaatttacattcccaccaacagtgtatgagcattctctttcaccacatctgtgccaacatctgtttttgtttgtttgtttgtttgtgttttaaccttttggctagggtaagacaattctgactagatggtatctcactgtgattttaatttgaatttccatgatgattagtgatgttgagcatttgttcatatatttgttggccgtttccatatcttcttttgagaaatatctgttcatgtcatttgcccactttttagtaggattatgtgttttttttcttgctaatttgttggagttccttttagattatggatactagtccttcgtcagatgtatcttacagcataggagttggctgacctggtgacaaagggtagaatatcaagaacagagcaccctgtaagtttggcctgagcaagtggctctccccggacctgtttaaggctgtttgtcatccagccattatccattcacaagtttcaggctcagcaattgtaggagcactcatgtttctaatttttccattgggaaatttttcatacatttccatttgagggacagcataagccacatcgcagcagccagcccaatgggctggaagtactttgtatggttttatgaccacatactaaataatgtcccttgagggcatactagtgttggttattgcctctagtggttgtaacagaggctagaggagctaacctggaatagactccaaagagacagttacaaacatcatcttctaaatggctgggtactttggtaccatttagccagcaattttttgcccagtctttcagttcaccaaaatattgatccggggtaaaataatttcctatgatactggtattgcgtgggtattgcagacaatgctgtccttaatgggagtttggcccttacaaagaatgtctgtttcttgaaaataggtttcatcttttcacaaggacacagagcatttactgtgttccacagggtgactatatttattagactgatttctagtaaaacaccacgtttcttaggttaaagaggccacatcatactcccagtcacaagggcttttaagaaataacccaatatctttctaaaagggagacctaaatggctgtatatttgtaatgttttctgccaaggccatctaaagcataagggagacaattattaagggaatacgagttttaggatagagtgggaatgggcatagacccggcaattactttggttaatttcattggctactttgtcagctaagagaccgagggaattacggtcatgagaggaaagcacgggatagggtaagataaggaggaaacaggggaatcatgacagggctgctgaggctggagatggagtatatatgttgtaagtaggacacatcactaggataaagatgggacgttgtagaggacacaggagtagtagcagaataagtagacccaaaattgaagtcagagacaaagaaggggaatcggagtgaatcttgtttcaggatctttggcagaagcggactgcttcatcatatcatttacttgctccgtagttcttaggatggatgtctgtctccagctgttggctacttttagaggttcttttcttttctttcctttccttttttttttttttttttttttttttttttgagaccgagtcttgctctgtcacccaggctgaagtgcagtggtgcaatctctgctcgctgcaaagtttggaggttctttttttttcttttcttttctttttgagattgagtctcgctctgttcccaaggctggagtgcagtggctcaatctcggctcactgcaagctccgcctcccgggttcacgccattctcctgcctcagcctcccgagtagctgggactacaggagcccgccaattagcgcccggctaattttttcgtatttttagtagagacggggtttcacctgatggtctctatctgctgacctcgtgatccgcccgcctcggcctccgaaagtgctgggattacaggcgtgagccaccgcacctggcctggaggttgttcatagagtctcagcgtgagtctctggttagagtgccttccaattgaaatagattttgtattttttcaactaaaagacatgcacccaagttcaaacactctgtaatttgttagcagtgttagcaatgagtgaaacaataaaaggtcccctccctctgggttcaaggttagttttctgatgttggtgttttttcaaaatgccagatcacttacttatgaagcaagtaaggactgatcagggagtttaaagatacaagaagcctcaattgtggagtatagtggggctgtgtgtatttaattaatccctgacaatatctgaggttgttgaactgagttagtttggaatcttctgctagtttgcattagtagggtattctcatgggtatcccgtaatgattcaaagaggatcgtttgtgtgaaggtagggccaaggatctgagagtcagtgtgatgggtaatatctgtggccatggcaagttctttcttcagacagtttagccagttcagcttgaggatgctgttggctctttgtatagaactttatcactgaggatggtaagtccagtggaatatttggctggtgtgtgtaacctttcctatttcctgaataattttgccagtgaaatgtgatcctctgtcactagaggcagtagaggggataacccatgtggggaagattcactcttaataaaccttggcaaccgatgtccttgaggagtttcaacagggaaagcctcccattctattttccagtgaaggaagcctattttccagtgaaggaaggatgtagagggagccacttcccttttttgccccacctttatgctttttggaggattatgttgttggtagatgcagcaaatggcaacagcttggtccaaataaaatctaaagagtccaagccatattgttttgtttaatatatactacatgttatcctttctgtggtaaatctggatgagcaaattgtacacaatgacttgggagacagacttaggagttatcaaatggccatctgggtatttctgaagtccactaaagtggatcaaacattcacctttttctcatccaattctttctgactctgaaattgttatctgggctgtgtgaattttacatttcctttagaggcattgtaaagacattgcttctgtcaatttatttaaagagggtaaataatcctagcaggactgtgggtatttgaaatgaagcccaggtatctagtcacaaggtttggagacttcctggatttcttaggcggccaaggaagaggatgctagcttagcacctttatcagccaatttatttccctgagcctcatctgagtattttatactatatccctcagctttaactgtaacaactagctggggcaatagcaatgactctagaagttctgctatttggggtttacttttgactggggacaagttgctgtcatgaatcctctctgttttcaaaacataccaaaatcatgcactacaccaaagacccagtgtctgtcactgtaggtgctaatcttaattccctctgccttatataagcctgaatgagaacagttaatttagccactttggctgatttaacgtgtggcaaagcttggcattcaagagttttgtgtagatgagtgatggcatatccaggctggaaggtcccaacctccttccagaagtaggagcgattgacatagagcatcaggtcgacttaggagagaagggtttctgacatatctaacctaaatgagacagtgatctggtttcagtagcaccattgtgtgtgtgtgctgaggggttcccttagtggacaaaatgtacagggtagcaagggatttttggcagcaaaggattgtgattgggtggggaggcatagtgatatttcatgagaagtaagtcgagaagcaaacgagtgctgtgtgttttcattaagtaatagggtcaacacagcatgggaacatacacatcaagtgggcggcctaacactaaatcagaagtagcctggatgagttggaagtcatggccactgtttgtaggccaggaggatatgcttcagcactggctggttttatgggaaaacagagagaaagacatggctgagtctcatggtgctcagagaaggccacagccttggggtgccgtggtgaccacaaacacttcccccatcccataccaatctttaagagccttttccttcttaaagacctgtcacttagcaaagagctttcaatgaaccctcccctctgggccacttgttggattgcagccaatcagtgatggagggctggacacaactgtgggatgctgtgatttggtttagcccttgggtctagagtgctctggggtccactgtacttctgggataaaacgccaaggccatgactctcttgctcatttacaaacaaaaaattgagggctagctaaacaaggacagggtggaagcagctttctgtaagacacacccaccagtgtgccctgtcagtttaccattgccatggcaacactcaggcattaccaccactttcagcagcaatgacctgatgacccaaaagttaccacccttttcctagcaatttctgcacaaaccacccctgaatctacatgtaattaaaagtaggtatacatatgacagcaaaactgggctcagctgctactctcggcaccctgcctatggggcaaccctgggagcagtcactgagctgtgaccctgcaggagctgtaacagtgctgctttgataaaggtgttttcttccaccttaccactggctcgcccttgaatcctttcctgggtgaagccaagaacccttgcaggctaagcaccactttggggttcgcctaccttgcatcagcatcaggttttttttttaaacttgtaaaatagtttttgtgactctgtcatgtattttgcagtcatgaactaacattttttccctcaattgtcagttgcagtttcctcaaagatcattataaatactccttaacctacaaagtttggcagtcacagcctactctttgaggaacagcctgactcaccatcaagtggctcctcaggtggttttacttcccatgtttcccatgtgaggtactaagcctcagtgattcctggcaaaacttgtattctctgttagtattgcgctaactttggagtgagtttcttttggtgagtaataattttagtcaatgatactactgattattttatctttttttaggcttatgatgaatacctgatttatgattagtatgtttttcacttttacacatttcaaggaaggaaacaagaacagacagaaacacaacatacttcatgaaaccacattttagcatcctggccgagtattcatcactcagcaagatagagagacataaactatttctagcaagaatacttcataaatgatgaatagaagaaaaatagaagtcctaaaaatcttgcagaactgtcttaatttactaatatatttacactgtatcctaagtcactctctagcttcttgctctaagcatatgaaatgtaagagctaatgggaaccccagtgcctgtataaataacaagaaccagcatgtctttatttatggcagggaatactctacaacctgggacagatgccactctgcttcagtttggggaagctcctcactttaccatcctgacgttgaataaatgattcaaaggcaacctgatgcaacctgagccactggatggcttctgtaaataaagttatctcacctgccattcattacagagaaaacaagaaataaggcactacatgtcatatttgtctagatcctatacatatttaggttcacattaaaatgaagagaaaacaacataggctgagaatcagaaaacctgaactctgtcccagctcagctactgaccaaagagaattaatgaatcgctttaaatgtcagtttcttcattaagcatcgtagagaatgtcaaaaccaagtttacaaatactgtcattccaaaaccacacaactcaaatataaataatctttataaggtaacaaaaatgtacataatactttacataaacatttttagaataactttattataactcgataagcaaaataatccaaacctttatacatttctacaaggatagtcatgtatgtcaatttttgggtttcctctcgtgcctattttgtctcctgagccggcccctttccagctgacacatgtgctccgtgttctcccacaatagcctgatctggcctgagtccacgcccctgtgagcctcctttctttgcttacaacagcagcctgcctgatgtcagttatggactattctttttttcagcctcgtttcagggtcccctgcctcttagagctgctgctgtagcttagctagagacccgctgctgttgcatcatggaaaagtgccacatatgtgcacatgtgaaagaatacgcagaccttcatgttgtgttttagttttagaaaaagtcagaagtagcttcacttgatttcagcttgtaaagacataggagggaggcaactgggaatcaccattgcaaaaagcaaacatcaaaaatcacattaaaatgctgaagtgttgtggagcacaaacctagctttattggatcaagcatttgtgagagttcttctacttgctttgttatgctttctatcagacagggctcattctctgtcttttttttaacatattcatttatttcctttggtctgtttagattattatcacatcttatgttttaaaactagcaaaatattatgtgtaagtcatgaagacagtgtaagaaataataaaatgaacactgatgtacacattacctgcctaagaataaaaaactacccgtatttttagagtccttaacactgtcctgttaatgagtcccatttcttatctttataattttgccaaaataaatgcattagtaaaggacattgagcattattgtttcacatatttttcagtttaaacaaatggaatcacactgaatatatttttctgaaattgctttttagttcaatatttaatttgtaaaattcattcttatgatatgtttgtctgtactttctgtgcattgatttagagtattccatcacaggataatactataatgagcattccattttattagattggggttatccatttttttctattacaaaactagatgtccttttcttgtatgagtctcctggacataaaaggtagattttctctaaggtataaacccaacattcaaataattgtgtcaaaagatttgtatactgttggttttactacgttaaaatgaactgttttccaatttatgctcccatgagaagttaaaggttctggtagatctatattctcaacaatacttaatagtatcaaacgttttaacgttagtcaacttggtttctcatttgaattgtaatctgcattttttagaagtactgaatcaaggtaagaatcaagtaatgaaagactattattttagtaaataaaaatgctgtaaagacaataaagcaaatgaatgtaatcaaaagtggagacgggctacttcattctgatagtcaaagatggccttgctggtcatctgagttgagaggtggctagtaagacgagaagagatgttaagtagctgtggaaggggcctgctggtacagggcatgctccaaagccctgaaaagaggcaaacattctttccctctaaatacctgaactaagtaaaaacagtcctggctttgcacatttgaatatgcacaggtttaattaacatagtttagttaaatagcactagtctcccaacaacctggttacaatttcggttaccaccatatgctaactgtgagcaactgcataaaatccaaacttcattcccagctcttaattccacaaatgcctgtgtgagtaaataacagacaagcatcatgatcagggactgtattaatcttgtggggatgctgcaacaaagtacaaaaaaccgggttgcttaaaacaacagaaatgtattgactcgtagttgtggaggctagaagtcaaaaagcaatgtgttggtaggttcatgctctctgctggctctaggggagaatccttcttcccctctccttcctgtttgggtttgccagccatccttggtgttgtttgacctacagatatgtcactgcattttctcagtgtgtcttcacatcgtcttttgtgtgtgtgtgtctggagctgtatccaaattctccttcactataagacaccagttagtctattggattaggacccaccctaatgacctcattttaacttgagaacctctgtaaatgtgctatttccaaataagctgatattatttggagatattggggattaggatttgaaacatatcttttttggggaacacaattcacttccttcaaagcctgccagtgactgatcaatgtgcatcagctagtttgcacacagacagcaaagtctgcaatcgtgttgattccttgtctcccagtgagaaacccatgtgacatttataaatatgaataatcagaagaaaaaacttgtcaacaaccattgatgtgcagcaaagaaataaaaaatgtgataaccctggaagtggattcaaatacaatgtaaatggaatcatagaattggctcaccacaggaaacgcggcaagaggaactcggtgcaacgcagtgttctgacataaatgaggaacgcagctgtgattaaaaggatgaagaagccccagaggaagtgatgccggcaaagacagcaacaaacttcatattaaaggaactcttgtagatattgcatgacgttgacaatgttagatgctgttccgaaaacagcacgacagttcaccaaggcatagaaacactgctggctccttatcataagctatacgacaagagggaggcaagcacttttcaaactgggcttgatacacgtctataaataaataaagcactttaattggctgttgtttaatgttttaaattacagtgtataaactaagtactggccaggcgtgatggctcactcctgtaatcccagcactttgcaaggccaaggtggacagatcatgaggtcaggagatcaagacgatcctgggtaacacggtgaaaccccacctttactaaaaatacaaaaaatcagccaggcgtagtgtcacgtgcctatagtcccagccacttgggacgctgaggcaggagaatagcttgaacccaggaggtggaggttgcagtgagctgagatcacgccactgcattccagcctgggcgacagagcaagattccatctcaaaaaaaaaaaagtactaacttcactatgtttcatttccttatacatttataaccaacagtaagagatttttaatgttttggccaaaatttttaaatgacacagaacagtcgatgtttcacatggattgtttaggtcactttacagatcttcagcttgcatagtgatttgtatggccctgcactgctgtgcaaagagaggactgtctgtgttcttaaccagtaagaaggagggcaagaaagaggttctcagccagatattgcgtatgtaataaaatgatgggagagggaataacactttagatatgaaatgtaccatgtggggaagctatttgaacaacaacaaaatagcttaatttaacccgatggagtacactcagccaccttctagatgtccctgcttattcttcaaatcttctcttttgtggccccaaagaatgattcactctctggagtgaaaaataaccgttgctttctttgcctggaactttaaactgagttgtactgtatcatccaaacctactcaatcctctcttttccattaatcagtgaggtccaaaggagccaaagacaaatctctcctgtttttcttagaaatgtaaagatgttgcatctgtaaccacaggctgcttttaatcctaaaagtcagcgtgataatgaaatccagtgattaatttctgtcttctaatcaataagtagacatatcaatttatagtatgttagaaagcctcaacttcactgaaacaaaaagcaagaggctctgcaaatgttggagtgtgctaaaggaaaagcatggactgatgtttggggaaaggttggtcaatgtgatgaggccatctgtgtttgctaatagtgcttatcaaaattaggttcctacgcagagacagagaccaggagacaatcctgtatccttcttgatccttatagtccaaagggatggctcccaagtctttcagaaagacatttccatgttgtaggagatttaaaggggcagagaaagggtttataactccaggttatctgtcttttttttttttttttatccagacagaatctcactctgagcacaatctcggctcactgcaacctccgcctcccaggttcaagagattctcctgcctcagcttgctgagtagctgggattgcgtgtgtgtgccatgacgcccagctaatttttctctttttagtagagacagggtttcaccatgttggccaaaatgttcccgatctcttgacctcgtgatctgccctcctcggcctccaaaagtgctgggataacaggtgtgagccaccacgcctggccattgcaggttttctaaagttaaacctcttagaaatgggaggtcagggacctatagtcaagttttgggtgggacaaacagtaaattcttttggcagaattgaatgttcccaggcaggtgctttagaggggtatggggcatcgtagggacgtggctcggagctgatagacactgtgttggaatttggccaagtctcttagtgtatgtatgaggaggagggatgtgcagaagaagttgtttgtgccaagaatttatggttttcacaggttaagacagtggtgcctgggatcatctgcaaggcatgagtcaaatgttgacacaatgattgtttgcagactcatctgagggcttaggcagatatggacctgttgatactgaagtttctgaaggtagaggaagaaaacataatgtctcaataatatctgaagtaggggtaggaaaacagagatttaaggaggtgagatcccttaaggcctcagaaagaagcttcacttcttgcgcctcccttcagagtaaatgggtcattaaattagttctttgtaaccaacctgggaatgatggtgaagaagggaataatgagaggaaaaactttaaataagaatgcctgagagataatactaggtcagtgggagagaaagaaatttccaagaagttgtcatgggaaagggctcacgaataataaataaaaaattagttattaataatataaattaatatatgaaaaataaataagacatctgccaacagccacacttacagcactagatggattttaactgaattaaaacttgagtttttaatgaattttctacaatccaaaatttatttgtttaatttttgtaacaaaacaccatttctttactttttgcaaaagtaaaagtaaagtgctatttgtactttttaaataaaaactaattttaaagaaaaaaataattagctggacgtggtggcaggagcctgtaatcccagctactggggaggctgaggcaggagaattgcacaggttgcagtgagcccagatggccccacttcatccagcttgggtgacagagcgagactctgtctcaagcttcttcagtactcacatgtaaacttctactttccccttcagattacagcaaccatcatgccaaagctatacactctcagggaatccctgtggatttcactgatgaccactttaccaactattataaaaatcaaggccaggggttctcaaactctcaacatttgtgtgctcatctccccttcacccagagactccccagggctgctgggccacgctttgtttggtttgactggaacatagctcgaaagggatggaaatttccaagaggtgttaagagacacataaatatttcaaagattaaaatgaaagaaataaagaaatggacatttgtgagctttggtcatgagaatgcaggcctcgcagtacttaactacttccaaacccctgtccaaagagaggaccaaactctagtgaggcttccggcagcacaagggtgtcccgcggatgaccccagccctcttaaaatgactgcctgaaaaagctcacttgcaaagaaaatttactgtttgtttcaggcaaaacctggtgatgggcaggtagagccccgaatcccctcttagaaccttagaaagcttgcaattataaatttttctccacctttgaagtgtaaatctacatcccagaattgtctcctcaaagacctgagagttctctctttgaaatgcaaacattcaggaagctaactcttgctcttgttgccagttcctgagggaggggaaaggcctagctttggcgagcaccttgttccagcttgcacctctgactcttttattgccatgaaaatcaacatgtagacttttttcaaacccaatgacagcccattacaatggaggccatagcaatggaggtctctacatgcaaaaaaaatggtgggacagtttcctgataacaggtcaactttattccaaggataagcatgtcatgaaattattggatggcagattatgcttatctatggtcttcctttttctccttggtctcatcccaataacttacagatcctttaaaggcaaaggccaaatattcagctaagttaggcatactttagatgccaatatcaattttagctatatgggagatcctacttaagatattgaggacgatcatgtgtgtacagggcaaaaaagatgggacaaagagataagaaggggatgggaaatcacaccctccctccgcaccacagaccatgacctggggcaggtcctctaacaccaaacccacccaggccccatctaacagtatgccgcattctacatgacctcagagttctttcggaattccagctgaaaagctgaaaagcaatactatatagttgtggtttccagctggcccatgttagtatgtatagcttttcttcctcgccatgaaagcactatgggagaacgaagcccgatgctgggcatgctttgccaggtgggtgctgctgaatcacagacctcagcaactgtgttccgcctccacagaggccggagatgtttgtttccccagtgtgttcatatatttcagccagtttcatgcactttgccctctcagtttgcttcactttctggctcagtgaacctgacctgcaagtctccctgcagtttccctcagcaagtgctcactgggcagccccaacatgtgagaaacggctgtagggtgcacagaggtgaactaaattactaaaaactattactttactaaaatgcttcctggattccaaaactcaccaactgggagaaaggtcagacacacacggagacaactcatctacacaaatgatcatcagtgatttaaagaaggtacagcagagcgagactccgtctcaaaaaaaaaagaaaaagaacgtacaggagatcatggaataagaacaagaagagattactttccagggctctcagaaagtttctaaaaagaggtgccattgaccctgaccttagcattgtgatggagacattacagagctggtaggaaggagaagaagaaggaacggctggaacacacttggggtgaaatgagcagcatttcagtgtgggagctgcagactcagttttggtggaagagttaagagccaggatcttgtcaggaataattctgtgtccaagtgcagaatcgtggtttgctccactactgccagtaactccatttctcaatcatgatggtgatgctttttttttttttggctcccaatcccagagagtggccatactgaagtcacattacaacaattaacttttcaactattagatgattaatttttaccaagtagcaagaacagctgtttggcacgtagcagtgtggcatgagtatcttgtaaatgaattaaacaaaatatctctccaacacacacacagtcattcttgctgcatgtcagcctccacttctccctccattatttgatgctgtgaagctgaggcagccagcttgagcgaaagctttcagatctcactccaacaaagagctttgattgattcatttagtataaggtgttttatctggctagagaaatccaagctgagttttattaattactaagaaaagtatgcaatagattaatctttgatcaaaactatgtgtgaagtagaaacatattacacatatggagagcagttttatggaataaaaacaatctatgtgtggcataactgacattgtctttatatttttgggggggtgtgtgaggacggagtctcactctgtcgccaggctggagtgcagtggcacaatcttggctcactgcaatctccacctccttggttcaagcaattctcctgctgcagcctcctgagtagttgggattacaggtgcctgctgccatgcccagctaatttttgtatttttagtagagacggagtttcaccatgttgtcgaggatggtttcaatctcctgaattcatgatcctcctgcctcggcctctcaaactgctgggattacaggcgtgaaccaccttgcctggcctatacataatttttaaaacagatacagaatatatagatagcttaacaattataaaattgtatttatcaagtaggtcacgaggtaaacattttacgctatgcaaaagggagcaaacctccgaatttgtcatgcagggtcactagtggaactcacagcaacaggtctgataaagcagaggagggaaccgggcttccgtgtgctttagagagagtgaaacatgaggagtcacaggcagagaaaactgtttttcagaaagaaaagaaaggggacatgacagcccagcagtagggtgaagagggcctctccgtgggtgccgctggcttgagctgctgtaagtggctgtgccgggaacagaggatctgtataggagaatggggaagggagtgctggaaccgggggtgggcaggagcagcagtctggagaccagaatgacctagggtttcctctcatgctcccattcccagtgtttcatgtgtgtaaagtagcaagcatgcatatactgcttagaggcatctacacttaacatactacactcatatacaacacttgcatcgtacaaagtacacatagtaggtgtggcatgtaataagttaccctcctatattttcttctaaaagatttttaaatatttgcatctcaaatttaagtcctttgtccatttagatctggcctttgtgtgatagcgatccatttttgggatagagatccattctgatattttcccatatggataccaactgctcataccatggattatatagaccctttctgactgttctgtaatgttagccagggcatacatcaagatttcacacaagcatacactttcacaatagcaattcctgctgtggtaattataacttcacagtaaatctggtacgtgatagactcacataagctccacctcccaccttcacacactttagtcttctatgggattgtcttagttatactgggcccttttatcttccgtataagctttggaagcagtttagtgacaatggtactcttgtctttttcttgattttaaaaggagtgatttcgatatttttaatcacaaaacatgataggtgctgtaggttatttgttgactccttttatcaggttaaggaaattaccctttattcataggtggaaatatcatgaattatttaatttttgtaaaataattttataggccttttgagacaatcatataacttttgtctttaattcattgataaggagatgatttcagtagattttctaacattgaactaaatttgtattactaaccgagcttgttcatggtttttatactttgctaggtatacttcctagtattttgtttacaatatttgtctctgtgtgcatggatgaggtacacaatagcaaggttaccctagtctcaaatgaattgaagaatggcctcttttttctcccctcgcaaataattagtgtaacattggaactacttgtgacatcatctgggcatcctgttttctttgtagaattattaattatcaactcaattactttaatggtatgatttccatccagattttctaattatttgagtcaactttaataagttaaatgtatccaaaaatttgttaatctcacttatttacaaatgcatatatttaattgtcttattacttaatgaaatagatcataaatataaaagtgtgtatgtacagcttaagaagaatataaaatgagcatatgtgtccttccttcaggttatgaaatagaatatttccagtatcttagaaactcccattgcccttctacaatgccactcactccttccacaagaggtaaccactatccctaacttcctgttaatcattccattgcttgtcattacagacttgtatattgtttagttttgcacatttgactttttaaataagtgaaactatgtattgtttcttatgatcagatatgcatacacacaaacatgtatatgtatgtatatatacacacatacacacattatttttaagagcagttcaaagttcacagcaaaactgagcagcaggtatagatttcccatatactccctgtcccccacacatgcatagcctcccccataataaacatcccccaccagagtggtgcatttgttacaattaaagaacctacatgatacatcttatagtttgcattaaggttcacacttgggcttggacaaatttacaatgacaagtattcactattaaaatatcatacacgtactttcactgccttaagcatcctctgtgctctggttattcatccctctcttcctcctaactcctgggaaccactgatttttttttctatttctatagtattaccttttccagaaggtcataaagttggaagtgacatatgtggcctttttagattggcttctttcattctgcagtatgcatgtaagcttccactgtgtcttttcatggcttgacagccatttattttatcattgaatggtattcagttgtctggatgtaatacagtttgtttaattattcacctactgaaggtaatcttgcttgtctccaaatttttgcaattataaataaaacgtccataaacatctgtgtgcaggtttctgtgtggacataagttttcaactcctttgggtatataccaagaaacaagattgcggggtcgtataataagagtagatttagttttctaagatgccacaaaactattctccattttgtatttccatcagcactgaatgagagttcctgttgcttcacatcctcatcagcatttggtgttgtcagagttctggatttttgccattctaatatgcatgcagtagtatctcattgcagtgctgtgtttgagaatgtgagtagctgcagttcattcactcttagtgctgcgaggtactctattattggaatatatgatcatttagttacctattccacaatctacccatattgagagataactggattgtttccaggtttttaaaattgtgaacattctcatatatccctaggtaaacaaatgcaagaatttttctggggcctgtaacaggctgactagattgcactaggttgtagtgaagccgctgggtcagagggtacatgcatgatcagctgtatgagctaacatccgttttccaaatggctgtccttctacttgcatgggatgaatgcttccacggttctttatccttgccaatactacacctttcagaacttccaaaaaattttgtcaatatgtgtgaaagggtatctaattgttaattttcattttcatgattattattaggttgagcactttttcacatgcttatgggctatttatgctaacttcttgaggtgttatttttcacttattaatttataggagagctttatatattctggatactaaacctgtctaggtaacatgtgttgcaaatatctctgccaagttttgcatatttttttctcattgcggtatccaataaacagaagtcttaaatttttatgtgatcaagttagtttttactcttgccgtttgttcttcttccctatgtaaagataaaagagatgctccacagtttttttctaagaatgttgagaaggtatctttatccattaaaatatatttttaggtttggtctatgggattaagtttcaatttccttttttcccccttatggagaccagtggtcccagtgttgcttattgtaaaatttactatcttcacttaaccacaataaaagctgtgttacaaaatatgtttccaagtatgtgtgaaaaatatatttatctttatgattctactcagattaattagctctcaggactgctgtgtccagagttgattccttctggtgggttcgtggtgttgctgacttgaagaatgaagccgccgaccttcacggtgagtgttttcgctcttaaagatggcaaggacccgaagagtgagcagtagcaaggtttattgggaagagctaaagaacaaagcttccacaacggggaagagcacccacgcaggttgctgctgctggggtgggggtgggggggtggccaggttttattcccttatttgtcacgtttctatcctatcagagtgcccttttttcaatcctccctgtgattgactacttttagaatcctgccgattgatgcgtttttacagagcttgctgattggtgtgttttacagagcgctgattggtgtgttttacagagcatggattggtgcgttttacagagcgctgattggtacatttcacagaactcgtgagacaggtaagttcctgattggtgcattttactatcctctggtaagacaggaaatttccccaagtccccactcgacccaggaagtctggctggcctcagctcttgctaccagaggctaatttccaccctggtatttctcaggcccatagatagtgtgaattcaaacccaaaccaatatggctattgttttgtatttagaaattatcatacgttttttatttttcatttttttgtctaccctattgggaccaagacaagcacatattttcactttcttatgggggtgggattttcctagcccaggcacttaacgtgcttctttttagaaatcctagatttatgcaggaggcattttagcctatattccttcctgcatgggcatcagtctctgtttcctgaattaggtgctcatgggtctgggccagtaggtcctgggagacaccgcagggcaaatgccagatgagacactcacacctctggattcagactttttttgctcttctagatatctgaaaatttgccttactttgactcagcccatgcattaaagcagatgcttttaaatattttatgatgcatgttttaggaaagggtctgtctgggtatttcttctttcgattttcatttttcattcagttcttctttcacactatcctaagcattaatcaactcgccatttatgtcagtacaaaacttcactatcctgttcattatcaccatttcattttgttctgcataggccagactatttatctaaaaatgtttaaagaaatctaaggccttaaaggattctttctcaaggactctactgtttgtatttagagaaatgctcatttgttccactgttttactttcttcttgggtcacgctctttgatgactgcgatcttacagaggatgacaaaagagggcccaccctgagacagtaatacctgcttgcccctttggattttattagtgttatcaaaatattaataaaatgtcaaaaacaaattactatcattagaatgtgtgcctcacttaaaaatttctctctctaataagaagtttttgtttcctagttcctttggtaccctaatgtttaggtaaatattctctgaggaaaggatgtggaagtcatagcaaaatatatgctggacttgaatgaaaatatctgtttcataaaagttaagcaggcaaccaaaatttaccttttttaacctaaattatctaaacatgtatttacatttctgcttcattgaaagatatttgacattaaatgtccctgagacagattttggaatgccctctccttctaaaatatattttttatcttttgtggactaaacagttagttaaaaatgaacttaatgattgctaattactaagttatctaaacagttatttaaaaatgaacttaatgattgctacttagttatttataatgcatttcaaaattaactttatcatctaaaccttttaacacaaatgtattaaattatgaaacagggaattggctatttttgttcaaatgtttattctcatcaaacttaaaatatcactcagctatatgattaaaaatgaaggcttcagtcattaaattatttcccagttatttgcgatatttctccatattaaaggaacaaacagtgcccttcgaatctgttgatagttctattgatagtggccatcacaagttacacattatcaataaggtcaaggcacaaataaaatttctcccttgcttttcactcaaaaactacaagtatagttctttgataagatgtcccaatcatgatttgtgatgccaatcatagaaggaaagaggatgttgagaaacaataaaatagctactttaaaatgttctgtgcctgaacattttgatggcaatattggtcatattataaatttgaaaatataaattttaatctagattgactttattctactagtgattttaagagctttatccaagagaaacacttacatttttattcctaatgtttctttaaaaatgtgaaactcctttttttttttataattttaaaaattcctagataagcagaacatagagccaactgttatgttctggttgtttttaataggtatatttatgttatcccccaaattataatttattaatgtctaacttcagttagatgagttgattacttttcatacaccattgactaaaggaaacctaattttacacgtaattcaaggggatctgtgagtaagaacatttttaaattaaagcaacacatgtgcatggaaaatcattcaaacagtttgatggcaaaaaaatcagtggaaaccagaaactttttttttccttccacagaccttggtcctgtttttcagagttaggcaggttttatcatactcttttttttactatatgctattctcttgaactgtaaataatattatataatcacctaatttgttttatcagttttaagtaatatcccttgactttttatgaacgatagagaatatagctcatttaccctactttcttttcttttttcttttttcttttttttttttttttttgagacggagtctcactctctcacccaggctggagtgcagtggcgctatctcggctcactgcaagctccgcctcccgggttcacgccattctcctccgtcagcctcctgagtagctgggactacaggcgccagccaccacgcccggctaattttttgtatttttagtagagacagggtttcaccgtgttagccaggatggtcttggtctcctgacctcgtgatccgcccgccttggcctcccaaagtgctgggattacaggcgtgagccactgcacctagcccatttaccccactttcttcttctaaaactatatttccaatttagtctttaatatataattttaagggatttttaaaaatttgcttcctctaaataatatacttacagtgcttaattctttgcttaaataatatattgtttaaatatacagtccatccaatttgaacaccactgattggctcagtaggatgtggagattagtgtacaacttccctcccctccaacagtccctgtcatagctttcgacttgtatcaaatatggttctatacttatattttcacattttatgtaaattacatcctattttgtaattataataaagtctgtgctttgttcataggttaattttgatcatggaatctcaggtgaattgacagcatcattattatgttttctttttttttcaaaccacagtcgcaggtggcatgatttgatttgtgtgaaggcaatgaaatgatacacagatacaccgaagcctcccaaaagaatcctggttccaagattcaagaagatggattaatgtttttccattaattgttggaatttatgccatttttttactatgtgccatcaattttaaagcacttctgaaaagagataacaatctacaatagctggcattttaaattcataaaaatatagtattttcttctatttttatacatttatgatgcattatttcttatttcccaggaattttactacctttgttttgaatgattaaaaaggaaacatagcaccttttttcaacacatcaccaagatagcctagttaatattcttctctttctgaagtagttgaattgggagagacagcttgccaggcctgctgccacttgtcagcatcgcatccctacattcaaccacacttgcatctaacgaccgtctctttcattaaatttcttttgcaccttttcttcctgaatgagtgcatgatagttaattttcctgtgcacttgcatgtctcaagaaggttttaattctttttgtattgcattaatatttaagttaagtttataattgcaaaatgatttatactcacaacattgaagactcctttgttttgttacatcctgtcaaaatgatgagaagacagatcatcctttagggaaaaattggttttgattggcatcagcctttccaacagcaatgctggagacaagaataaaatgaagtaatatttttcaaggattaaaaggaaacaatttttaatccttgaattatttgcagccaaaatattttaaatatgaaagcacagaaaaagacattataaagtaaggcctcaaaagttttatttcaaataaatccctttgaaaatgcctagaggacatactccactaagaagagaaatacaccgtggtgttagaattgagggttccagaatcaatggtagtggtgtttatcataccctaaaaaatacatgaaaacataacatattgaaaacaactccgagtaaacttcagaaagtaccaccttagacaaagtgctgtcttaacagagaaagcaaaccagaggtggcaagaggaggctagagtacttatttggtttgctgagatgatattaattttgacacatggaggaaattgagaaaattaacataagtaatgacataaccaccattacaatgttaaaaatttccagatttcaaacaaatgaaaaatttttgatctatagagtgagaggtacaaataggaaaaaagacacagtaaagtatgaaaaatcataaatgagataacagaaagaagtcataatggaacaataattacataaatcaaaggttaagattgttaggtaaaatttttaagtgtcaaaaaacacaatataacctatcgaaaataaattagtggaaaaaatgtagcaggaaaatatgaataaaaagagctaggtccaatttttgataaaaatttgaattcaagttgataatatcctaaagaaggaaaagtctgtaggccaatagaagaaatagcagatgcagaggtgtgctcacaaacatgagtgctcatgacactagtcatacaaactcaaattcccattacagttgtatacaaacatgatggccgacaagaaggaagttcctttaagcccacttggagcattaagacaaatttaccatgtgaatccctaattgaactctgagttacttctgtgaaggaatgaagaatgatatcataaatgaatttcatatagcactccaagctccccctctatatggttcaggatagacttgagtatccacggttctggagtgcaagggaggagaaaggaaaggtgcattcagacaaaaaaaaagtgtacagaacacaccacggatatcagaagaggctgctcatggcaaggcgtggtggctcgtacctgtaatcccagcagtatgggaggccgaggtgggtggatcacctgagctcaggggttcaggaccagcgtgggcagcaaggcgaaaccccatctctaccaaaaatacaacaaaattagttaggcatagtggcacatggctgtggttccagttacttgggaggctgaggtgagaggattgcttgagcctgggaggcagaggttgcagtgagcccagatcgtgcctctgcactccagcctgggcaacaaagtgagaccccgtctcaaaacagaacaaaacaaaacaaaaaaagagactgatcaagaccagactcggctcctaggccttgaactccagtcccacctcacaccctaaggttcctaaagaatcagtaacttagttcaccctaccccactcctggcttccagatgtagcacacctttctaaacttgtgcaaacaatgaggactatctattttgacaaaataagaagaaatggagtcaaggcaacatataacagatatttttgccagttttattgattaacaaagaaaaattgtatatagttaaggtgtgcagtgtgatattttgatatacatatacattgtgaagtgatgattaccacaatcaagctaacatattcatcacctcacctggttacctttttatttgtgtttgtgtggtggagaatatttgagatctactctttcagcaaatttcaagtatacattattattgactttagtcactatgctgtacgttagatctccagaacttattcatcttataactgaaagtttgtaccttgtgacaaacattttttcttttcccccaactcccaggccctggtaagcactattttactctcttaccatgagtttgacattttttaagtatgcatataagtgaaatcatgcaggatatttctgtgtgtgttcctggcttattttacttaccataataaactccaggtttgtccatcttgttacaaatggcagtatttcctcatttttaaaggctgaatgatattccattacatatgtgtgtgtgtgtgtgtgtgtgtgtgtaatacatttaaaacatccatctgtcaatggacacaggtagtttccatatcttggctgtgtacataacactgcaatgaacatgtaagtatacatatctctttgagatagtgattttctttactttggatatatacccagatggggattgctggattatatgggagttccatttttaattttttgaggaaactccatactgttgtcactaatggctgtaccaatttacgttcccatcaactatcaactaagcacaagggtttctttttctcaatatccgcagcaacatttgttacctttttactgttacaatagccatcctaatagatgtgaagtgatatctcattgtgcattttcctgatgattagtgatggcaaacatccttttattagtatatacctattgtcaatcgtatgtcttttagaaatgtatctcttcaggtctgatatgctttggctgtgtccccacccaaatctcatgttgaattgtagctcccataattcccatgtgttatcggagggacccagtaggagacagttgaatcatgggagcagttttccccatactgtttttgtggtagtaaataagcctcacaagttccgattgttttataagcgatttcctttttcacttggctttcatcctgtcttgcctgctgctgtgtaatatgtgcctttagcctcccaccataagtaaggcctccccagcctcatggaactgtgagtccattaaacctctttttctttataaatcacactgtctttggtatgcctttatgagcagcatgaaaacagatgaatacagtaaattggtactggtagagtggcgtgctgctgtaaagttatccaaaaatgtggaaccaacttcggaactgggtaagaggcagaggttggaacagtttggagggctcacagaaagacagaaaaacatgagaaaatttggaactccctagagacttgttgagtagctttgaccaaaatgctaataatgatatggacaatgaaattcaggctgaggttgtctgagacggagatgaggaacttgttgggaactggagtaaaggtaaatcttgctatgttttagcaaggagactggcagcattttgcccctgccctagagatttgtggaaatttgaacgtgaaggagatgatttagggtagctggcagaataaatttctaagcagcaaagcattcaagaggtgacttgggtgctgttaaaagcattcagctttaaaaggaaacagcataaaactttggaaaatttgcagccaaacgatgtgatagacaagaaaaaccaattttctgaggagaaattcaagccagctgcagaaatttgcataagcaacaaggacccaaatgttcatccccaagacaatggggaaaatatctccaggacatgtcagagacctttgtggcagtccctcccatcacaggccaggaggcctaaaaggaaaaaatggtttcctgggctggattcagaggccccctgctgtgtgccactttgagacttgatgccctgcatcccagccactttagccatggctaaaaggggccaaggtacagcgtggactgtggctacagagggcgcaagccccaaaccttggcagtttcacatggtgttgagtctgtgggtgcacagaagtcaagaactgaggtttgggaacctctgcctagatttcagaggatgtatggaaacacctagatgtccaggcagcattttgctgtggggtgcggggggccctcatggaaaacctctgctaggacagtgcagaagggaaatgtagggttgaagcccccacagagtccccactcgggtattgcctactggagctgtgagaagtaggccaccgtcctctggacaccagaatggtagatacaccaacagcttgaccatgcacacaggaaggccacagacaatgccagctcatgaaagcaaccaggaggggggatatgtcctgcaaagccacaggggtggagctgcccaaggccgtgggagcccacctcttgcataagtgtgacctggatgtgagacatggagtcaagggagtgcattttggcactttaagatttgactggactactgagttttggatttggggcctgtagcctctttgttttggccaatttcaaccatttggaacaggtatatttaccccctccctgtacctccattgtatctggaaagtaactgacttgcttttgactttatgggctcatagctggaagggacttgccttgtctcagataagactttggagagtggacttttgagttaatgctgaaatgagttaagatgttgggggactgttgggaaggcgtaatttgctttcaaatgtgaagacatgggatttgggaggagccagggcagaatgatatgatttggctgtgtccctacccaaatctcatcttgaattgtagttcccataattcccacatgttgtgggagggacctggcagaagacaattgaatcatgggggcagtttctcccatacttttctcgtggtagtaaataaatctcacaagatctgattgctttataaggggtttcccgttttgcttggctttcatcctgccttgctggctgtcatgtaagacctgcctttcaccttccaactgtgatcatgaggcctccccacctatgttgaactgtgagtccattaaacctctttttcctttataaataacccagtctcaggtatgtctttatcagcagcatgaaaacagactaatacaaggtcctttggaatcatctgagttcctaatttatttggatattaacttcttatcagatatatagcatgtaaatattttctcccattctttaggttgtcttttcattgtattgattgtctcctttgctgtgctgaatcttttgatttagtcccatttgtctagttttgcttttgttgtctatacttttggtgtcaaatctgaaaatttattaccaataccagtgtcaaggagcttttctcctatatttatgtctaagagttttacaatattgctcctaggttgaggtcttttatcaattttgagtcaatttttgtatgtagggtcagataagggttcagtttcattcttctgcatgtggatatccagttttcccaacaccatttattaaagagactaaacttttatcattgtgtattcttggcaccaatgctgaagatcaattgattgtaaaggcatggatttgtttctgtgctctctattcttttcccttggcctacatgtctgtttttatgccagtaccgtactattttaattactatagctttataatttagtttggaataaggtaatgtgatgcttccacttttgttttttctgctcaatgatgttttgactgtttggggtctgttgcacacagattttagaattgcttttttccatttctttgaaaaatgccactgaaattttgataggggttgcattatatctgtagatcacactgagtaatagagattcttttatcttcaaattctttcatcagtgttttatagtttttggtatatagaaattttactttctgatttaaatttattcctaagttaattttttgatgctattgtaaatgagattgtgttctttcagatggactctcgctctgtcacctaggctggagtgcagtggcgtgatctcagctcactgcaagctctgcctcccaggttcacaccattctcctgcctcagcctcccaagtacaggtggctgccaccatgcccggctaattttttgtatttttagtagagatggggtttcactgtgttagccaggatggtctcgatctcctaacctcatgatccacctgcctcagcttcccaaattgctgggattacaggcgtgagccaccgcgcacagcccgagattgttttcttaaattctttctgggatagttcactgttagtatatagaaatgcaacaggttgtttttttttttttttttaatgtcaattatgtgttctgtaaatttgctgaatttgtttcttaattttaacaagttttctttttggagcctttagaattttctctgtataagatcatgtcatcttgaaatagacacactttcacttcttttccaatttggatgccttttatttctttttcttacctaattgctctggctaagacttacagactttttcagaaaccccccagagtaatctaggggagtccactgtcactagatctgctttataagaaaccctaaagggagttcctcaaactgaaatgcaataagactaattagtatcatgaaaccatatgtagttataaaaagtcactggtaactatacagtcaaattcaaaatactcttaatactgtaatgatgcagtataatcactttaacttttaaaaggttaaaagacaaaaaatactacaaataaatataattacaaaatatacaaagaaagaaactctgacatcaaaaaacataagtggaggggagtaaagtgtagggtttttttatatgattgaagttaagttgttatcaacttaaaatagaccattataactacaatcatgcatttcttaatgcagatatgttctgaataatgcaattttgtcatggtgtgaatatcatagagtatacttacacaaaattagataatactagctaacacacacccaggctatatggtataacctattgtttccaggctacaaatctgtacagcactgtactatactgaatgctataggcaactgtaatacaatcataagcatttgtatatctaatgtatctaaacatatgaaaggtacaataaaaatgttataaccttatgggaccaccgttgtatatgtggcccatcattggccaaaacatccttgtgtggcacacgatagcatacaatgttttatgtaagcctcatgataatcacaaagacaaacatgtaacagatacacaaatgagaattttaccacatgtttaaaaaagaattaatacaaaggcacagcaaagaatcaaagtataccactacagaaaataatgaaagtaatcaaatcatgcacagcaagagagaaataaaagaacaaaaaaactacaaaatgcctatcaatagttactttaaatatcagtggaccaaattagtgaaacaaaagacacagagtggctgaatggatagtataacaagaaccaaatatatgccacctataagagactcacttcacctttagagacacacatagactgaaagagagggaacaaaaaaagacaaagagtagctattcttacaacaaacaaaatagattttaagtcaaaaactgtaacaagagacaaagaaagtcattatagaatgatacaagggtcaattcatcaagaggatataactactgcaaatatatattctcccaacattggagcacctaattatataaagcaaatattaacaaatctgaagagagaagtggacaacaataatacaataacagtaggggacttccatatcccactttcaacaatggattaatcattcagacagataatcattaaagaaacagctgacgtgaactacactatagatcaaatggaccagacatatacatgacattcctttccaaaacagcaaaatacacattcttctcgagcatacacagtacattctccaacataggtcatatattaggccagaaaacaagtcttagcaaatttgagaatattgagatctcaccaagtattctttttgactacagtggcatgaaactgaaaattaaaaacaggagaaaacttagaaaagtgacaaatatgtggaaatcaaccaacacactcctcaataaccagtagatcaaagaaaacatcaaaaaagaaataaaataacttgagacaaactaaaatgaaagcacgacatactaaaacttatgagatgaagcaaaagccattctaagagagggaagtttatacagataagtgctaaataaagaaaaaagatctcaaataaacctcaaaaaatagaaaaaaaaatcaagcccaaaattagaagaaggaaataacaaagatcatagcagaaataaatgaaatagactagaaaaacaatagaaaagatcaatgaaatgaagagctgattttttgaaaagataataaaaattgaccaacctattactaggctaagaaaaaagaaatctcaagtaaataaaattagaacaaaaaaggagatattaaaattggtaccatagaaatacaaaggataataatagtctaaacaactatgtgtcaacaaattgtttaacttagaatagagaaatttctagaaacatacatccactaagactgaaacatgaagaaatataaaataaaaacagataaataatgagtaaaaatattgagtcagtagtcaaaaagctcctgaaaaaggaaaatccaagaccagatagcttagtggagaattctaccaaaagtttgaagaagaattaataccatttcttcacaaacacttccaaaagttgaagaggagggaacacttccaaacattttttatgaggccagcattaccctgataacaaagacagaaaaggacactacaaggatgacagatatttttaaggtacaaatgatgtattgctggaattgaaaatacaggctttgttagtacaaatatttgtgtgtggatagatggatgtgtattggtgtgtgcatgcatacatatacaagcttaccttgttttattgcacttcactttattatgcttctcagatattgcagtttttacaggttgaaggtttgtagcaaccgtgcaccaagcaagtctaccagtgccacttttctggtagcatgtgcttattttgcacctctgtgttacatctttgtaattcttgtagtatttcaaatgttttgttattattatatctgttatggtgatctgttatcagtgatcattgatattactattgtcattgttttggggcatcacaagccatggtccaaaagacaatgagcttaattgatacctatgtgtattcgaatggttccatcgatctgcccttcctccatctccccctctcctcaggtctgttttctgagacacagcaatattgaaattaggccaattaataactctataaaggcctctgtgttcaagtgaaagtaagagtcacacatctcttattataaatctaaagtgagaaatgattaagctgagtgaggaaggtatgttaaaagccgagacaggccaaaaggcccaggctggtctcgaacgcctgacctcaagcaatccacctgccgcagcctcccaggtagctgagattaaaggcatgagccaccatgtccagcttctatgcattattttaaatggagtattgaagactctattactgtagaactatttctaacttcaattctgtcaatatttgggtcacaggccttaatgttattacacgctagtctgatgctcatggccaggacattttgttttcctgttggacataaacaatctcacagaatatcaacttcagaaggttaatctgagaccgtgataagtgcaaacaaaaacaagggcactttataatgttgtctaagtgcagataaaaaacaaggtcttgatgccacccagaaaatacttaataatcatattgctcctgctttctgacagcatccaatctaaagtcttcactttctgagatcctgtccgaaatcaaccaattaaagcccaaatcgtataacagtttctctctaactcctcccactgagatgacccatagtaccccattccttgctgcaatgtaattacaagtgtgctcctggtggtctttaactgaagggcactgactgggtactggtgaagttccccgcaggaactgagtcagaccccatctcagggccctgcagaagataggtgcctgctctaaggcgtggaccctcgcgacagccctggcccgtcttgacgggcgagggttactgtacttgtcccaaccgtacagatgagaaagctcagactcagggccagcaaccccggtcccagcggagcgcccggcacgcgccgacacttcagcaccagtcgcggtggccaccactgtgcgcggagatggctgcgacgcgtgcgcaggtaaagtccatccgtgccttgcctcccaccggcgccttccaccgcctctggttttgtccccgccagcggctccgactccatcgcgtcctcttccagtctagtgcttttttccagatctcgatcccaaactccctcctgccagaatctggacccgaatccacccattgcccattttccgctgccgctggagagaatctctgaggtccccaggacagcctgcctgcacggaagagatgcctcctcagtatggccgcccccggagaggagcgattaagtgcagacctccatgttgctcttgagcctgagtggcttcagggagccatgtttgttactggcgggcgccggcctcactgagcatgtgcagccctggccgggcggcctcaaagttctgacatcacagggcggttcctgaagtggacgtagttgtaagagctagttattttagacaatgcctctgggatcagggactctaatctggaaataggtagtgggagaggtcggtgatgctgtctcggggtcagagacctgagctatatggggttagagaggggccctgggcaggcgagtctctggggagtgtggtgagaatccttgtgtaagatgctgggaggaggtggggtcagggctggggtccgtgggccgatgggttgggggatggccagcgtcagggatcagtagtagagattctatgtgccctgatcgccagtagaggttttaaatacagagtattcatgagtttagcaatgttattcgcctctcataatttaaataatttgaagttttcccccagtaactagtgtcttagaagtcatgaaaatttcagaaaatgacaggtcttctgagttcgtgatgggagttgggcagcagtcgcatacgagcacctggagagtccttgccagttctttggggatggggagctcttaagactgccctgagaccgccctttgacctcattgtggtcctttctagattaaatgctgttttccatgaccgtctctgttcttcccatacgcgaatggcaggcatccagatctccaagaatagaggattaggagagactccaccacctatgtcctcacagttaattatcgatttgtgtcacttgcccattttctcacttcctgtttgtgtgtcaaggagtattaataaatctttgcctatttaaagatactagccttggattttcaaatattgcatattttgacatgtaaaaatgtgttagttttattttttcaaccgatctgacctgtatagttgggcttgaggaagcttcctcattgtacatgttactatggattttttaatattaacacagagttgtattttttccatataaatttctattgaatttctttttccatatgataggtggtgaaggtttagcccagtaaagcagagaggttaagaggttagactgggggctctggagccagacctatgtagatctgagtcctggctctggcacttgaaagccgtgtgaccttggttaagatacttagcccctctctgccaaatggagaaataagggcacctaccccgtagggtagttgtgtgagtacacaagttaatacacttcaatcactagcaagaaagtgaatgtcaagctgtatttgttcaggcagccatatggtagccccacctcattagtaaactgaggtattgaagtatcttctttttctttcagaaaatatttgtcaagcaccttctgtgttctaagaactgttctagagctttgcatgctatggaggtctagaaattcacattatggtggcaggtgacagacaatacaaagagataaagcaatttcatatagtgataacctagggaggcgtgctaaaaggagccaaggtgtagtggtgactggaaggtgaccagggaaaccactgtagggtttctaactgatgagatctgtgacaaatccctgtggtcagcagcaggcattggatatgtaactttattctgtcccattgatcttgtagtcaaccctggtctgttctgtattgttttaattacataatctttgtaataatctttaatacctggtggagtgctctgtttacttatttctgcataattaaccacccctaagcttaacttactcatggttctgcaggatgactgctctccatggttataggggtttctgcatggggcctctcacatgtgctacagtcaaacattagccggggccacagtcatctgaaactcacttacacggctgacaattgatgttggctgttgcctggagaagacatatgtggcctggtggaatggaatggtgactagattcaagaaagagcttcccaggagcaaggctaccaagagaccgaagtagaggcttcagtttctttaaaaaaaaaaaaaaaaaaatcgggccaggtgcgatggctcacgcatgtaatcccagcactttgggaggccaaggcaggcagatcacaaggtcatgagatcgagaccatcctggccaacatagtgaaacccgtctccaataaaaaaaaaaaatacaaaaattagctgggcatggtggtgtgtgacggtagtcccaactacttgggaggctgagacaggagaatctctagaacctgggaggcgggggttgcagtgagctgagattgcaccactgcactcaagactggcaatagagggagactccatctcaaaaaaaaaaaaaatccaatagtagaattcccagaatggaatttatgtcatattctatggattgagcaagttgcaaggcagccagattctaggggaagggagctattcctcacctcttgagaagcaatgtgtgttgaggaagggaaagaattgacggtagctgtctttgacttctaccatacagagcaaggtctccacactcctttctcctgtaataattttccatttgaaaattttccttgcagttctcacacctttattatttcatataaattttacaatcaatttttttcttgtctagataaccatgccatttggattaaaattgcattacattgcaacttttgagaaactatgggaggagaattggcaaccttataatattgaatttgctcattaaggaacatagtttctctgtttatttaggtgttatatttttcataatatacatgttggtatttctacccaggcttttctctttgttttgtcatgtaatgcatgaatgagactgcactgtctgtgtgattgggcagttgcccaaagtttaaggtgttaacatgcattaattcacttaatcacttctcatttcctccttccctcaacccctgacaaccatgaatctgctttctgtctctagatttgcctattctggacattttatataaatgtgtcatccaatatctggtcttttctgactggcttctttcacttagcaggattctacggtttattgaggttcattcattgtgtaggctgtatcagtacttcattcctgtttacggctgactaatgttccactgtatgtacatatgtatgtataccacactttgtatatccatttatttactggaggatatctgggttatttacagtatatttcaggagtccccaagatcatcctcccccttggtatactgctctttgtatcttatatgacctgtgcagaactatttatctggaaattaggtgatggttaactaaatatagttcttctaaagattcattttccgttggtattacatcctgaggagaccttaactcaatctcccaatacatttgatcatcaatatcactattaccacatgacttatttacatgaggtactcaaatctaaccagccatgccagtgttacccatattgcatgttgtggtagtagatgcagccccctgaaataaaagtcaaaagatgctggcacattcctgaggttcttctcagccactaacaattggtgtagttcatcatcacctggaatgaccaaaatgtctcccatggaaatgcagctcagctctgtaggcttccatttaactttgtcaggttccgaggcagggctggcttgagtggtcttgtttccactttggctttgatgaataatgctgctgtgaacattcaggtatacgtttttgtgtggtttcatttcttttaagtatatatcttggagtgtaattactggatcatatgataactctgttttaatttttgagaaactaccaaaatgttttccacaacagacaagattttacattccctcagcattgaatgaaggttcttatccagtttcctgtttttgctgagacttcttattgtttgtcttttgaatttagttatctcgttggggtgaagtggtgtatcattgtgttttgatttgcatttccctaataatgaatgttattgagcaccttctcacatgcttattggccatttttcatctttttgaagaaatgtctattcatcttttgcccatttttaaattgagttttctttttattgagttgtaagagtggttatatcatctggaacatgtgttccttatcagatataggacttataagtttttgtcccattctgtggttgtccttattttcttatgtaaccattgtattagtctgttttcatgctgctgataaacacatacctgagactggacaatttacaaaagaaggagttttattggactcacagttccatgtggctggggagaccacacaatcatggtgaaagatgaaaggcaaggaggagcaagtcacgtcttacatggatggcagcaggcaaagagagagcttgtgcagggaaactctcatttttaaaaccatcagatctcctgagactcattcactatcatgagaatagcacaagaaaggcctgcccccattattcagtcaccttccactgggtttctccgacaacacatgagaattctgggagttacaactcaagatgagatttaggtggggacacagccaaaccatgtcgactttgaaacagagaactttttaatgaaattgaactgatctattttttgttttgttgcttgagcttttggtgactgctatggtttgaaatatgttcccacaaaattcatgtttggaatgcttatattcctgttggtgggaatataaaaccatacatctggtatggaaaacagtatggtgattcctcaagaaattagaaacagaattaccctatgatccagcatttccacttctgggtggaataccaaaataattgaaagcagggtctcaaagaaatatctgtacacccgtgttcatagcagcattagacacaatagccaaaagtggaaataatctaagcattcattgagggatgaatggaaaaacaaaatctgacatatacatacatacagtggaatattattcagcttccaaaaggaagaaaattctgacatatgctataacatggatgcaccttgagtacattatgctaggtgaaataagccagtcacaaaaacaaatactgcatgattccatttaaatgaggggcctagaatatcaacttcatagacagaagttagaatggtggttgccaggggctgggaggagggggtaggggttaggttttaataaatatcatttcagttttacaagatgaagagagttttgcagatgggttgtgggcataattgtacaacattatcaatgtatttaataccactgaattgtacacttaaaatggttaagatggtaaattttatgtgtgttttaacacaataaaaactgaaaaaagggatatatgttaccctaaataaaaaattcgtatgctgaactcagaacccccagtacctaagaacatgaccttatttggaaatgagattgttgttaatgtaattagttaagatgaggtcatgctgtaatagggtgggccccctaatccagtatgatttgtgtctttataaaaaagggaaatttgtgcacagagataacacaggggatatgccatatgaagatgaaggcagaattctacaagcccaggaatgccaaagattgccagcaaaccaccagaagctaggagagaagtgtggattagattctttctcacagccctcagaaggaaccagccctgccaagaacttgatctcagacttctagtctccagaactgtgagacagtgcattttgttctgtaagtcagccacatggtttgtggcactttgttatggcagccctaggagatgaagacaatatgcaacatggtatgtccattataggacactgtgggctataaatgtgttctttggcctgaagaaataaaacttggtggtccaagttgatgtcttatcatctgttccagttcttttatggtatttttggcatttgaatctaatgactatgcaaagcccagtccagagaatgtgtcaggacccattatagcctcccagggatactggcttcagtctggtataatctacttgttagctatgagtggtgccttcccactgggaacctgccccatagccacctgcggtctctgtcttcctgctgtcagataggacagttcttgttggcatttggtgcctctgagggtggaggagggacttgttgctgagcagcccatccctgcacggctgcagctcccctgtgtccactccttcattaagcccaggtggccacctcaaggtcaccaggatatccacctaccagatctgatcactgatcctgggaggggttcttcaggtgggcattgacatgacctactttaatgtgccctttaaattcctgcagtgctgtgctccatgtggggatcctttcacagcccagtttgccattgcccctcttcctggttacatggccaggccattggccactgcccatgagtcagtaaagtaaaaaccgaaatgtagaagatcctatcattgttcaattcttccatcccaggaaggagtgcaacatgtaattcatctcactgggctgatttgttcttgcctttttcaataagaattttcccattactgctcatggtgtgcatccaggccacactgatgcaaggggtggggtcccaaggccttgggcagctctgccccatggctctgcagggtactgccccagtgactgcttccatgggctggcattgagtgcctgtggcttttccaggcacacagtgaaagctttcagtggatctaccattctctggcctgcaggacagtggccctcttctcacagctccactaggcagtgccccagtggggacattgagtggggcctccaaacccacatttcacctccagactgctttagtaaaggctctccatgagggctctgaccctatagcagacttcctcctggacatccaggcattatcatacaacctttacaatctaggtggaaactcccaagcctcaactcttgccttccttgcacctgtaagcttaaaaccacatggaagccacaaaggcttcttatggctgcaccctctgatgcagtggcctgagatgtatctggggcccttttagccacagctggagctggagcagctgggattccgggtgacatgtcccgaggctgtacacaacagtggggtcctgggcctaggccacaaaaccatttttccctcctaatctttcaggcctgtgatgggaagggctactgtgaagatctctgaaatgtcctggaggcattttccccattgtcttggctattcacattctgctcctctttacttatgcaaattcctgcagctgagttgaatgtcttaccagaaatttggtttttcttttctaccacatggtcaggctgcaaattttccaatcttttatgctctgcttcccttttaaatataagttccaatttcagatcatctctttgtgaatgcatatgagcatatgctgttagaagcagccaagttacatcttgaatgctttgctgtttagaaatttagaaatttcttctgccagatgccctaaatcatctcaagttcgaagttccacagatccctagagtaggagcacaatgccaccaatctccttgctaaaacatagcaagagtgactgcaaactccagttcccaataagttcctcacctccatctgggaccacctcagcctggatttcactgtccatatcactatatgagcatttcggtcacaaccattcagcaagtctctaggaagttccaaacttttcttcctgtcttctgtttttttgttttgttttcatttttgtttttttcagatgaagtctcactctgttatccaggctggaatgcagtggcacaatcttggctcactgcaacctctgcctcctgggttcaaatgatcctcctacctcagcttcctgagtagctgggattacaggcatgtgccatgatgcccgcctaacttttttttgtatttttagtagagacagagtttcaccatgttggcctggctggctttgaactcctgacctcaaatgatccacctgcttcacccttccaaagtgctgggattgcaggcatgagctaccatgcccagccatcatcttcgtgtattcttataagccttccaaactgttccaacctctgcctattacctaagtccaaactcgcttccacagtttcaggtatctttgtagcaatgccctacttctctggtaccaattttctgtattagtttgttctcacattgctataaagaactacttgagactgggtaatttataaagaaaaaaaggtttaattggctcatggttccacaagctgtacaggaagcatggctgaggaggcctagggaaacttacagtcatggcggaaggtgaaagggaaggaagcatatcttcatatggacagcaggagcgcaggggaagttactatacagtattaaacaaccagatctcatgagagccctatcacaagaacagcaagggggaggtccacccctatgattcaataacttcccaccagggtcctcctccaacactggaaattacaattcgacatgacatttggctggggactcagagccaaaccatatcaccaaccctataaagaaagcgaggcactgatgtcacactgctggtggatctgagacttgatctcaggccagcctgattcctaagtggcgttcttaccctattgcctcaggagcagcgagagctctatggagcctgtacattgctaaagaacaagttgaaagaattttatttccaacagtagggctgataaggaccagctgaaaacagctaaagcttctggaatacatatcaagaacctcttaaaaatgtgtcaatgagctacaaaataagagttccaaaaagctaaaaaagttttaaaatggaagtgaaacccaaagaagtaactaaggcactgatgccacttttcacccttaagatatttgcctgtcaaactaaactttgctgtttttcacagcctgaggtggaaaaggggcagcagaacagcagacaaagctgagggcctggccaagtgggaggggctaaaaggagacatcataaagtgagatccaaaaggacagacttagtgtaagggtgaactatgaataaacctgtccgcctccccctgtatgctgcccttgacccctgcttccctaggaacagtgaggaacattgggtatcctgagagaaaacatctcccctgagagttttatgtgtgtgtgtatatatatatatatatatatatatgtatgtatatagccctttaactggtttgttcacacaacctgggtggtctaaaatgtctcaagcttcaaatttaccgcaatatcagctttttggtgccttctaggtgactgacagatgcaaaatggattgtctgtggaggaactctgagatactttcaaggaatataagttcacaataaaaaatcacaaatgtaaaattggcaagagccaccagaaacaatggacagaaggagcaggcctgcaaaaacttaagacagtcaagttagcaaagacagtacaaagtgtgttttatacttaaagaaacaaaggagttgaaataacttgagcatgaaaataaacaaatacattggggaaagtaccaagtggaaacgaaatgaaaagtatcataattgaaatggaaagttcaatggattggtttaactaacggtcatcaaaaagagaataatagatgaagaaataaagaagttttcagactcgaaaaagctgaatgactttactacctgcagaactgcactataagaaaagttaagggatgtccttcaggcataaggaaaacgatactaatggcagcagtgtgccatctggagcagccactgttatcacgccagctgcagtgtggaggcacaagtggtggtggcaggagtggctgtgggagcagcagtggtcatggtgggtcccctgtgccctacatccctgaggcagctgactgcaccaccccaacccttgcacaactgggcaggacccactgcaggcccggaacctccgccgtgacttcaacctcgctgtctgctgcgtctcaggagtctgtgagctgatagtgcagccaggactcttggggtggccccaggagcattgggtttgtttgcacggggttggctgaggccaccagccacccgcaccttgcctgctgccactaaggggaaaatgcagaccagtggtatggccagggctgcatgctttatggagccagaaagttggtagagtgggagcttcccaggtgcagctgcagccacccaagctgtggctgctaccagggcactcctgtgctcttgggagccaagagtaggcaggagccctgccctcccaagtgcagctgcagccacccaagctgcagctgtggacccaggaatctctgtactcttgggggcccaggaatgcacccctgtccctgcaggctaggaagtgcctgctcccactgtctgtgttctcctcactgttagcatctgctcccgtcacagttcacaacctggggcactgtctctctctcagcactttcgcatcccagctgcatgtgtgcatgcttggagtagtgctgacatgccagccccttggccccctttggactgtggaggctgacaagcatggggaggaggctgaagtggggctgaggacagcttggcactggcctgcaggtactccttggcatggataacgtgggtgccatgaacaatgccaggaggcaaacaggctcttgggtggaagggagcaggttcccaatgaagccccacctgcaagctggggtggggatgaagcctggggggtgggccaccagtcttcagggaggagctaccctctctgctgagagctgaagagacaacaagatgacctgcctgcagagaggagctgccctctctgctgagagctcagtactcaacaggacaccctggctatggagaggagttacccactgcgggtctcctctgagctgtcttatctctcagtaaagctcctcttcatcttgttcacctttcacttgtctgcatatatcattcttcctggtcgcaggacaagacctggagacctgctgaatggcggagctaaaatagctataacacaaacagtgctgaaacatgacccttgtttgtcacattgcaagcaatgagaagagagaagagaagagctgtggctcttcatggagcccagacctaggaactctgagccagggctgtgacaccctctttagggctctgtgggttcctggcatctccaaggttctgggcaccaccacatttcctggtgtcagccgtggaagctgcttatggtatgcctggtctaactgcagccttgcatggagctggcacccgtgccagtgcctgaagctgcctgtccatcgcctatcccccctcagccggcatgcctggctgtgtgcagtggctggaccccatgcttgctcacacaccccttgctgctctgtgcctggctcacccttggcagacatgcgatccaggctcatagtgggaactgagcacagcctgccaggctgagtgggtggaacaagaccagagattcagagcaaaactcgggcaaaggcgccactggccatagaggcttttggctgatgaagtgataccccaaggatcccgtaacaataccagatggaaatctggatccacacaaagaaatggtctacaccagaaatagtaacatcgtgtatctataccagaaatagtaacaacatggatatatactttatattatttaaacttctctaaaagataattgtttagaaaataaagtaatatgcagtttataatatatgtaaaagtaaaatggatgacaataagagcttaaagactaaaaggggagaagtttactattctcagattcttaaactgtacctgatgtgatctactgtcacctgaaggtcggccgtgatccgttaaagatgtacactgtaaaccctggagccacgactaagataacaaaccaaaagattatagctattaaactaacaaaggagatcaaatggaatcataaaaatatattgggtaaatccaaaagaagacagaaaaagacgtaaaagagaataaaggacagatgggatgagtagaaaacaatagcaagataagagactcaaccatattaggaattacattacatttaaattgatttagaagacaggttgtcagattggattttttttaaagttggttgtattttgcttgcaagaaatgtactttatttatttacttatttttggagatggagttttgttcttgttgcccaggctggagtgcaatggagtggaacagcgtgatctcactgcaacctctgcctcccaggttcaagcgattctcctgcctcagcctcccaaatagctaggaatacaggcccctgccaccacacccagataatttttgcatttttagtagagacagagtttcaccatcttggccaggctggtctcaaactcctgaaatcaggtgatccacctgccttggcctcccaaagtgctgggattacaggtgtgagctacaacacctggccaagaaatgtagtttaaatataaagatgcaaataggttagatgtaaaaggatggaaaaagatataccatgccaagactagtcaaaagaaagctgaggtggctatacgaatgccaaaatagacttcagagcaaagactattaccagggaataaagagattatttcttactgataatgtggttagttaacgaagaagacataacaaacctatgtgtttttgtacctaacaacaaagcttcaaaacgtatgaagaaaagtaataaaacaatacgtagagatagagataaccatcagagattttaatcccactctcaacacttcatagaataaataggcaataaatcagcaagaatgtattagacttgaacaacaccatcaactaacctgacctgatttatatttatagaatactccaccctataaaagcaaaatacacattttgtcaactgtgcacggaatatttatggagatagaccacattatagaccattaaaaacctcaataaattaaaaagtattcaactacaaaatatgttctcaggtcacaatggaataaaattaaaaaccagtaacagaaagatcctttaaaaattggaaattaactcacttctaaataactcataggtcaaagaagaaatctaaaggaatattagaaagttatttgaagttactggaaatagaaaaacaacatagaatttgtcggttgtcactgaagaagtacctgaagggaaatttatgatattactatattagaaaagaagaagggtctcatatcagcaatctcagtttctaatttaagaatatcgcccaggcgcagtggctcacgcctgtaatcctaacacttggggaagatcgaggtggacaggcacctgaggttgggagttcgagaccagcctaccgaacatggtgaaactccgtctctactaaaaatacaaaaattagttgggtatggtggctggcacctgtaatcccagctacttgggaggctgaggcaggagagtcacttgaacccaggaggtggcggttgcagtgagccgagattgtgccactgcactccagcctgggcaacagagcaagactctgtctcaaaatatatatgaggaagagcaaattaaatctaaagtaaccagcagaaaaggaataataaagatcaaaatgggaatcagtgaaataaaaaaaaaggaaaaaaaatcaatgaatccaaaaacgtgttctttgggaaaaatcaatgaaaacgacaaatctccagctggattgattgggaaaaaagagaaaattatgaatataaaaaggggatgactgacatcactaaagacctggcagaggtagtgctcatcaggattctccactgcagtttctcttttccccctcttccataccgtcctctttggagaataagtcactgtgtgcagcccacacttaaggagtgggtagttattctcgccctcctttgggatggaatatataacataattcatttgaaatcctgcatgtgaatttatctcctttccctcattcattaacttatttaatcatttatttatatcagtatgcactcaagaatatttattttatctaatactgctctattttgttgccctttacacacatggaatcttccgtattgccacaggtgccatcagatctccagcatttgcacatactgtttcctctctgggattcccacatgccaggcattaggtcaagctccacgggactccctgagatggatcagacatagatcccaccatgaatacctcacagtccggctgggaagatgagacagggacctaactatctacagaacagagtcaccagcttataggtacaaaggaagggcatggacagcacaggacacacctgcctactgccagaggtgtcaggggcagcttctgaagttggtgggtctcatggggctcagtgcagaggtgtgaccacagaaaacagaaaggaggcattccatgcagaaggaagctagagtgacaggagcacacagtacagaggtagggagcatggtaggggactaaagactcggaccagccccccattggtacattttgtgctaggtgtccacactcaaacatcctgcagctcagctccaacgactgaaaattctgctaatgagaatttctcttctgcgagctttaggccttggctggttggaccagtggctgcctcttatgtcccccaccagtcgaagctcagttccacaggaagagctttgtgttttgctctaagtagcaaggaatccactggtggggagtccaacagggagtgagtgaaggacttacattccatgggaggcctctggctgtgggcacagaaggggctctgggctaaagaaggaagctgggaacccctcaagtagcagaaggacattggggtcatccctgagagaggagacctagtgagaatgaagtgatggccgggtaaggtggggtgggaaggggagggacaggagcagatagggagaggagggagtaataggggaagggagatgaagagaagggcaaggaggggagggagtagataagggacaaggagggaggaagagggaggagaggaagatgaggaagggggagggtgaagatagggaaggggatggcccagaggtattcatttgaaagcagccccagcaggactgattgtagcagtggctgtccagtgagagagaaaggaaagaatcaagaacaaattctagatttttgacttgagaaactgggagaagatggggacttttcccaactcagtgcttttcactgagagaagaaaaggaagagccatatttgagtgtgaaaacaagagtcgcctttgagatctattaagtttaatatgcttcattaggaagctccctcatttcccccgtagcatcaacattctttctaaaacatttggaaagcattatgatttttattgtagagtccccccaccccagcgattttctctacttttttcctattcattggtcatggaagttgcttccaattttcaactattgtgaataatgggttctttaaagcatagaacagagctggtttgcaacgaacattctgtacacaggtctttgtcagtatctctgaatattatattcctaaaaattcccagaggtacaatttgtaggtcaaaggctgtaaatattttacagcttcttaatacatattgccaaatgatgctgcaaaaaatggcaccatgtacatttttcaagagaagcatcaaaggatctcactggtcctcgccacctggactattgtaatggtcctgaattattgctaattagatgtgcagaaaatactattttatgttcatatctggataaagtacccatgagggttttgactaatgtatagaggagaagaatcctttttgaggatttagatgtgattttactgagttgcagatgtcttcttccccacagtaccttgggggactgaatacaggtgtggaggccacccagcttgtatctgtgtttactgtccttctctgattggaagcctccccgtcttattccattagactttgctactgttctcccacttagctgacctgtcacctcttgcctgagagtctcagggttagtaatggatttcatgactgtacactttagtaatgaagaactccattatcactggaaggggagtgatccttctgtggtgtctgagccaagacaggacaacatggaagcccagcacgtcaaggtccaggagcgtgttcagtggctgggcctgggggcaggaggaagagaagagacagatgcattggacagcccccccacatcctgcccccaccatgattactcatccttctttgtagttacattacttcattgtattacctggaaataacctgtctccttggttgatggtctattctttgagagacagctttagaggccggcagacctaaattctaatccttctgcctgatgttgggcaagtcatttgtggctttggagcctcagttcctaatccgaagtgaatctcacagtggccacctcccagggatgctgtgctagatgaactgcctgagttgggtagctgggccaggctctaggtcactgtgagatgctgcagctgtggctgtaccctgttagtgctgggtctggaatcccagcctccaacacagctgtgattaaagaatgcctggaaggagcaatgcacgaggaaggagaaggatgagaatttcgaggttagcatcagatgactggggacttggctttcctctggctacttcccagctacttggggttctgacacctctggccggccacacaagcaccctgaacattcaccatctcccggaactcagtagcctgatggcccaggatgactgagtgccggcagatctggcaggaacagcttgtgaatggcatgggtggccagggtctctgcctgataaagagaatgttcttccctcaggaaagcggcccaggtgtcctggagcaaaggactatactggaataggttggtgcctgcagcctagagcttggacagtttcagcagccaaatgaaccctggggttcccagtatttgggaagaggttaaggtatgtgggaagaggccaaaaacataaggaacctccccgtggcgtcagggtcctgctccacacagacagaatctgagacgccctccccggggcacctggttcttctccagtcctttgtcacctcccaagcgggtctcagaaaaggcaggtctgaggatgcggacggacgcaggacctagcccaggctggtggagccccctccacgtcctctgagtacagctgccggtcgccacctctgaggcagaacttgaggaaaatggggtcaaatggaaggtactggtatggggacacacgcggggaggcctccaaacaccctttcaagatggttcgtgttgaccccgataggtctcgtgttggaggggcaggcactgggggttgctggtcgacccgcatgttgccccaccacagagcatccagggctaagagcctcctccgagcttaagctgcaggtccaagcttccacgaacagatggggagcgaatgctttgccagcgggcggaacaatcctgctaacgctagggacatcctggaactcgacccggtgcacagtggccacttctctctcgcgggagctccagagaacaagtgcaataggtaacatcgaccgccaggtggagcccgacaaccggagcaaagggctgcagtccatgtcggatcgcatttctcagacctgggtgggtggagcgcgtctggctcctcttggagctccaggtcaccacgacgcatccccagcagcataagggaaggctgactgctgggaagaatacagactctccctacgtgactcccagtctggcccgtggaaaagctaaccgcgagcctgcgggccgggcgccctgccaggccgggctttccagagccgcgcaagcggacttagaaaataccgcgccctcaggtatgggatgaaaaactgcaaccatgaaagctttgttgaaaacactttaattctaaaatttctgaacagagaagatctttaaagcatagaacagagcccgtcacggttgttcacgcctgtaatcctagcgacttgggaggctgaggcgagaggatcgcttgaggctagcagtttgagaccagcctgggcaacataaatagaccgctgtctcttaaaataaaaataaaaaggcatgtatacaacaaagacaactcgaaagccatcaaggacacgattgattaacttgatagcataaagtttaaagaaaatttatctgtgcacgtaccaggacaaagtcaaatgacaacaaatgggtgtggggaacatcggtgcaaatacatgtatgatgttaagaatactgatttcaccattacttgtaataacaaaaaataaagaaaacatagccattcagaggagccaggtttaaaaaattctggtacatctatacaataccgttaatttacgttttggtttatttcttcagggcggtagacttacatgtagtaacatggaaaaatgtccatgatgaaatagtaaatgaaaatagcaaattcatgagaatgcaaattagaatcatagtgtgataccatgaatgccttagacaaaatagtcttcaaaagtgaaggagaaataaatacttttttttttctttctgagatggagactcactctgtcacccaggctggggtgcagagtgcaatggcgtgatcttggctcactgcaacctccgcctcccaggttcaagtgattcttctgcctcagcctcccgagtagctgggattacaggcacacaccaccacgcccagctaatttttgtatttttagtagaggtgggttttcaccatgttggccaggccggtcttgaactgctgacctcaagtgatccacctgccttggcctcccaaagtgctgggattacagctgtgagctaccgtgcctggcagagacttttgtagaaaacaaaaattgaggcaatttgttgctggtagacctgcatgcaagaaatgttggaataagttaaaagaagttcttaagagaaaagtaagacatttggatctacataaaggaagaatataaaaaatgaatatatgaatgtgaagtaaaaactttgcattttcttattttcaactgatatagcagctaataaataatttgttcaaaataatgatagcaatagttattagatgtttataatttattgataagtgaaacgaataatagcaatgatataaactataggagggaagagttagaaatattttgttattataaaatacttgcactactcataaagcaatacagtattacttgaaagtagacttgtactaatggtaaatgtacattgcaaaatctagggcaaccaatagaaaggttttttaacagtaaaaagaaaggaagaatttacatgcttaaacgggagagaaaatggaaccatataaaatgctcaattaaaaccacaaaaggcaggaaaagagtggaaggcaaaaataggaagaaaaaagcaggacaacaaatagagaataataacagacatgataaataccaacctaactgcatctgtaatcatctttaatgtcaatggtctacatacaccaattaaagaatgagttcatctgagttgatcccccacaaaaaagacccaactatacattgtttacaagaaactcactttaaatgcaaagacatatagatttgaagtaggaaatggaaaaagatatacaaggttaacaataattaaaataaagctgaaacagctatattagttttcagacagagtagacttcagagagaaaagataattctggatgaatataggcactgcttgataacgaaaagtgaattatctgagaaaatataacaattcttaatgtgtgtgcacctaacaagagtgttaaaatacgtgaggcaaaaaactgatagaactgcaaggataaataaaagaattcacaatcatagttgtaaacatcaacaccctctatcagaaatggagagatccaatagatagaaaatcaataaaatatggtagaactaaacagcatcatcaaagaactggaaataattaacatctatagtctacttagtgtaatgacagcagaatacatattcttttcactctcacatggagcattcaccaagataggccacattctgggccataaagcccaccttaacacatttcaaagtataaaaaccatgctatacctgctctccgaaaacactggaacctattatacaaaccagtaatagaatgatagctgggcaatctcaaaatacttggatattcagaaatatacatctaaataacataagggtcaagaagaaatctcaacagaaattaaaataattctttgaactacatgaaaacaaaagtaccactaatggctccaagagtttctcacttcccctatgggaatgtctgtatttcctacagagatcagtcaaagctgcacagggagcctccaggaagggtctctgacatggctacagttttgcgtggggcacagttgcatacagcactcccgaaaacgtttctctttcccaattagctagctgagacattccctaactagtcatggaggccaggaagggcatcccttccacctggtggactgagtggggattggtcataggaggcaccctgcaaaattgtatctaaacccctctctggaggccaggacaaatctgaatggaccatggaactggggagagcctggatgggagccagtggtcaggaaggccttgggggctgctcagatggggccaggtatgaaggcctgagaagggtaccttgttgcatgggtctggttggcccaatgagtctccagaaagtttcttaagacccgtggttggggggaggactgcatctggctataaagtgaaggccccagggatggttttggtgccctactttccactccagtccaaagcagtgcctgtcatcagaggcaccagaaaatatgttctaagtactccctgtttgtgggcaccaggtaaggatgcccagtaaggcctgggaagggcttgtgaatccagtcacagttcttcctggccttgtcgatggcatgcaaattctttgaatgtttgcaagtccctctctggaggagcagcaaaggcctgagtggctgaggaggcctattatttttgtttatattattttatatgaaattattacttatgttatttttgttattataaaaagatgtaaagtgtgacatcaaaaacatcaaacatgggagaaaaggaagttagagtgaaaagtttgtgtatgcaatcaaaattaactgttatcagcttaaattaacctgttataacatgttttatgtaagccacagggtagtcgtaaagcaaaagcctgtaatggatacacaaaagataaaaggaaaagaaccaaaacatactactacagagagccatgaagccacaaaagaagaaagctaaagaggaaaaaaggaccaaaggctctacaaagcaactagaaaacactttaacaatggcaagagtaagttcatacgtgtcaataataacctagaatgtaaatggattaaattctgcagttaaaagatacatagtggctaaatgaggtatttttttaaagacccagctgtatgctgcctacaaaagactcacctcacccgtaaggacacatgaagatattccatgcaaatggaaagcaaaagaaagcaggagtagttgtagttttatcagataaaatagacttcacattagaaatcctaaaaagagacaaaggaggttattatataatgataaaagcatcaattcagcaagaaggtataacaattatgagtatatacccacccaacaccagagcaaatattagatctaaagggagagacagactgcatttcaataataggagacttcaacaccctactttcagcactgaacagatcatccaaagagaaaatcagcaaaggaacattggacttaaactacactctagagcaaataaacctaacttttacagaaaatgtcattcaaaagctggagaatgtgtatatattcttctcatgagcacatggagcattcttcagcatagaccatacgttaggccacaaaacaagtctcaacacatttttaaaaattaaaatcagatcaagtatcttttttgaccacaatggaataaaactagaaatcagtaacaagaggaactttggaaaatgcaccaatacaacatgctcctgaacaaccaatgggcaaataacgaaattaaaaataaaatttaagaatttcttaaaacaaataaaaatagaaacacaacataccaaaatttacgttatatgtcaaaagcagtagcagtactaagaggggtagtttatagaaataaatgcctatataaaaaggtagaaagatttcaaatataatgatgcacctcatgaaactagaaaagcaagaataaatcaagcccaaaattacaggaagaagaaatactaaagatcacaacaaaaataaataaaattgagactaaaaatatgaaagatcaactaaatgaaaatattgttttgaaaaggtagacaaaatcaacaaatctttaggtagactaatgaaaagaaaaactcaatggaatagaatcagagataaaaaggagacattataactgataaaacagaaatacaaaagatcattacagaccattatgaacaacttacatcaacaaattgaaaacttataaaatagatatattcttggacacatataacctaccaagattgaaccatgaagaaacaggaaacctgaatagaacaataatgaataatgtaattgaatcagtaataaaaagtctaacaaagaaaagtctaggaccatatggctttacagatgaatcctacctaatttttaaagataagctaatgccaattattctcaaactattttgaaaaatcaaaggggagagaatgcttccaaatcttttttaaggccagcattaccctgataccaaaaccagacaaggacacaacaaaagaaaactataggccaatatttttaatgagcataaatgcaaaactctttaaaaaaaaaaccctagaaaacaaaatccaacagcacagaaaaaagattatacaccatgatcaggtggtattttcccccagggatgcaaggatgcttcaacctacaaatatcaataaatgtgatacatcacatacatcacatcaagagaaaaaagaacaaaaccttgtgattatctcaatagacacagaagtagtgtttgataaaattcaactcctctttgtgattaaaaaaaaccctctcaacaaattaggtatagaaggaacataccttaaaacattaatgttagtatatgataaacccacagttaacatcgtactgaatagggaaaagttgaaagccttttctctaacatagaacaagacaaagatattcactttccctaagatccttcctctaagatctagaacaagacaaggatatttactttcaccacttttattgaaaagtggtcaatcacatcgttttcttttattgaaaagtggtgaaagagtcctacacagagctattaaaaaagaaataaagggcattggaaaagaggaagtcaaattgtcactgtttgcaaatgacatgatcttatatttaggataagctataaagacttcaccaaaaagctgttacaactggttaactatttcagcaaagtggcagaatacaaaatcaacatacaaaaaccagtagcgtttctatatgccaatagtgaacaatctgaaaatcaaggaagcaatcccattcaccttagctacacaaatataaaatgcctaggaataaatttaaccaaagaggtaaaagatctgtacaataaaaactttaaaacactgataaaagaaattgaagaggacacaaaaaataaaaaaactcatattcatgaattagaaaaattaatattgttaaaatgtccatgctacccaatgttaactatagactcaagacaattcctatcaagtggcattcttcacagatatagaaaaagcaagcctaaaattcatgtgaaatcacaaaaaagcctgaatatacaaagcaaccctgaacaaaaagaacaaagctggagacatcacactatctgacttcaaaatatactacaaagctgcagtgataaaaaataaaaagcatgtttatggcataaaaacagacatatacaccaaaggaatgaaatagagaacacagaaacaaatccatgtatttatagccaactgattttcatcaaaggccctaagaacatacactggggaaagaacagtatctttaataaatggtgctgggaaaactgagtaaccatatgcagaagagtggaacttgaccctgatctctcaccatatacaaaaatcaactcaaaatggattacagagttaaatgtaagcctcaaaactgtgaacctactagaacaaaacttaggtaaaatccttcaggacattggtccgagcaaagatttattgagtaagacctcaaaagcacaggaaaccacagcaaaaattgacaaatgggattacatcgagtgaaaaagcttctgcacaggaaaggaaaaaatcaacaacgtgaagagacaacctacagaatgggagaaaatatttgcaaagtattcatctgataagggattaataatcagaatacaccatgatgctcaaacaactcaatagcaaaaaaaaaaaaaacaacaacaacaacaaataacctgattttgaaatggataaaagatctgaatagacatatttctcaaaagaagaaaatcaaatggccaatacataaatgaaaaaatgctcaacatgattgatgatcacagaaatgcaaatcaaaatcacaatgagatatccttgcaccccagttaaagtggctattatcaaaaagacagaaaatgacaaatgataaggaggatgtggagaaagggaaatgctcatacactgctggtaggaatgtaaattcgtacagctactggaaatctccacactggaaaacagtgtggagatttgtcaataaaactaaccatagacctaccatatgatccagcaatcccactagttggtatatggccaaaagataagaactcagtgtatcagagagatatcttcattcccatgtttattgcagcagcactattcacaatagccaaaatatggaatcaacctaagtatccatcagtgaatgaatgggtaaaggaaatgtggtatatatacacaatggaatattattcagccagaagaaagaatgaaattttgtcatttgtagcaacatagatggaattggaggacattaagttgagtgaaataagccaggtacagaaagacaaatatcatgctcttactcatatgtgtgggctaaaaaaatgggaggtagtgaacagaatggtgtttagcaaaaactgggaagggtagtgggaggagggcatgaaaaggggttggttaatggatataaaaatacagttagatagatagaaggagtaagatctagtgtttagtaccacaatagggcaactatagttaacagtaatttattttgtatttcacaactttctcaacacaaggaaacaataaatgtttgaggtaatgaatatcccagttacccatatctgatcattacacactgtatgcttgtatcaaaatatcacaggtactctataaatatgtacaactattatgttttcataaaaattaaaaataaaaactaaactattaattgttctactttgtggacataaaatatctttccatttatttgtgttttcttccattttctttcatcagtgttttatagttttcagtatacagttctttcacctccttggttaaatttacacctaagtattttataagttttttgttgctattgtaattggattgcattcttttttttttctgcctcccaggttcaagcgattctcctgcttcaggctcccgagtagctgggattacaggcacccgccatcatgcccggctaattttttttgtattttttagtagagacagggtttcaccatgttggtcaggctggtcactctaactcctgacctcaggtgatctgcccacctaggcctcccaaagtgctgggattacaggcgtgagccgctgcgtccagccgggattgtattcttaatttccattttgaataactcactatcagtttatagaaatggtaaatcaccctttgtggataaagcatgggtactcagcaattaggagtaaacccttcagctaatgtctaagttgctttcattgttactttatctgtttgatttcttgtctaaagtttgataatggcaactaacccatttttaagagaaattaaaatggataacatgcatgtgatattctgtgaaaattgcatgacttcttttaattaatttaaggaaactatagatgtgtagttagggctttaaaccaaactggtacaatttattttctgctaaattacaaagttatttgattgaattgacaagtaatattgctttgttttatttttaattcgttactgtgcaaattcacatttggagaatgtaagattatatacaaaaccttgaaccacctttaaataactatatttttatttattaagccacaaacagtttagttatgttgttatgagcaaatatatttactattttttctctgcaataggaatagagatttcttttgctcttctatctcaactgaaaaggatatattttctggatcactgccattggctccttctatagtatttaaaaaatatatgcatatcatagtgttaggcttctataaatacactactaacttctcttcactataaatgaacttgagcaactctcatatctacaatttctagcaccaggaaagtgacattttcctttgagatggggaataggccttttgaggtcatggtggagtcatatactcccttttatgacaattattagcaccacgtgagggcagagaggaatgtaaaaaaagtatcatttcaagttaataagctacaacctgccaccactgatggcatgtccacttacagctcacgagccagctcttcatcaataagtgctgctttgcagtggtttgtaattgaattgtatgatgtaaatgtggagacagccaatcatgatgttacaggatctttggggtgtcgattttcttgcccagaaacctctgtggacagtggcatctttgcctgagttcttgtcctgcatccaggaagaatgaggtatgcaaaggaagggcgaagaagattaagaggagttttatttagtgttagaacagctcagagaagacccacagtgggtagctcctctctgcaggcaggtcgtccggtggagtgttcagctttcagcagagaggaggccctggcgagcctggctgctctccgcaggctggtcatttggaggtctctgcaggtctctgaagctctcagtagaggggagagttcgtctctgcagctggtcatcccatcgtctctctgtcctctgccctctctggtagagcccagggcttttatggacctcagaggggaggaagtacctgccaattggtccatgagcagccattggcggcccagaggagggacagatccccagtcctgtccacaggattggcagtctggctcccagccttcaggccctccctggcttgaaggtggggctttactggggacccatccgcttctgcccaggactctccctccccctgccattcaaggccccagggctcgaccaaccctgttgggagattaaagctggtgacagaagaggagagaggccaggcagtgagagcagacatcccagagccagttgggggtggcaggtgcaggctgccaagatgccagggtcctgcgcctgagacggtggcctcagttgcacccagggagctcccacccagccaactcagaaggggcggggcttctgcttgtcccggtctcctgcctgctccatggagccggaagcccaggtctgcagcagtgggttgggtggctgcagctgcacccaggagggcagatcctgtcggttcccagccccctccaagagcacagggaagcttggatccacagctgcagtttggggtgggctacagcctgctccgtagagcaggaggcctgggtctgcagccgcaccagggaactcaccccaactcagaaggggtggggctcccaccagcttcatggagtatgcagacccagccatacctccctgctgtagcctgcatgatggcagcagctgctgccatcaatgagagaaaaaaagacaaaatttaccaatatcagtaatgagagaggtgatctcactacatacattacatatattaaaaggcataataagagattacaatgcaaagctgtatgccagtatgtttgacagcttagaagaaaagacaaattccttgaaagatgtaaactactaacactgactcaagaagaaatagatgacatgaatagtctattaattagattgagtttatagttaaaaaccttcccacaaaaaaaattccaggcccagatggcttcgctggagttttctagcaaacatttaaggaagaaataacaaataaacataaactcattcagaagattgaagaggagagaatacttttgaactcattctataagtccagcattattctgacaccacattcagacagacatttttttttttcttttttgagatggagtctcgctctgtcacccaggctggagtgcagtgatgcaatcttggctcactgcaagctccgcctcccgggttcaagtgattctcctgcctcagcctcccgagtaggtgggattacaggtgcccaccagcattcccggctaattttttgtatttttagtagagacagggtttcatcatgttggccaggctggtcttgacctcctgacctcgtgatccacccacgttgacctcccaaagtgctgggattatgggcgtgagccaccatgcccagcctagacagacattttaaaaaaataaaaatacagtccttcatgaccacagatgcaaaaaaacttaacaaagtttcaaaaaattgacttataccagtaattcaagtttagtttaccataataaaatcaaccaaagcaatttggcataaagacaaacattctgcaaaacaatttggcagtttcttaaatgttaaacagatacctaccatatgacatagctattcttgtctaggtatttacccaagagaaatgaaaggatattttcatatgaccatctgtgcataaatggtcatagtagcttatttataacggatgaaaactggacacaattcaaatgcccatcttcaaatgaatgaacacacaaactgagctatattcacacaacgagatactactcagcaataaaaaggaatgaactattgatacatatcacacattaatgaatttcaaaataattctgttgaaagaaaaagccagataaagaaaagtaaatactatgtggttccatttatatgacattctggaaaatagaaactaatcatgagagagatcagatctgtggttgccagggatttgggggaagcagggaggttatgggggaggggttatcaagagggaggagaatattttgctggggtgatggatatattccttattttaattgtgatgatagtttcatggttgtatacataagtaaaaatttaacaagtcctgcactttaagcatgtgtattcattatatgccaataaagcctcaatatggctgttaaacaaaaattaactaccgaactactaaatatgtgtatcaccctaggaaatgaaagacatctcttcaactgcttttgtgtcttgacttttttcccaaaggaagacctatattttgcttcatttctttctactctacatttctttttactctgcttgcatttagtttaaaaaaaaagctctctgttggtgatttctaatctgttttaaggtaaataattgtactgtccaattagagactgagataactcatgaattatcacacaggttgttctcctgtacaatatatatgattttgagtactaatattacacagtgaattcagaattgtgtgtttgtatatacataccatagtcttataaataacttcaacttgcaataattaacttgcagttaattcttacagtagcatgagtttgggcctcttaaaaaaagaactaaaaccaactccctgcctgagaatagaaacaacacacacacacacacatacacacacacacacacacacacacagaccaaattgaataatcttgttttctcacttacagttgtgggcattcatttatggagttcttggcagctatgttagcataaaaccccacctataattatcattcatattaggataatatctcacaaatgtggtcagtattgtcttctgcaacattacagttagttggtggaataagttctagtgttgtacagcactatagggtaaccacagtaaacaacagtgtgttgtcttttttttcagatagctgggagagaggatttttcatgttaccaacacaaagaaatgataaaggtttgaggtgatggacatgctaattaccctgatttggtcattatacattgtatacatatactgaaatatcccactgtaccccataaatatgtacaattattatgtgtcaagtaaaatatgaatatatatagtaaataaataaatgaagtaatttgccattacttaacatttcattaaatgtatgtttccaaaattatatttgttcttgagaccttttgagtgatcacagtttctgctattctccataaggcctcagtttgacccagtgatgaaatcttgaataaaacacagaggaatgtgtttgtatttgtaatgcttcccttgcaggtgaaatggccaccagacccaggctttctggaatgcattcattttctgcagttgaagggacgatcccggatctgaaagaaagagccacagtgactccaagagtggagccagggcatgctggacactgcatagctatggccacgtgtgtcacctccgagggagatgtgagagaaacacagagggatcgcttgtgactgtgccttctcgatgtatgatggactgttctgctcaaatagtaagtgtgaacaaggagccggtgaacataggaaacaaagaatatttcatttgacattataaggaatgagacaattctagtcacttgaaagtgaactatatctgtcgagaattcctagttttaattgcgaagaaatgtgcttctctttttgaaaagccacaggttattgcttttatatctaatatcagtcctctctggatctctcaaaggattttgtgtatatcctaccattttccttctgttgctgcagtttggaagtagtttgttatcaggattatcaaagcatcattgctatttatgacaatgactaagaaatgcaagaatatttggaacactgtagaaaaaatattttagcctggaaggcaaatactaatttcaggaactattgatctgttataaaacaggaccactcagacatttagctctaggactttggcatatctgttgttggaggcgtatagtggggggcatgactcagcttctgcttaagtacaagttgtctgcagcgaaggaagaatttgattgtagtatcaacagaaccagacagaactctttgaatataattatatatcttggaaactgactcatcaaagctattagattacatagcatcatttaagcatcgttgggctctgtacttttcattatctgtacttttcattatggagtataataggctttatttggtacagaaattgggtctaagatggaaacaacttgtgatttttgaataaacttttggggattagttactttgatgttgtcaagatagcagcatagtaagtcctctgcctttccttttgatttatttataatttagaatcagtttatgattttaaaaaatgtgacagacacagtggcatgcaccagtagtaccagccacatgggaaactgaggcagaaggatcacttgatcccagaagatagagaccaccctgggcaacatagtgagagccccatctcaaaaaaaaaaaaatcaattcccaataccattccagaacacttttaatataaccagatgaaattgtgatcacttctttactgtaacgtttaaaatggtcctcagtccatatttaagtacaatcttagtgtttctgtgcaacctaatatattagaaagaaaaactgtattgcatttgaataggaaataactctgaattgcgggttatttcgtttaacagttgcaattagattggttagtgacaattatctgtaattttcaggcaatgcctaggcaagtgcccaagacacagtagcctcctccttgcctccgtatgtgtgtgtgtgtgtgtgtgtgtgtgtgtgtgtgtatgtgtgtgtggagggtggtaacatttctgggaatttgtcttaacataaaatgataccacctttcacaaaacgacctagaggaagttggaaatctcactatcctggcttcctgctgagcaatatctgcttctctttctgactcaggctgatgcatctgtatacttagcttcacttctccagtaaataagggagagctttattataaaagacaacttctattgattttcaagggggtgggtggttgtcaagctcactcctttctatgcactgagggaaaattattgtaagcgatctgtaaaacaatagatgaaaaaagaggagataaaaattaaataaaatttaaataaaaactaggatcctaagtgggaaaatagctttaaattagaaattgataccaaaaaataatgatatgtaatctaagatgaaaatattttgaagactatcagcatatctcccttaaatgttatttagttctgaaaaatatgtattgaagaactgttatattttactttatgtcttatattaaatgtgctaaaattaaaaagaaacaagtagataaaagtaaagattgtattattattttatcacccaggttatttcaagactggagacattctttaaataaacctaaattatgactccttgcacttaagttttgctaacataaaaagtatgtatgatttcggagatttctgcatattttggaatgagctcttcagttgcttgtaatttccaagaagattacccattttaccccttaactaaaacccctgttcccttacttccttgctgcttcacttcatggggatatgtcactgaccagaggaacgatcacattgaatttctgagccacactgttttgtatggctagaataagatgctcaaagtatgatttcacaaatcacatggttattgccatgcaaggagaatttgttttcttaagttcacaatgctcgaaaaggagaagaataatgtgaacaaatctacagggaatacactcaaaagatgaggcacattaaccacagagggagtgagttccaaatattaaagtctagttcctgaagtagaaatggaagcagacctctgtggaaaggcaaatcgaatgaaagtttgaggtgcacctttttttcaagcgaattctctggagagatggtgtctgacaccatggagatcctcaaagacacctagggtcccttgacaccaagtgggtggtgccagtgatgcaggcgaggcttcatagctcagcggctgacagggtggggcgctgttgctgcatgagttcagccttccaagaagtgactggcagggcagccctgtcacagaatatgctctccatttttggagaagtggctgagacttactgaagttctcaaagtgttcaacgaactcttatgtttatatgtattttgaaatccagtggttgaggtcagtaactcacatatgatgggtctgatgagctctgacattgcattctttccccgccacgccccccccaccccccgccccagacggtttcttgctctgtcacccaggctggagtgcagtggtgtgatctcagctcactgcaacctctgcctcctgggttcaagtgattctgctgcctcagcctcctgagtagctgggattacaggcgcacgccaccacacccggctaattttgtattttcagtagagacggggtctaccatgttggccaggatggtctcaaactgcctgctctcaaactcctgacctcatgatcctccgtcctcggccacccaaagtgctgggattacaggcagaagccaccgcgcccggcagacactgcattcttgaggggtggagagagtacagtctaagttcttgttacagcaaaacatagcaaactatgtaagcctttggaataattccaaaactacataacagacatgagctccaagcttactgatttatctgtgtgccttctctgaggaatatcttttggttatccttgtgcaacatggcaaatatttttcaaagtgaatgagagttaatgagaaaattaaattataaaaatattatggcaatgaggtggatcatggcagtgttcaagctacacataaaaaaatgacatgccctccaactttcattctcttatttttcagtaatattcaaaatatttattgcaaaagttaccatttcaatgatgaaattaagatgcctttcagttcaagtttggcagttttacatatttgatgtgaaactctgattcgaaatgttgctgggggtctttagtattgcatatgaataataaaaatcaaatttgctatttatattgaaataagatatacagtattttatatggcaaatgtttctcttccttttaagagaagaagagaaatattaaggtggttattactcaagtgaatcctacttaaaagtaactttctaatagttgagaagtcacttatgcatacctacatgaggaagaaagttgaattgactgtcattcattcagcccagtgggacatcaaactctccaaacctttcacagtaggaaaacaaagccaggcctccttaactatgctacatggcaagtcaaaacatgaacataatatctgaaaaagcctgaaaaacatctctggctaactagatctcattgcaggcagtgagagagtggtggcaaatgtgaacatgtctgtgtggggtggtggcaggggaattggaatgtacgaatccaaggaaaactgactcttggcaaattacttgttttggtgctcctcttcattttttttattatggtagaagactttgtatacaaatttctcactgtacataaaacaagttcttcagttattgcatttctgcaatatattaaaatacatgagaaaatcacattaaaaagaggcatgattatagaaacaaaatgttattacaatacgatatcaacttataattcataattatatttgtaaatatcaaattataagtaatttatgagaaattagagccaaagcttttcatacttactttagtgtttttctaaaggaaatacatggtgaaagaactgtagagaagacatagcttatgattaatccatttgtcttgatacttaacacagtattggtggtgcattggttccaggactccctggggataccaaaacccatggatgcttgagttccttatgtaaatgatgaagtatttgcatgtaacccacacttacactctctctttaaataatctctagattacttataattcccagtgcaatgtaaacactatataaatcgttgttttacatactgttttaaaatttgtgttatttttaatttttgaagatactttatccatgattggatgaatccatggatgcaaaacctatggataggaagggctgactgtaactgagctcagagattctggaaaagcacttaagtaatcaatattccaggaaaggggacttaaaatgtatccttgactctacatgagaagttttaaatacagttttttttttcctttttagggagtttgcaggtcagatacaggctagactgacatcaagattctgattccttttactttgatttaaaaaacttagctgatagcagtttcaccattttagaatgaacatgaaagaagcaattgtagaggtaacgcattaattaaaattatgactttctagcatcaatgactttacataaacatttgataataaatgactgggaaaaaatgcccaaccaatgatatacatacatatatatatatgtatgtataagtaagaagtgaagtcaaatataattacagcgttttgtttggttttgcttttgttctttgctttgcttttgtttaacaatgagaatctatccaagctattattaacatttgattacttagatgccaagttttgcttttagttcataaggaaacatagtcgattttatcactggatactactggtagaaactttgaattgatatttcggtgaaaacctattttcattgaattgtcaaaccacaaatgctatatataatagcaatttagaacaagaaaaacaacctgattttgattaaaatgaggatacataatgaaaagtcaccacaaaataaactttactctgttactggcttttgaagaaaatcatttagatattaaatctatagatagaacatttctctgcctcatgtaatattttattcttagttaaaagttttgaggtataaagtaatgcattgtatttctttgtagatcctcccagttatagatatcctatgaagcaaagtaaattgggaaaggagataacaggtggagtggcagcttttggcattctataagttggttaaaaatattttcctcttagtatataaatcttggaattgatctcttaatctttttggtagcactaacaggtggtttattttatgatttttttcccttggttttcctttgcttcctgtctttttatcacaaagttactcttcatttgaatgcttctattggaacaaattgctaggttaacagaatgcaaggagacaagtcatcctgtcaggtacagaattcattcagtgctgtcaaatttcttgtattggggaaaattttaggtaggtggaagaaaaacctttcccttcacataacagatcaaaagtgtcatgtcacaagcatgagaaccatttgtcatgctgaaagaaacttcttttcttaagtttatgaataattacatcatgagtgacaatcaagataaaaactgtacttttatctaagtgcacatgtaatcatgagtaaagtgcttcctgaaagacgagcaagaatattgcttcaaaaataatcttacatttatctgtctcacttagcaatcaagcacaatgaaatgtgttattcttctaataattcaggcaagaaaaaatgtgatcaaagtatgtgtaaaattcatagcttctgtctgtgtcttcatcggtggtcaacccagaaactttcacttaatgagacaactaagattaagtttggaataaaagaacggtatgaattaattttagaatgctatattatttgtcttctgacttatgaactgtatgaattaattttaaaatgctatattatttgtcttctgccttcatttaattcttatggaatttgaatttttcataaaaaatggttctgagcaagtgctgcagtggatacaagataactggatcctagcactggctcttccatttacaagttgcaccatagactgtgacaaggtatctgatatagtttggctcttctctgtgtccccacccaaatctcacattgaattgtaatccccaacgttgggggagggaactggtgggaggtaactggaccctgggggaagatttcccccttgatattcttgtgataatgagttctctcaagatctagttgtttaaaagtgtgtagcaccacccccttcactctctctcctgctggccaagtgaatatgtgcttgcttcctcttcaccttatgccatgattgtaagtttcctgaggcctccccagccatgcctcctgcacagcgtatggaactgagagtcagttaaccctctttttaaaaataaattgcccagtctcaggtagttctttatagcaataaactaatacagaaaattggtagcagagaagtgggacattgcagtaaagatacctgaaaatgtggtagtgactttggaaccgggtagcaggcagaggttgaaacagtttgtagggatcagaagaagacaggaagataagggaaagtttggaacttcctagagacttgttgcatggttgtgaccaaaatgctgatagtgatacggacagtgaagtccaggctgaagtgatctcagatagagatgaggaacttattgggaactggagtaaaggtcactcttgctatgctttagcaaagagactgatggcattgttcccctgctctagggatctatggaaatttgaacttgagagaggtggtttagggtatctgttggaagaaatttctaagcagcaaagcattcaagaggtggtctggctgcttctaaaagcctatgcttatttgcataaacaaagaaaatgacctgcaactgggacttacatttaaaagggaagcagagcataaaagttcagaaaatttgcagcctggccatgtggtagaaaagaaaacccatcttctcgggagtaactcaagaaggctgcagaaatttgcataagtaaagaagagccgaatgttaatagccaagagaagggggaaaatgcctccaagatatttcagagaacttcaaggcaacccctcccatcacaggcctggacgcaaaaatggttttgtgggccaggctcagggacccactgctctgtgcagcctagggacatggcatcctgcatcacggtcacttcagctctagccttggctaaaaggggccaagatacagcttgtccattgcttcagagggtgtaagccccaagccttggtgacttccacattgtgttgggcctgcaggtgtgcagaaggcaagaattgaggtttggcaaactctacctaggtttaagaggatgtgtggatgtccaggcagaagtctactgcaagggtggagacctcgtggagatcatctactagggcagtgcaggggggaaatgtggggttggaggccccacacagagtccccactggggcactgcctagtgaagctatgagaagagggccactgtcctccagatcccagaatggtagatctgctgacattttgcaccatgtgcttggaaaagccacaggcactcaattccagcctgagaaagcagccgtggaggctgtatgatgcaaagctacaggggcagaactttctaaggccttgggaggccacccattgcattaatgtatccgggatgtgagacaaagtcaaaggagattattttgaagctttaaaatgtaatgactcccctgctggatttcagactagcatgggatgtgtagcccttttgttttggccaatttctctcatttggaatgggaacatttacacaatgactgtacccttattgtatcttggaagtacctaatttgtttttggttttataggctcataggcagaaaggacttgccttgttccagatgacacttgggacttggacttttgagttagtactggaaggaattaagactttggaggacttttgggaaggcatgcttgtgttttgaaatgtgagaaggacatgagatttggcagggactaggggtggcataatatggtttggctatgtgttgccacccaaacctcatgttgaattgggacctggtgggagctgattagatgatgggagcagattcccccttgctgttttcatgataatgagtgagttatcgtgagacctgatgttttaaaaatgtgtggcacttcccccttcactctttctctcctgctctgctatagtaagacatgcttgcttccccttcaccttctaccatgattgtaagtttcctgaggcttcctagttatgcttcctgtacagcctgtggaactgtgagtcaattaaacctcttttcttcataaattacccagtctcactgggtgcagtggctcatgcctgtactcccagcactttgggaggctaaggtgggtggatcatgaggtcaagagattgagaccatcctggccaacatggtgaaaacctgtgtctactaaaaatacaaaaattagctgggtatgttggcatgtgcctgcactcccagctactcaggaggctgaggcaggagaattactagaacccggaaggcagaggttgcagtgagccaagactgtgccactgctctccagcctggctacagaatgagactccatctcaaaaaaaaaaaaaaaaattccccagtctcgggcagttctttatagaagtgtgagaacagactaatacagcaactattcttctgtgtctgttttttcatctgtaaaattgaggagattggaataaatgatccctctatatcccttctacttttgatgctttatgaatccaggttaaagtgtgtggtacaatttaagaaggctccttttaatatttgtatatccattaaggactcttagctcagatcttcagtattattcaatgactctctttctctcttcctccttctctctctttaccctcattcagatcaacatatagaacatttccattacctaggaagtttcctgtgtcctttccaaaacaatctcttatcaccattgattagttttgccttttcttgaacatataaatggaatcatacagtatgtcatcttgtgtcttgctcattttccttagcaaaatgttttgatattcctccaatttttggtagatatttttagttcattcctttccactgttatgtactcttccattatatgaatggaattcatacaatggatttgtttatccattcttttattgatgaatttttgggtaatttccaattgttggctatgaatctcctgtattagctttgcagctgtaatgaaacttttagtcatttccctcaagatcacaatatgttctcttaagttattagtactttggccacttcccaaagaatgcaagatccttacaagtttacttccatgtatttgtgtatctctcacccttgtgccattgttgtaatacacttttttattgcattttatatttctacaagatattattattattgtagttttaaaaagctttcattactatttactcatgtttgccctttctctgcacttcatttattcttgcattcccccctgctgcttttgttttctggtttttgattgccaataagagctacagaaaatcatgaaatatttcttttgtttctatatttaatgtttaattgtttttgtgcttattgttagtaactttttgaaacacctttcattcctttaagtagagaggctcttcagccaaatttttattccttaatatttcctttttcttccagacattttgttgttgatgagagcagaaaagatttccctttttggaaaacattatcaagcaaaatattttatgggccaatgcctccataacctgaaacaattgaaagaattctggattgaaatgatagaaattgtattggtttctggatttcttgctgtagattttttaagagaaaaaatgtattaaatctgtttttgaagtgactaagcaactctactaaaaattgtcatgcaagtgaaaattgtcctcagcttcttaggctaccatgtgacatttacttcactacttagcttcacccaaatcacgcttttcccatccctttcttgcctgagatgcttaatgttttttctcctttttttctgtcaaaaccaaagtgtatttgtttttccatgctaagagttgataaaatattgtcccactgaggcataaattagtaagaaaatgccaactattagttctcccagttggttttatttttttcattacattttagtaggaaaaataggttttaagttaaaagaaaggaacccaaagatggagtttcaagacatccaataggaaagacagatagaaatacatttctgtatatagatatgtgtacatatgtttatacatataaatatatagatatgtgtgtatgtacatatttctgtatgagtcatggtccacgtgtaatttaaaactatttatggaaatattacataaagcacatttatttattaaaaagaaggatttccatagtggagtataaagttctttaaacagttaataggaagactagtcaggacagaattagaaaaatgtatgtgaaccatctccaagatatgagagaattacgtgccaggtgtaccatgaaacaaattatattagtgttcaatattgcatataagagtataacataattatgaatataaaatatatattataaatagaatgtcatttaccaaggttttccaccttaaataataccgttttttaatcttaaaacatacattgtaataagagttatgatgttaagaattctaagtatagcatgacaaaacgcttctattattttctttaaaatatatataaaaaacttttgctgctttttggtggataataacccacacacatgtacacacacacacatgcatccccattaccttttaatggaacaaggcaagtcctttaatggggacacatgcatccctattaccttttaacgggacagtcaccattaaaaatgtctgcagttatgtatttctaaaatcagctctgtgggtaagaaatttaatgtagctgccgattctgtgcggttctggggaaataatagtttaaaatcttctaatttgactctaatttcacttctaactccaacctgtgctcctgaagcaagacgtttttggaccgtcagcaggcagatgaaggcctgagagtggtaggagagctattgtgggctttcctacctcagggctagaggagggcttggagaccggcaaaggaaaagatggaccatttcaagtctcagagcaaaaatactaagagacaaagatgggatggaaaataaaagtgacgtggtaatcgatagaggaaatttacacaaatctaaaaattctgaaaaagaaaaagaagcagagacaataaatatgcatccaaagagaagaaaactctgagcaaattaaaaatgtgagctgcacattcctgttactgggtatatacccaagggattataaatcattctactctaaagacacatacacatgtatgtttattgcaacactatttacaatagcaaagacttggaaccaatccaaatgcccatcaatgatagactggataaagaaaatgtgggacatatacaccatggaatactatgtagccataaaagagaatgagttcatgttctttgcagggacatggatgaatctggaagtcatcattctcagcaaactcacacaggaacacaaaatcaaacactgcatgttctcactcctaagtgggagctgaacaatgagaacacatggacacagggaggggaatatcacacactggggcctgttacggggttggggggcaaggggagggggtattaggagaaatacctaatgcctgtggggcttaaaacctagatgatggggccgggcgcggtggctcacttctgtaatcccagcactttgggaggccgaggcaggcggatcacgaggtcaggagattgagaccatcctggctaacatggtgaaaccccgtctctactaaaaatacaaaaaattagtcgggcgtagtggcgagagcctgtagtcccacctactctggcggcagaagcaggagaacggtgtgaacctgggaggcggagcttgcagtgagccaagatcgcgccactgcaccccaggctggatgacagtgtgagactatgtctcaaaaaaaaaaaaaatctagatgacgggttgataggtgcaggaaaccaccatggaacatgtatacctatgtaacaaacctgcactttctacgcttgtatgccagaacttaaagtaaaaaaaaaaaaaaaaaaaaaggccaggcgcggtggctcacgcctgtaatcccagcactttgggaggccgaggcaggagatggagaccatcctggctaacacggtgaaacccggtctctactaaaaacacaaaaaattagccgggcgtggtggcgggcgcctgtagtcccagctactccggagcttgaggcaggagaatggcgtgaacccgggaggcggagcttgcagtgagccgagatcgcgccactgcaccccagcctgggtgacagagcgagactccgtctcaaaataaataaataaataaataactaaagtgagctgcagtttgaaagggctcaccaatttagactgatggtatttgtgttgagtttcttatatgttttggatattgaccctttattagctgtatagtttgcaaatattttttcccattctgtgggctgtcccttcactttaaaggtttgctgtgaagaggctttttagtttgatgccattttatttctctctttttgctttttgcttctattacctgtgctttttgctttttgcttttgttgcctgtgcttttggggtcatatccaaataatcattgccccagccaatgttgtggggatttttctctgttttcttttagtagtttcacagtttcagatactatgtttagatttttaatccatttgggttgatttttgtatgtggtataacatatggatctgatttcattctccttcatgtggatagctagttttccccacacaatttattgaagatactgtcctttccccgttgtgtgttcttggcaccttggtcaaaaatcaattgatcatacatgcatgggttgatttctaggctttctatcctgtttcatcagtcagtttatttttatgccagtgccatgctattttcattacaataacttcataagatttttgaaattagggagtgtaatggcaccagcttttttccttttgcccaagatcgttttgactctttagggtcttttgtaattccacacaaatttaaggatattttttattgctgtgaaaaatgacattgcaattttgagagagattacattgacactgtagatcattttgggttgtatggacatttttgaaagaggggtgttgaggttccataatattgtagtattgccatttatttatccctttatgtcatttaataattgctttacgtatttaggtactctgatgttgggtgcatatataattacaattgttatgtcctcttggtgaattgacccctttctcattatttagtgaccttctttatctctttttacagtttttgatttaaagacgattttgattgatataaatatagattctcttggtctcttttgatgtctatttgcatggagtatctttttccataccttcagtttcagtctgtatgtgtcctcactagtagagtgagtctcttgtaggcagcatatggtttttttaaaaaaaaaaaaattattcagctgtcctaagtctcttggttggagaatttaatctgtttacattcaaagtaattactgataggtaagcacttgctactgctgttttgtcattcattttctgaattttttgtaagtccctgtttctttatttctctcttgttgttttctttttgctttgtggttaccatgaggcttacgtaaaatgtgtgagctttatagcaagctacattaagctgataataattgaactttaatctcatactttcactccccccttttataattttgatgtaaattttttatttgtttttgtaatttgtattccttaacaattgcagctacaattgcttttaatagtttttccttttaatcatcacagtaaggatacgattgctttatgtatcacccatacagtgttagagaatgagtttgattatgtattacttaataccattgagttactgagatttttacatacatttttttgttgttgttaagtagaaaccttccatttcagcttaaagaactgcctttagccattcctgtaaagcagggataatgtaatagactcccttaggatttgtttgtctggggaagttggaattctctcttatttctttttttaatcttttttttttttttttttgagatggagtcttgctctgtcgccagactggagtgcagtggtgcaatcttggcttactgcaacctctccttcccaagttcaagtgattctcctgcctcaggctcccgagtagctgggaatacaggtgcacgccaccacacccagctaatttttgtatttttagtagaaacggggtttcactgtgttggccagaatggtctcgatctcctgtcctcgtgatctgcccacctcggccccctcaaagtgctgggattacaggcatgagccaccctgcccagccaattctctcttattttttaaggacaactttgccaagtaaaaaattcctggttggcagttctttttcttctgcactttaaatatatcaccccaatctctcttggcctgcagagtttctgctaagaagtcaactgaaagtcatattgtggttcccttgaatgtgatatgtttcttatctcttgctgctttcagttttgtttctttgtctttgatttttgataaattgattatgttttatcttggtaaattcctttttgagtggaatttgattggagacttttgagcttcctgtatttagatgttgtcatctttccccagattggggaaatgttcagccattttcttaaatatcctttttgggccttcttctctatcttcttctgaatctctgattatgtgaatattagtttgcctgatggtatctcataattcctgcaggccttctttattctttttctttttgctcttcagactggataatttcaagatacctatctttgaattcagtgatcctttcttttgcttgatcaagtctgctgtcaaagctttccattgacattttcagttaaattattgtattctttatgtctcagatttctatttggtttctatttatcatctctagttctttgtcaatttctcattttgttcatgaattggtttcaaacttaatttaatttaattggagttccctgaacttctttaagggggttatcctgaactctttgtcagtcattttatagatcaccttatattccagatctattatctgatctttattattttcttttagtggtatcatatttccctgacttttcataatacttctgtcttgcattgatgcttctgtgtttgaggagacggccacctcttccaggccttgacagatctttactacttcgtaggaagggattctggatgtgttagctggcaatgaccctggacgggcagagcttggtgtcaggttctctagttgggctgtgtcacttcctgagccctaaggttgaatggtactgctaactggactctgcagttcactctgatcaggcaggatcgtaggctgtctccgctggttggatggtattgttgtttagaatctgtagttgaacaggcctctgggctgagctctatggtcacctaaagactctggtgttgttgctcagctacacagggctgattagggctagaagccattatgccccacacatatgtgcggacttgatcttgtctcctggcctaaggtaggcttaaacaaagcttagtggagttcctggtcagctgctggtgctgggtggggaccagatgtaccctctgcagagaagtgctgactttcacttgccttctagcctgggcaatgctgtagaaagcaccaggtctatgtaggaaagctggcgagggatgctagctgggtacacctgtgagctgtacttcctgcggtacaatgctgttggctaatctctctcatatgatgcctccattagccagaatgcagactaactacacgctagtctctgtgagatctactcccattctttgtttctagctgactccaggtggtctatccccgatggcactcctaatgtttcctgtggtataagacaagggtgagcctcctgtgaagggtcctagaatggtgggcaagctgaatgtccacctccaactttcttttcccactgtagaaattgtgggtctggtgaaatcctctgtgtgtcatgctatgccagcttggtggaggggtggcatgctcaaaatgaactgttcctcttactcttcaaagcacagcttttcttagttctgcagtacaattgggtgtctcagtctcactcctgagttctgggatattcagaaaggtattcttgcctgtggatagttgctagttggatttccgtgtgggggtgtggagctggagaaattctattctgccaccttgtgaagtcattctctggaataattttagatttacatagagttgcaaagatggtaaagacagtttctatacactcttcacttagtttcttctgatgttaacctcttactttaccatggcacatttattaaaaataagaaattaacattgtacaatactattacctaaatgacaggctatatttaaccagtttttcattcttgagaggaattcttactctaatgcctaggctggagtgcagtggtgcgatcttggctcactgtaacctcaacctcctggtttcaagtgattttcattcctcagccacccgagcagctgggatgacaggtgcccaacaccacatccggctaatttttgcatttttattagagatgggatttcaccatgctggccaggctggtctcagactcctgacctcaggtgatccacctgccttggcctcccaaagtgctgggattacaggagtgagccaccgtgcccggcccacatttcaccagtttgtttttgtttttgtttttgtttttaactaatttcttctctttgttcccaggtaccatcaaggatctcatattgtgtttagtcttcatgtctccttagtcgacttcaattagggacaatctctctgtctttcctagctttgacactttgaagaccactgaccagatattttttagaatgtgcatcaaatgatttgggttcatctgatgttttctcttgattaaagtggggttgtaaattttgaggaagaatttcacatagttgaagtgaccttcccattgtgtcacggtggtgtgaggtagccatatgacttttcattgttgatgttaaccttgattacttggctatgttggtgacttgatggtttcctccactacaaaattacagtttttacttttccatattccatttcttaaaggcagtcattaagaccaacctgcaagactgggcacagtggctcatgtctgtaattccaggactttgagagaccaaggtgggcagattgcttgagcccagaagttcaaaaccagcctggacaacatggtgaaaccccatctctacaaagatacaaaaattagccaggtgtggtggagtgcacctgtagtctcagcaatgtgggaggctgaggtgggaggatcacttgagtctgggatgttggggttgcagtgagctgtgattgtgccaatgcacttcggcctggatgacagaggaagaccttatctcaaaaacaaaaacccaaaccacaaaaacaagactaacttgcaagccacatgaggggaattcaacttcaccttaattcaaaatcaccagagtaattaacaaatatttaaagaatttttcaatggttatagaattctgggttgataggtttttaagaattcttttatgacttcaaaagtgtcacttcgtttcttgcttgcatggtttctgatatgaagtcagctcccattcttaaccttgtttcttgtttgataatgtctttttgcctctagcttcctcaagatgtttctcttttgagaaaaatgagagattttcagtttttgtgttgatttctctttgtctctggttttcagctatttgaacacattccatatcactttaagatttcttcatcgggggtcactggacacatgtgtcacaattaacaaaggggaacacattctccaaatgtgttctgtttccccaggaagacagctggaaatgcaacaaaatgcctctccctctcctttagcaaaacacgagtcagggcaatgcaagatttgattgggactgctttacttcattaactattacagtgcgctgtttttctttctagtaacaacccagtaatagttattaaattatttggagctaaataagtgtaatggtaattttcatttaaagtttgctatatggtagcttagagcatcttacctgtacacagttccaaacgcagaaaacctaaatgaaattaacatatatgtatcattacaggttctcaaaacctcataaatggctctattttacatctctgagctcttatatgatgtttcctttaactatgtcacaagacctaagactatggtttgaaatatatacctactataaaaaagtaagccttcctgctggtgtcaatagataaaaacaaaacagacaaaacgacaaccaaaaatgcccagaaatccttttttttttttttttttttttgagatggagtctcactctgtcacccaggctggagtgcagtggcgcgatctcagctcactgcaacctccgcctcccaggttcaagcagttctcctacctcagcctcctgagtagctgggactacaagcgcccaccaccatgcctggctattttttttgtgtatttttatagatacagggtttcactgtgttagccaggatggtctcgatctcctgatctcgtgatctgcccacctcggcctcccaaagtgctggaaaccctgtttttaaatgcatatttgcattcataataacccgtgaatacatacatctattgatctatgtattcatgcatctctatatgtaaatgtctgtccaaaatgccactatatatatatttatatattaaacttttattttaagtttgggttacatgtgcaggtttgttatataggtaaacgcgtgtcataggggtttgttgtacagattatttcatcactcaggtattaagcctagtaaccaatagttattttttgtacccctttccctcctcccaccctccactctcaggtaggccccagtgtatgtcgttcccctctatgtatccatgtgttctcatcgtttaactcccacttgtaggtgagaagatgcggtattttgttttcagttcctgtgttagtttgctaaggataatggcctccagcttcatcatgttcctgaaaaggacatgatctcattcttttttatagttgcatagtattccactattccacggtgtatatgtaccacaatatgttcaattttagtttattacaacttatatgcaacatacaatggcaagatgaatcagatcagaagataaacaattgagtgtgaaaagacagcagtttttttcctgttttattctctgcagatgtaattttcaacgagaatacattttattgcattagtagtgcttttagaagagacatcaatatgatgcccaggctggtcttgaactcctggtcttaagtgatgctccctcctaagcttcccaaagtggtaaattgtacttcctgagggcatagaaaagagacatagaagcaagtgaaattggtattacccttttttctgttattctttattagtaaaacaaattaggtttttctttccttggttttcatgtgtccaagctcctttctctttcatttcacatgtgcacaaatataataacatacacttttgaacatcaaaagttgaatgatgaaagatcattcgttagcccaaatcaacctgcacatgactttttttttattcctctgagagttagcctgtggaaaggtggcagggtttcattgcattatcccctgcagatggaaaggtcaatgacaacatgtgtaattgcttcagtcctgattttctacctacacttactgctgtggggttgtttcacctgaccaaggcagtttctgtggcagcaggtcctagctgtctcgaccaggtccactgacaaagccactttgctgagtggccaatttgctgatgactattttgttaaatttgtttctgctaactatttaaggttgactcattttcttgtgtcatagtctcagcaaatgtgaagggatggctggtctatctctgacctggctttctgctttgacagatggaagctaaaagaaaaaaggaaaaactgatggtgcaaaagataaacatatttatatgagtttattcttgaataaaatgatttatttttaaaatatattcttgatatgatttggctgtgtccccacccaaatctcatcttaacttgtggttcccataatccccatgtgttgtgggaaggacccagtgggaggtaattgaatcatggggacggttacttccatgctgctgttctcataatagtgagtgagttctcgcgagaactgatggttttataaggggcttttcccccatttgctcagcacttctcctttctgccatcatgtgaaggaggacatgtttgcttccccttctgccatgattttaagtttcctgaggcctccccagccatgctgaactgtgagtcaattaaaactcccttttacaaattaccgagtctcgagtatgcctttattagcagcgtgagaacggactaatacgattcttccgatgaatatattcttctcattcataaatgcttgatgtaaatgcttaatttttcctctaggtgccttcaagatttttctcattgtctgtggttttcagcaatttggataccttacatatcgtttttatgaatcttccacagagatcagtggacacatgtggcacaaagaacatgtgaattaagaatgcactcctgaataatatattttacatatatgttattgagcatattcttaaatataaataatttcttgtgaatatattttgattaataaaaatatattaataaatgttaactcatgcatattcttcttactcaaaaatatgttcttatattaattactccctctctcttcctcctagtctccaaaggtaacatcaggggctagaacagagacacagaaatgttccttaaaatgtcaaaatgaaatattgtctattaaaacagaagaattaaaataaacaagagaagttaggtattggtcatctgatatttgtaacctgcagctttcccaggaaacttggttggacccttttcttgattcagctgtcagaagctaaatgttcccttcctctctctctttgcagtctgttcatgacatttggtattcctaatatgcccacttggaggaaattgccagcttaggccaaccagggtgaaatgcatgcacttataaactcataagcccaataataattttcagaaggaggcactcattcacttcggcttataaacttgcaaatctgtagattcattagtctatcacttacatggaaagacaaaatttatatttaattgttgagacttgacttcaaaattttcaagaatatcaacatttgtttttgttgtgcacctctctgtcaaaagataaatacgtagtacataatcattattatttattaataatatactctgcatggtcttacatttcacagttcatgcattgtttattcattaatataacctgttaacgttaatatgcaccacattaccgagagcccttgtcaactcctcagaagcaactaactcccaaggtaactatgacaacgaatctcttaatgcttaaagtgtaacaaaaagattgtgtgatttggatgttaattcaaatatttcctatacagccccatacagccactttagaagggaagtggtttctcacaaaactaagtatattgtcaccataagatccagtaattgtgtcttggcatttaaccaaaggtatggaaaactgaggtcaacacaaaaatctgcacattgatgtttataggagttttattcataattgcccaaaggtggaagcaacttcagtaagtgaatggataaacaaactctggtacactcatacaatagaatgttattaagtgataaaaaggtacacactatttaactatgagtagacatggaaaaaaaaaaccttaaatgcccatcgctaagtgaaagaagccgatctgaaaagagtacatactgtgtaagccgaactatatgacattctttaaaaggcagaacgatgaagacaatgaaaagcacagttgttgccagggatttgcagggagaaggagggatgaataggtggaacacaggggatttttagggcagtgaaaccattctgtaaaatgtcatggtggatatatgacattacacattttccaaacccatagaatgtacaacacaaacagtacaccttaatgaaactgttgattttagttaataataataatgtatcaatattggctcattaattgtaacaaatacaccagacgaatgcaagatatcttaataataggtatgatgagctagggagggtttaaggaacactctgtattgtctgctcaattttcttgtaaatgtaaaactgcctccaaaaataatgtctttttattaaaggaaaacatgctgctaccactatgtgcttagtgtcctatgcatttcaagtctgggtggtatgtctagcagaaatatattaacatgtcccaggctgatggtattgaataaaggatttagatggccataaaaaatggattttgtataatggatttctgagttgataagaaagcagtatgagtatatcaccataatacaaaacttagtgatttgaaataaggcaaacatatcatcaattttgccagtgtaatgataacacacacactgtataaacagatattggaacatcagtttgtcactggttgttcaggatgtagaatatacatcaacttaaattttcacatttagtaaagctctagcttcctcttatgctagctccataaataagacaaattttttctttcatcctctttgatggccaatgccggcctaaactcttgcctgttaggaattagtacacatctcctagctcagagacacctacacgagtgactcttggccagtggaacctggttcactgtgccctccagtgtggggccaggcattgttcctctcccttgcttggcatcccagtcttgtgggccctctttcagttgttcattcactccctgcttcctctcttcacaaaaactactctgttgaccttggtttagaattctctacccaccctccacccacctctttatgctgatcctgtccttgtcctgtcttgcaaggctcaacagttaagtctcagggcagccttccctcacccttcagtcctgccgctttatataaccatcctgtagactcctgctattttccatcagcctgagagcctcagttccctggtgtgataatgtgactaaagtcagcctcacctaattaaacagggagcccccagaaagcagggctcactgtcattcggcagtacctgccctgagtctggcccatccttgctgcagctcaggagaactcagcagcccaggacagcaccttcgtagggctcagcaatacagctggaactaagggagggaggaaaagaaagaggcagagaataaatgaatcaacttagccagaattttacagtcagaaaatctacaaagaagtgggtttagtttcaggatatatttgcttttaaagacaaaatgacattttaatgctgttattagtggtagggaatgggtgacatgtccatgtgttggtgcttgaggtcactaaacaacttaacatagctctgagtagaggtttcaaagagagttttcgatgaaatgatttgttttacaaaatagggcacattatctcctgttttgttgtggaaacaaaacccatagaataatttcccttttaagcaattcttctttgtttctactgagggaagctgaactaggaatacaccgtgttagatcaggagagattcaagacagacattgggaagaattttctagctggggtgttgttaatcactttcgcacagtaaaaaagcctgcagagcagccttttttttgatgagagttaaggcaataagacaattaatagtctaacccagtaacagctgaattgaccagatatccttcaagacttctcagagacttcctcagcacatggacttgagctcttacataatgttctcattcacagactgcattgtgcctgcaatctcatgtgtcattattattagtagtaatagtattttagacggagtctcactctgtcgccaggctggactgcagtggcatgatctcggctcattgcgacccccgcctcctgggttcaagcgattctcctgcctcagcctgccaagtagctgggattacaagcgcctgccaccacacccagctaatttttgtatttttagtggagacggggtttcaccacgttagccaggatggtctcgatctcctgacttcgtgatctgcctgtctcggcctctcaaagtgttgggattacaggcgtgagccaccgcgtccggccccatctgttattattcaaggtattttagtgcatcaccgcacacacgatcttgggtctcgccattattttgttatccctgtacttgaagaagagagacattctgactggcattaactcaacattttgtgtgatggactactacatatggctcggaacgcatttttgtttgctatatagaaatgatcttctcttcggtgtgataaataatacagctaaaagtctcagaattaatcaaacttaccatcaattaatttcaaatttttgactagtttccttaagtatttaaattattatgatttgcaaaataaccttgaaagtcattcagtcagaatggctttgaaataaaatcatcatatgttaaagtaagaaattatatcctacctaataaggacaatagatacattaaaatagtctcatcaagtatttgtctttagttagtagttatttctccaagaaagtattaacttcaattttgaacaaagttttctttctttttctggcagtatcagccttttgccaagctgaacacaaggggatgaaaagaaaatctgggctcgaatgtgcaatttcatattttatgttaaggcaatttacaacatatcataaagctgcattaataaacagatgtttcacagtctgcagaatataaaataaatgtcttgaataagctaccaagaccaaggcactttttggagcagatatttttgtcttaaagttttatctcatgcaaacactgtatataacacaaacttatataatcaatgcttttagcaaaatgtcatagtagaaccaaagcccaattgttagctgaaatctatataaatataggtatgtagaatagttaggaaatataaatattagcatatgctctttattgttgatgatatcaagaattcttttatgaactcagaaaagttttttctctttatattcaaaatgaatttttctaattactttctttttcacagggttctccctgtctgcaaattataaccattacagctatttctttcaagtaaatatctcctttgaatcagtcttagtttctccaacacctagacaatgcctggcacatgtaaaggcattcagaatacaagtaaatgcatgcataaaatgaataaatatatttacaagatatttatagacatgtcataggaatgtgggggccaagaagagggattctagcttttgggtagatacaattgcagataataacaataacttacaaggtgcctaaaatatcaagttaccgttctaaatgtgttagatctattggttcatatagtgcttgcaaaagcccttgaagtatagttttattatacttaccattatataaatagagaaactaaggcagggagaggttatgttgttccaggttcacgtgacaattcaatggcagagcttgattcaaatttcatacttttaacttacgtacaattttgcctaccatcaagacattcttcttgctgaatggaaaaaggccctcaaagggaatttatggagtactattacacataaataactctgcatataagtaattcttctgtggaatgatttcatcttatattctcagagaatgacacattttatgtcaaataaatacaggagaaagaaaatgattttataaatgttactaacactatcctaacaaatggaagagatatgataaactttacattctaatttgaaatttatgaaaatgatacacaaaacactgttttgagtagactctatgtcttatttttgtgaggccaaaatatctaatacatttattttatgaaataaatgcttagggattattttatttgttgttgtaaggaattatgcctactgaaatggacaaagcattgtgattagtgttgggtcttttggctcagactcacctaaagggaacaaagaggaacaaccagatggtgaaacggaggttcctccatcctctgatagcttgactaccattgcattttagtaaatccttaaatcgtatactatgcttatgacaacttaattttttttgtaattgatgatggagttgataagttcttgtatacccttgcttgttagatcaggagagactcaggacagacatcaggaagaattttctagctggggtgttgttaatcacttgcccacagtaaaaaaaaagcctgcagagcagtctttttttgatgagagttaaggcaataagacaattaatagtctaacccagtaacagctgaattggccagatatcctttaaggcttctcagaagcctcctcagcacatgaacttgagctcttacataattttctcattcatagtgactgcattgtgcttgcaatctcatgtcctattatttaaggtacttagtgaatcactgcatacatgaccttaggtcttgccattattttgtaatccctgtactggaagaagagagacattctgactggcattaactcaacattttgtgtgatgaactattacatgtggctcagaatgcatttttgtttgctatacagaaatgatctgttaattatatgtgataaacaatactgctaaaaatctcagaattaatcaaacttaccatcaattaatttcaaatgttcactaattattagcgagagaggagtgttgaattatctaatcataattgtacatttgttgatttcttcttttagttcaattaatgtttgccttttgccaaatttgggtaatttttcctgttaggttttcaaaattctttcagcactgcgctccttttcattttctccttctgagactcagatgacatgtatgttggaactttagttattgttcctcaagtctctaaggctctaatcgagactttttcatctttctttctctctattgttcagattagataattcctgttgatttatattcacgataacagattcttacctctttagttttactgtaataaaaagcttacttagaattttgtatgtcagttattggattttttggtcctaatatattcattttgttcctttttacatcttctatttattttctgatacttctagttttccattggtatacaagtgtttgtgaccgggcatggtggctcacgcctgtaatcccaacactttgggaggccgaggcgggcagatcatgaggtcaagagatcaagaccatctggccaacatggtgaaaccccttctctactaaaaatacaaaaattagctggacgtggtggcgcatgcttgtagttccagctcattggtaggctgaggcaggagaatcgtttgaacccggcaggccgaggttgcagtgagcctagattgcgccactgcactgttgcctgggtgacagtgtgagactccgtcccaaggaaaaaaaaaagtgcttgcgaccacttgttggaacatttttataaaagctgctttaaaatccttgtgatgtaattcaaatttatttttcttctcagtattggtagctacttagtactgactgtcttttctcatgtggggtgcagtttatctgtttttttgtaattttggattgtgtcatgcacattcagttttgaggctctgggtcctcacaaaatattaggcggatggatgctgtttttgttttagaagcaattgaccttgtcatattcaagctgcaagttccaatctgtgttttgtgagctgtggttccaacaatcagttgagttttcaaagcctttccagttttcttcagatgtgtcctggtggtcagtgtggaagtcggatgataatctgctagtttcgttctcaaaatctttggttaactaattaggagccgatccacacacatgcagcttggggatgcgctcagttcattaaaaactttatggtgtcactttctcatactccttcctctccacaatgtctccaatattttctggttccctggagctcctcttttctgttttctggccagaatgctgggtctttgattacggtactctgctacagtgtttcatggctgcacccatgtttggagccgacaggtggcaaaatgagaaaagactttaaaaagtttgcatcaccctcttgggatcactactgcaccaactggagaggaagatgccctggcctgagggttttgtttctcctaggcactgcctgctgctgtcaccacaggaattcttgggggccagatcacaagggctcagagaaaacaaacaacaacaaaacggagggatttctgcattctctcggagtaataggtgtcctctttcctgcccaaacttgtagggcttatccttgatctcagcaattgctgagaaactgttccaccctttacatggaaaacagactttcttgtttgcctcatccctaccagtgtctttctctctacacctaagttcaattaccagctgccctttatcattgaacttgatgctttcttctcatagtagaattaagaggaaagtaaaatattttttgtacctatatctttattatatttagacaaatcacagagtgagagagtaggggtttcaagaacaataggagagagacagagaacagagaaagaactgcttgtggaaatgcagaatatcccacattttcaatgtggaaagtgtatgagggtctgaaagaaaataatcagtttttttttgtcctgtaataggcagcattgacaaatgtgtaccagagtttgggtacatttgagccagttcttcagaatcgtggggtgggaaatagaagaaaattatttacacctaactctaggcagataagtgtgcttcaaggaaaggcaagggcctggctagattctagatgtttttaaactggaggccagagacagctttagggagtctatatacaggcacaaatttatttcttttatattattcttgctctttgaaaacggtctttatgcaaatacacactatataaccaaagtttctctttgttccagacagcagtagggctgattggagccattgtacagtgtcaggaacataccagcacactgagaatagcatcatgtcataaggacccagagcaggtggaccctgctgtgatgcacaaaggtgagggtgcagctgcccaggacacactcatgcatgtttgtgtggaccatggaagatggcaggggaagagctgtcaggttgttggggcagagggtgcgcatgagtactcgcctgtaagtcatgttgtagaatcacctcgcacagccgctgtatcttcccaccagcatcaccagataactcccttatcgtcacttcaataatgcttgattttgtctgacttttttatgtttaccagttcagataaagagaattgcactctcatcattgctataatgtacacttttttgactactaacgagtctgagaatctttagatacatttgttagtcattaatgttttttctctctcttttttctgtttttgagatggagtcttactctgtcaccaggctggagtgcagtggcatgatctcagctcactgcaacctctgcctcctgggttcaagtgattctcctgcctcagcctcccgagtagctggggctacaggtgccccccaccacacccagctaatttttgtatgtttagtagagacggggtttcaccatgttggccaggctggtctcaaactcctgacctagtgatccatctgcctcggcctcccagagtgctgggattacaggtgtgagccaccgcgcccggccatgttttctcttcttaatctgtttgtactttcatttactttttctttcttttttaataagaggtttttattttggatatcaatctttatatcttcagtaatgttgtaaatatctttttgttcccactagcttttcttgcaaacttttattcctagtgtcttgttgcacagaaattttattttattatggtcaattttgtcggcctttatctttataatttgtatggggttcttttcttgtttgtttttgatttgtataaaagtgatttttttaccctaaagtcaaaagttaaaatttaatgttttcttcctatttcagaggaccatgcaagatatgataaagatctatgtcactgaattttggttctgtatttgtatctcagcttcccggaaataaaaaagaattctaacattcatactttcagtattttatgtgacaggttttgttgtcaaaatcaagtctgagagcaatgtttattggggcctttaattggagtcaccaagcgataaaggggacattgttttcaacaataaccctataataaacacgttttggacaataaatatataacagtttcttaaaagcaatttcttgggcaatcaagacaatatggcttgagtatggagttatatgatggtctggattaatccagtattaaatctctggttattacagaaatcaatggagcctattcttccaaataatccttaaatgttacttatctcaactgagattttggtgaaaatttagctttagagcttttattgacctgccaatgacctgaagttaagattattcttttccaccgaatgaagacaaaccacctcataaaaattaacccagaaggctgtagaggtgatttgttttcttcatttctgatgacagttaaatagcttgactaaaactcttggttccctaaatggcttttctgcttttggatggtggtagcctggggaacgtaaggaaagcagatgtctcccaaaactgggaataaaatacatggtttattccaatacattcaaggaaaccccatttccaagctctttaaactaaaacattactgtaaacatgttggcctaaaatttttcagagctagaaattttcagagcaatagctgccagttgccaccatgttaggaaattctcattaattcttacatgacagttgtctacatagagatgaaacacttgactaaattgtcagcagcacaattgtgtccacacagacagatagaacaaatccaatgctgtgatgtagtttaaatgtgcacatattaactgattagagagctagaaaatggagggtatttttagcagcatatgataaatatatttctgactgcgttgaatattttttaactgctttgttctagttactggggattatatagtaggaagtaatacagacagatgtcacgtcctgatgggccttgtatttcagggatgaaatgggattttgttggcaccaagacctgattgctttgccagttaccctcacccctggctcatggggaaagagtattgaggagattctcgaggaaccacatgagtttcaatatcataagcttctgccctgaattgaaaggtaattttttgttgaggagggctgagtcacacttatccacaatgcctcctttggcatagaccccagataacccaaagtgtgttctctcaaacagatggagaaaattagaggatagaaaatatcaagagtgttactgaggatgctgccagctgaaccaccatttatgtttttcatagaacaaaacttcaaggggtttaagtagtcagagtgtggccagcttttccttggaagtatttatgcaaggaagatgttttatattctggaagagggcatatgtgaagggcatttcagaatgatgtaaggtgtatgcacaggtcatgtgatggagtggtctggggtagcaggacatgtgacaggcctcgaagttcaccactacaagcatggagcccatatccacaacatcttaaagcgcagaagctgggctgtggggtggagtagttcatgccaaaaatcacaacttggtttggaaaatgagagggaagagaaacttccctaaagagaattagaaaaagtaaaactcgtgaggtaaagctgtatagatttgaaataataaatccttacaatttttacttccactggtcgatggcagggtttcttaatcttagcagtcttaaccttttgagtcagataatttttaattcttcttgcagaggagaagagagggtacaggctgttctgtgcaagatggcatgcttagcagcatccatagcctgtactcactaagtgccagtagcaacctccagttttgacaacccaagatgtctccagacattttcttccctggaggcaaaaacagccctggttgggaagcactggtttatgaatagaaataaaactgtagtgttctccagccaaacaaacaacaacaaaattaaacagcatattttcaatttattgccttccttggctagtacataacccactataattaaagcttccaatcagaaattcttcctcggttaaaaaaaaaaaagctatcaagagaagcaatttagtaagctgggttttaggaatatgctgttaattttgcctaaaatgtggcatgcaaggggagagttatgtaataattttaagtaaataagtgtttcattaaaaaaaaaacccttaaaatggtttgattcaaaaatactgaaatgtcttatcatagacgcataaatctaaatagtttggttatttaaatataacttactttgaaattatcaaggaacatagctaatcgaacctatcattctagcctacatcatcctgtgcatttcacaaaatcctaatgaaaaactacacgaagctcaaagtatagataaacatatcagtgttgacaacggtgaaaccacactatccaaaggctacgagctctgaggaattcctgttagctacagcacatgtaggatcaatgaaggaagaaaatgaaggctcctgggagacaaaattatgccaggacaaagctgaagaagagcaacacctgtcggaaatgtcctaagataaatttcgaaaggtgccaggcttggaggtggggcaggcaccgccggaagagacaccttccctttggggctttctttgcctgtgacaagaacagcacttgatgcccttagaatagttcctggaacttctgaataaatatctgcgaaatggctgaatcaggggtggggactggcgttcaggtgggggacccctcaatagtatgaccacaacggaggctccacctggcagggagctgctgactcctgatgctacaggagctcgtctctgtattaggaggtcctgttccacttccagttgcaaatattacatatatttgtgtgtgtgagtgcaaatatattaatatatatacacaaccgcccaagttccccttgccccctgcctagacagagctgatttatcaagacaggggaattgcaatagagaaagagtcattcttgcagagccagctgggcgggagactggagttttattattgctcaaatcagtctccccgagcgtttggggatcagagtttttaaggataatatggcatggtctcaggaagtggggagtgctgattggtcaggttggagatggaatcacagggggatcaaagtgaggttttcttgctgccttctgttcctgggtgggatggcagaactggctgagccacattaccggtttgagtggtgttgatggccgcagcggcccatctggagaggctgctgccaagatgccggctgcagcaggggaggcgccgcagggagcgctttgtggagcccgcgggagccctggctgcttctgagctggtggggagggagccctgcagtcccaggcgcaagggcagctgcccagccatggcttcggacccgggcatccctgtcctcttgggagggggttgggggtggtggggagggggttgggggtggtgggggggcaggggaagcctatattagaccaaataaatatcatgatatattttatgtgtttattttttaacccataccaatccaagctagattttcttactgatttattttgcttgtttattaatcttattatgtagaatatattttggaagttgccttaacagtttttagaggaaaacaggataaaaataaataaatatataaaagatgccagttttccttatatgtatatgtaatggtgtaaaaaaagcactaaataaaatgatcagtatagtggctagggaaataattacagttaggtttttgggccaggcgaggtggctcacgcctgtaatcccagcactatgggaggccgaggctggtggatcacctgaggtcaggagttcgagaccagcctggccaacatagtgaaaccccgtctctactaaaaataccaaaattagctgggtgtggtggcaggtgcctgtaatcccagctactcaggaggctgaggcaggagaatcgcttgaacctgggaggcagaggttgcagtgagcagagatcgcaccattgcactccagcctgggtgacagaatgagactgtgtctcaaataaataaataaataaataaataaataaataaatgaaataaagttaggttttgaatgaattgagattataaaaatatatttcagaaaaggatgcagcaaatatcttttgaaaatgcaagggcagaggtatttctggcagaagtaatgatatgagacatttactacaatatcgtttctacttatgctcctgtagtttactaaaggcaattattgtttcattggaaatgtaattaatgaacatgaacctcagtaccatagattgggagccatgagtctggccctgggctgactgtggttggactcactcaggaaccgtcttggctagtctcttttaaataactgctgccagctactgccagaagttgcaggatgggaggaaaggaagctgactggcccagctgatccataaacagccctttaatagcactgcagttgcttgtgatgcatgcctgggattctaggtttgtgtctttcttttgtgaggggtttctgtctcaccctcaacactgttctttgcatcgttcaggctacacatcccagtgtgttcccatctcctgccctctagtctgctgaaggttttgcatcctgttctcagcatggacacatatcttctcttttgtccatcacatggtcatttcaataggatgttggtagaataggaagaagatgcacatgtgtttaactaatcatttttaattagaaagccagaggttgaattgaaaaacaactcatattgaaactgcatttgcaataattataacagtgagaaaattatggcagtggggaagatctaatatagccaacttccctcttatattttaccttcatgttgccttaattattaccaggcttaggatgggctagctttgggagacatgtagtttacagtttaaatgataatattccttctccaaaacttaatcacctttataaagctaatgagagacaaccaggctaggaggagaagagcctgaattcggcaaaggtgtagacataaaagactgccagccattattccagaggtcacgagatatgcaacttttccaattactcctgcagataacatcacgactgtagaacccaagattggccttttgagatagcctttcagatattttgcgtgtttggcaccaattatggtgccttctgaacccaccaactgctcatgtggccccatacagaagcagaagccattcagcacagagcaggatcttttcccatgttaagattgcaccccccaagcaatcagcagaaagcatccattgcctagccaccctcatcacttcccccaaattacctctgaaagaacccgaacctacaagcttttgatgagtttgatttaataactccacctcctgtgtggtgtggctggcttcgcatcaattaaattcttcctttactgcaatgccctggtctctgtgaattgatttttttttgtgcagcaggcgggaagaacccatcaggaggttacagtatggttgttgaacttttcaatttatggagttttaaaatataattaccaatatgtgtcttcataaaatacttttacactatgacactatacaatatttttattagatcttatttgttatttatgatttttcatcctaatttttaaaactatgatttttattagacttttatttacaatttttattatgaaaattttcaaacatacatggaagtagagacaaaagtaataaaacccaatgtattccttacactctacttcaataattataaatatatggagtagtcttaaaatttcatatatatccctcccacaaacacacactcaagcataattttagcacaaaccccagacatcatattatatcattttaaaatatatagctatgtatctttaagggaaaggacttttaaaatacatgatagtagtaccattaacacaactaaataaattaacagtaattccttaatatcatctaatgtttggtgttcaggttttcatgattgtctcacagatctctttttcagtgagaatccaaacaagtccacgcacactgcatttggttgacagaggtttttgacagagcaggagcatcgccatcatggacaagtaccaccattctaaagttccccttgatccacctaaaaaccacctaaatccaaagggcatcagcctaatggctaaggtcagcatgaccataaaccacaaatgacatgtccaaccagaaacattccaaccataggataaacccctccctgaccagagacatgccagcccccagataacctcccctccagctggagagatgtcagccccaagaaaacctcccctctgaccatagacattccaaacccgccatgagcttctcccccatacagaaacattccaagcctgtgataagctctctcaccaataaatactcttactctggaagagagagtgttcctaaccgaaatcggccagaagcccctctcaggtttattctccaaaataaacctgtctttgactcttaagccacttttcatgtttctttcctctttctttaactttaacagttttaattgatcacaatatcttcttcccacctgactccatgtatttgcagaaaaaactaggtcattcgcctgtagaatttcccacattttgtgtttggcttagtgcagccttatggtataatttaacacatataaactgatagttagaacaagaggttgatttaagttcttttagttttatattcttttggcaagaatacttcaaaggtggtgcagtgtgcttcctattgaatcatattcagaggcatgtaatgttggattttctttctcttatcagacttcttaattttagttgttccagtacataaaaattagtatgttatcatggtctgtgattactaatcatttaagagtttatggggatgtaagttacttgctcctgctttgctgtctgccacgagtaaaagccccctgaagactccccagaagcagatgctgccatgcttcctgtacagcctgtggaacgtcattgaaattataagactatcattcaaatggaagcattacagttctttggaaacattattatttcaaaatgaaggagaatgatacagatacactggctgaggtgttttgaggtgcattgaaatgttccaagctgttatttaccttaacatgttcttgaggtaccatggcatggattaaaaggaaatttggtaagtggcctccatttaaacgacttactagggaagctatgtgaaattatttaaaagggtaaggggatcaaatagtacttagccttcatgcaaaagttgtacagaagtcatatggaaatgaaaaaaggtttttttgccctcccccttgtgtatatcttatgggcagtggatggaagaaaataaaataacaaatgaaatgcgatggttgttctgaacaagggtctcaaccaagtgcatttattggcataggaaatagtgaccaagaaatgcagcagctaaacttggaaggaaagaactattgcacagccaaaacattgtacatatctgatttagacaagcaaaagcacttcatgttgtctgtaaaggtgttctgtggcaacagtgatgacattggtgtgttcctcagcaagtcgtccaaaccttccaaaaagaagcagtcattgaaaaatgctgacttatgcattgcctcaggaaaaaaggtggctctgtttaatcgactactatcccagacagttagtaccagatacttgcacgtagaaagaggtaattttcatgctagttcacagcaatggggagcattttacattattcttggatgatgatggatcagaaggagaagaattcacagtctgagatggctacattcattatggacaaacagtcaaacttgtgtgctcagttactggcatggcactcccaagattgataattaggaaagttgataagcagaccacattattggatgcagatgatcctgtgtcacaactccataaatgtgcatttgaccttgaggatacagaaagaaagtacttatgcctttctcaagaaagaataattcaatttcaggccactccatgcccaaaagaaccaaataaagagaagataaatgatggtgcttcctgggcaatcattagcacacataaggcgaagcatacattttacgagagagtgggccctgtccttgccctggtcatgcctccgcctgtcgtagagagccttaagttgaatggcggtggggacgaaccaatgcttgaacttacaggacagaatttcactccaaatttacaagtgtggtttggggatgtagaagctgaagctatgtacaggtgtggagagagtatgctcgtgttgtcccagacgtttctgcattctgagaaggttggagataggtccagcaaccaatacaggtttcagtaactttggtccgaaatgatggaatcatatattccaccagccttacctttacctacacaccagaagcagggccgcggccacattgcagtgtagcaggtgccatccttcaagccagttcaagccacgtgccccctaatgaattaaacacaaacagcgacagaagttacacaaacgccagcacaaattcaaccagtgtcacatcatctacaccaacagtggtatcctaactaccgtctttttgctaagacttaaacggacttgagtgcagcaaaaagttgacaaaaaaggagaaaaaaatgaacagtcttttgtggtttattgggaaaacttttcacaccaggtgatactattctaaaaccccactatctatctgcaagtgctgatttgaaatgcagaagccacagtaaaacaaaaaaacatcaaaatgtaaaaacttggaaattaattttttcagctgttttgttggttggttggttggttggttggttggttggtttttgtttggttttgtttaagtgggcaagaagtaaataatgtggctggaatacaagttgaacaaactagaagacataaatctaacatagtttttatggaccaagtaacttgtatattgtataagctttagtaaaaggtacattttcacatattcaccatacccttttttatatcatggtattatagtacatcttgtcaccaaagaggttgttctcttccccactcacctttgagcttttgctttaaaatacattcaggttccaagcctggccatgcttgcttaatctaattatcatgttcttccaagtttttttttggtccgaggctagagcttttttttttttttccagctgaagtcttacgacttttcgtgagtcaaaattgtttggatttcagcaagtcaaatcttgtgaaggcctacatttttttttaagattatgtgaagtctgtgcaaaagctttaaaaagctgcctctgccttgcctgcaacacatgcaatgtatgttaacttagtctctcttcgcagacactgttggtagttatttctgcattttcctttttttaaaaaaaagtatttctagtggttatccaagaggttctaacattcacatgcaatttggtgtggccattttgccataaatgagttaatagcgcagaacatgttgatatttgaagtgttctctctccttttcccataacgtaaatacattatgtgtgttccaggatttgttcaggtttttccccgctcctgatcttgtacataacttgtattacgtataagttaaacatttcattttgaacttggaatgttcccagtgatttcatccagcagagtattttctgccttgttggcaagtgacaaaaaatatcatgagaagcatctgctaccagttgggagatggtgcccttatggtagaatgaggaagatctcagcaaaagcatgttttattaactttactttttgggggtgttggagggggtagcctaggccagaacatcattgtaatcttaaaacataagatgcttttattagatgatcaactaaaatagctggaagacagtactttagaaacagatagttgtaagattatgaaatgcaaatgtaacttgtgtttttatttttcttttccctgccttttttgtttgttttctcttctccagtactgagcatctccacaaatgtctcctaactcagaaaatgtttcttttcctttcagctgagatttggttgcattcagggttgtacattggccttgcatgcgaaactcggcagttgtaccttgctttcattcctgaacttcgcttagcttttgttcggattcttcgaaattgcagcagactctttgggctacatttagtacaagaaccacgtgcataatatgatacggcacagtctagtaatacaatcatccttcttagagtaaaaactacctctagattgtggtaagcttttactgtcccataaaacaggagccacggtaatttatgaatgcaaaactgtaacttcctgcagtgtttccatacagaacattgtctttctggtttcctgggctattttgaaaaaattttcattaatagacttttcagaaattattattagtagcatttttttccagctttgctgttttcatcactcattctttgctcagactccagcattcagtaccgtgttggtccagatgtaggtttatatgctcatttttagcttatttcttgtaccttgcagcacactctacgcactcagcccttaaggggtttactttacaaactgtgtgcctgtaagatgtattagcaataagatagaaaattgagcaagtttataccataattttgtagaaaaaaagaatctgctcaattccatatttcatccatgaaaaacttgcaatacgagcagtttcaagcaataagaagaaaaaaaaaaagagtttataggtcggccaggtctgatggctcacgctcgtaatcccagcactttgggaggccgaggccagcggatcacttgaggtcagttcgagaccagcctggctgacatggtggaacccctgtctctactaaaaacaaaaacaaaaacagaaacaaaaattagccaggtgtggtggtgtgtgcctgtagtcctagctactcgagagcctgaggcatgagaattgcttgaacctgggaggtggaggttgcagtaagccgaacttgtgccactgtactccagcctgggtgacagagtgacactcggtctcaaaaaaaaaaaaaaaattttatgggtcatttgtggtttatttatttctgcaaaatgtccattcccatctttagcccacttttaattgggtgattttttttagtaagaaaaactttatatattaaacattgatttttaaattatttactatatccaatcaacagctttctttaagaactctctaatgcaaaatagaagagtggtagaagctgagtacaaaaaggaaaaaattctaattaattaaatgtatctttgattaacagaaaaataatataagctacaataatattgttatttcagaattccccagttacaaagtaacagtaagaagatggtgatctacaaaactttacttgtgacataattctagtgtagtttatttaagaaatataaaagaaaatgattggattacaaaaaagattaatataatgatacatcagtattatgagtatctttcttaaataaataatattttctgaagacatggataataaaaaaggtagcacaataaaattatacagggacaacttattaaaataaataaacatgctcagttcattgtaatgaaataaaatttgttttctgaaaacaaatggaaagaaaataataaccatgttagcccagagaaaggaatacacttgaattatagatgaacaagggcatatactgtgtatgactatcatgtaaccatgaagaataggtcaagataagggaaaagcagcagaaacatcagttctcaggcagtggtgcctgagattattacagtgtgcccaattagtttatgtcacttttaaaaagtcatttaaataaatgtatttgtggaagaaaaaatatctgaacatcaggtatggtctgatccacaatgatccaacgatctgtcataactcattctaggagtattcttatacagtttgcaagagaaattacatgtggagctacagaggaacatttatcaaaattcataaagctatttaacctgaatgttacatagtacatagtgaccatcatacaatagtaaaaatacaatatctgatactatttttacaagctatgacgtaaacaatttaggctctttttaaaaaaataaaagaaatttgattacaactttatttcaagcattttcagttagacataggtttatatattttcactcaaaatggcaaaggaccttctgtaggtaaaatatattctgtgtttaaatgcttgcattctgaagtatgatttgccatgtacaagttcaggtaggacaatgaagctgctgtagcaaaatcctggctgatgatgaagactcggacacttttcatctttcatgcagccattcaatattttgtgtatttacatgaaggagaaaagaggggaggatacaaagagagccagtattctttttggatgaagcagcctaattccagagaatgagctttccattttgaactcaaagactgtggtccccaaattgaattcttaccagtccaaggagctgcctttggcctgtgaggcaacacttgatgatgaagtgagctaggaaagtgttaactgaactacagagatggctgcgtgcaaaacaagtttccaaacatgctcaggcccacgcagaggtgaggtgcagccagaactattagttaaaaataaatgccctcacggatgcagacatagagcttgtaggaagagtcaccgttctgggggcctgattgtagtttccaatacctgccttcaccactctctgactcttctatttttctgctttgtttaatttgagtccaaggatttcattagcaactttctgaaaatacaggaagacagtctcctgttttggctgagataaagtggctactaaaaccattttcctggcaaaaccataagtgtttttcaggttttactgtttccatgtgctccaaataaattttattgctcaccaaggcaaccagtagcaaagcttctgactcttcgctccctttcttcggtacaatgtacacatcttttttttttttttttttgagatggagtctcgctgtcgcccaggctggagtgcagtggcgcgatctcggcccactgcaagctccgcctcccggggttcacaccattctcctgtctcagcctcccgagtagctgggactacaggccccggccaccacgcccggctaatttttttttttgtatttttagtagagacagggtttcaccgtgttcgccagaatggtctcgatctcctgacctcgtgatccgcccgcctcggcctaccaaagtgctgggatgacagacatgagccaccgcgcctggccgtaccaatcttttaaattctccaagctttgctaatttgtaacaagaggattctctgtggtccatagataaatgcatccaccttcttgccgcgtattgtacgcaccccctacatcccatacttgaagagtaacattcaagtttcctggcaatgttatcccgctcaaaaaatatgtatatatattcatcactatagtttagttttattggttcccaaaagtttcttgagcaaaactcataggtcttccaggaggtgctgcttcaagcatgacaaatttcagttgccattcttggtttctttcttggggtctgatggagttcagtgtggtgctcaggctagctccccaggcagagggagaaggaaaggagagcgcctccgtaggtggggagagaaggaagggagcaggaccctgccctgggatctgggtgccctggagagatcaggggaaactagttgatgatacttttgttaaatgaaccagtactttcacatgcttttaagtaaaaatgaaatttaactggaaggacccaaatcaaacatggtatctcttgagttatctctcactatggatgacaaaggctgttgtcaaagttgatttcactcaattaacttgatggatattaaacaacctgtataagcccagaaaatgagggttctgggagatctgttattacagaaatgcagaggtgtcctaactcgtgttatgtgaaggtggccatgatgcagataaggacatggctatgaatgtgcaggctatagtttgccctgacctgggtccatgaccgtgccttgagggtggaagaaacaccagagcgccctcagataagatggctggagggcatgacaaaaaccatgaaagtaagaccagaccgtgcatgcaagatgaatgctggcatctggctgaatagaggaatttgaacaaacaaaatcctttttctgcaagctcttcacataattctactccacctggagcttcatggctgaaatgagtggttatctatattcaggtctagtcagacgtgctgattaattatagttgatcagcatacatatatcatgctttcttacatatttaatctatcccatgtatacataagattttgaaggataaattatttattagcattaaagtgtaaaatttgcttgataactataaaatgccttaaatacactagtatgagtttcgaaattataccaaaatgaccaatgtgaagggtagtgttactacactgggtatgtcctgccactacgtcctttaggagatttctatagcatcacaatgaagtccacctgtgtgtgagagagaggcttgcgctcgccttccttaccagcaatgcaaaagtgctcaggggacccagcttggtctgagtacgaaaacaaacctaagaggcttcaaagccagctctcctgtagtatgtgctcacatccctgaaagaaaagcaagaaaattccaaactccagattttctaatataagctctagtgaaatacttacctttcttgagtcaaagcagaagcaactgctaactagaaatgtcagcctgctgcctcagagaatttctatggctgttctggggtgaagagggtggagtctttggctttcttaccacaggtgatcaggtaagaaggaaccacagcatcctctatgaagaaatgctgtccgaggtgatacctggaatccaaagcttttctaaaggagacctgggaggggactccacacccatcaaccaatagcagcccagcccaaaggctgcaaatttgcttctttctgacacccagtggagaaacaatcaccagctcttttccagcgagtccagcactgtctgcaattggatttgctttagttgcaaggattgtaagctagttggtgtgtgtgtgtgtgtgtgtgtgtatgtgtgtgtgtaggtgaagtttgagacacctggtgttagtgtttctatccagttgtactaaaattggcatgaaatttcttatctagaatttcaagcctccagctgtgagccttattcagctatcattgatttcatcaccaaaaaagataaaaccaggaaatagaatgcgtgtgagagagtccaaatgattgtttcttttacccttaactaactccctttccttagcccctctcctgcacctactggttttctaaggtttattcccgcagtctttagtaaactaattttaaatgtgcgaatggggtgaccaggttagagactcccagggaagaaccatgctatgtatcccactaataagttctccttatggagctaaagtctttcactggagctgtttccagtgtaacttgatgtagcatttgggatagtctcatcgtggagcaccaccactatcccagttggccgatacctgtttcttctaagaggagaatcaggtaagttttcccaaagcgccttagggaaatcgtgccattcagagagctgcgttgtgctcatgcatctggaaggtcttgctgttcatgcactgactcttctaactccatatcctccattcctgggtgtttgccagcaggatggaatgatggctcactgaaaactgaagaagacatggaagacaaaaagggagatgagaaagtcctgcccattaatgataggaagatgggcacaatgcggtgacctcacaggtctccctgtctcagctcagctctgatgaagaggctcatgtcatacagtctcttcagatgatcacagagaaaaacgtggtgacagagaggcagatgttttactgtttccacttctggaacttgttgcagggtatgaagagggtcagcaccagagaagatacagaatatcatgtctgcaatggatgaagccatcaaaggatggcttcacttcaccaccaggcagcactgaccaacttatggcaataaatcccgcagaccagaattgcacccatcaaatgcctcactcaccatatgtcagcccagaagactcttgcagtggtgagccagtctctttatccaccaagcctgacccagcaggcaggagaggcccagtaccaagatgatcatccacaataacctgcacactgcattgaggatggaggccagccctaacagcccgcagccctcaggagggagaggcagtaaagggctccttctctctttgtcctgatgaatgggcattgcactagaaagatgaacattaggagcagattatcagagcctcggtccagccaccatctcctctatgatgacccagatgggcaaaccttctgaaggcaaaggtccaaccaacatcctgggtggctggcattttctgaatttctatagctcatcacaaagtgcagcaggaatgggagtatttggtgcactttgattttgcagttgcctctgatggccaagagtcttagggccaaagatttctcctgacccaaggtccaggtcatatttctgcagcacagctgtgaccctcatcccaactacagccactggcacaatctccagtaatatttgcaaatgattatactcacatcaggttataaaagcttgttgtttttaatttgagttatatttttaaaatacaaaaatgtcttgttttttatgtttgtgttcatgtggtacattttccaggataagatgggctgtgcggtaatggcaaataaaccctccaaatctcagtggctggcctcctctaagtttatttcttgctcacggggtctgccgtgagaccagagtctctccagagcaactccccttccacccctgcccaggaaatagaacatgtgcgtaactgagagacaaatcatgtagaaaaacaaggtgattttcctagagaaggactgaagtgctttgctagtattagtcactatgataaaaagtagagaagaactattctatttctttaaccatctaagagacagaccattcacttggagtgaaatatttaaactatttcttcatctcttgaattaaaagaccttaataatatgaattcataactcgaatatagataataaacccagcacagtttggcacaacaatttgtatttcctcttgaaataccaaggctattttctcatgtaaattatatacgtatctatatacatattttcaaggactgaaattaattttaacatctttaaaacaccaaatagtatcacattacctgtaaaatggctggttacctcaaaggcagcattttaacatccttagctgctttaaaagattatcagcagtctatagcaaatattacatgagacatttaaagaatggtgcttcatttcatcatttaaaaatcttagtcaagaagagacaagaacaatttcttagaatcaaagctccttcattgggaaatcattcatcttggaaaaagcagaaatattttggctaataaaaaacattttattactaaattaacattgaagaagttgtaaaaatctcattttgctttaatttgttaaagtcaaagccttatatgcacctttgatttttataaaattttaactctttgaaaataaaatattaagcatcaaaagtaaatagaaaaaattaaaaataaaatgaaaaccaatgaaatggaacacagaccaataataaaatctgtgctgccaaaagctgatgctttgaaaagattattaaaaactgcaaaacacctagcaaaaggaaaacatcaccaatatcaagaatataaaatgggacattattatagaccctagagatactacaaggattataataatatgtatgctgaacaacttgaaggcaagaaatttgacaatttaaatgaaaagcatgcatttcaatttcttatggtatagttacttgcaactctggagagcccacataattcatatagtagccatcttctagctttgtgggttctctgtaaaaaagaaactggaagagtcacagtaaacgaacgacatatactttccacccttacatgagtagagaataatctgctagagcaaatgggctgggtgtgggggctcacacctgtattcccagcactttgggagtccgaggtgggtggatcacctgaggtcaggagttcgagatcagcctgttcaatatggtgaacccccatctctacgaaaaatacaaaaattagcctggcgtggtggcaggcacctgtaatcccagctactcgggaggctgaggcaggagaattgcttgaacccaggaggcagaagttgcagtgagccgagatggacccattgcaatccagcctggaaaacaagagggaaactctgtttcaaaagaaagaaaagaaaagagaaaagaaaacaaaaagaatctccaaatgctcaaataaactctatataatttaaatgtgttttaattttctcttactgttaggaaattgatattttaagagaaaacaactagtcagtgattgtttccaggagaactccattttgtggaagctcctctgagacctaaaccctttaggggagctcctgggagagcctgagcttctcctgattcaggtcccctttgtgtgttcactaagagtctgctctttgccgagttttgtaacaaggttgttgaaaatggaagagtattttcagccgtgagcttactttgcaacattcagctttctttagagtttcaggaagttcgtaattgtcttataatgaacaagaactttcctataagaagaactacaaagcatgccattcagaaaataggtaatagaccttaatcccaggaatactaaatattttaggaagtctctaggttcagaaaaacccaggggccctgtggactgaatgccaacctcccctccctcccccctgcccccccgacccccaacccctctaacctccacagtgagctccctgctttcaggctcaaccttctaaagttctctttcctggctggatgagtctcccatgaagccccttccatctctccactgctcagagctctccagaactcacattgtgatttaaatccagggtttacttactagtctttacttactagtcaaagccccacatgcttgccctgaaatccctctagttatttagtgttagaaactcaccactaggaccattattttgctgttagatctatttttgggggaaatgcctaatgtcaggatttttttttttttgaaagagtctcgctcagtcaccaggctggagtgcagtggcgcgatctcggctcactgcaaccttcacctcccgggttcaagtgattctcctgcctcagcctcccgagtagctaggactacaggcacgtgccactatgcccaactaattattgtatttttagtagagacggggtttcaccatgttggccaggatggtctcgatttcttgacctcgtgatccgcccacttcagcctcccaaagtgctgggattataggcgtgagccactgtgccagaacaatgtcaggattttttggcttatctttactgacctggtctaatccccacagatgaatatttattgatttatttttttctctttttggaggaaggaagccctgttgtcagcatcctaaaagctagaaatgagaaaagctgggaatctcaattttcagtgtgtgctttgttttcaatattgtaccctttcctcaattggtctcagtggtctccagtccagagactctctgttttatcctctacggaaaatgaacattttgtcctttatacagaaatggacatgtggggccgtcttcaaccactcctaaaacactaaaacagacattcaataaatcctgtttccagccccacttaatcctccaagttacataactgcagattgcagcgctcacatagggaaccctgtgagcagcctcctttgaagctggtcatccctccagccttattcccccacactctcaacggtattgtaactaaggacctcagtttttaaaatatacttcagtcatccactctctttatcttccttcctgccgctctcacaccttgattaaaaccattttttccttccacccatccatgtctcttgactctggcttttaggtggcaagctgctggacttaggaccagatacagtatcgtatgtcatgagcctttggggagctcttcagtttacaacttggtggctcaaagatttcctttctactgctttagacagctttttggggggatgtgttttccgaaatcagctgctctttccgtatagaaccatacattgagattacatgagtggctgtgatgtctaatgtagcagaacatttgattctctttgtctatattgtttatagaaaaacatctcttctcattgatatgtttctttccccttccatctctgttactgtactaaccattaccagatctttaacaataaatttaggattttaaaatatatttgtggcaggaattactgtctgcctctagaggtaacatttgagtgaactgtcttattgtcattggcaacttccttcagatcatgccactgcattacagactggtcgacaagagtaagactgtctcaagaaaaaaattaaaaagattaaaaaaaaaaaagaaacctttctgaggtaataattggagacactggcaaagacatgtgacagagttttcactttcttttattacaaggtcaaagtatagaaatacctaaatattgaaccatggagagatgattgaattgtacaatattcctatgtatggctgattgattcagttagaactttactcacatattgaacttcaaaattttcactcccccgaccaatgctttttagccttctattttactttgcttcttaacactcatcactgtctaatatactatatttttcttgtttatggtctgcctttcccagaatagaatcttcatgaaggcagagatttttgtttttatttcgttcattcatctagctccagtaattagaaaactatactgcacatggtaacaactcgctaaatatatgttgaatgagtcatcaatgcttttctcttaacttaatgacatgggaaaatgtccataaagtatacaataaaatatgcagactcagaacataaaaaatatacacacactctcacacacacacacacacgacaaaatcttgacttcagggtgttctgctgaacttcagttgttcttgacttccacatgtggaggtggagcatctttgttaagtttataagtaatatgtttttttttgtttatgaaatgccaggttatatgtttcctttgtccagttttgtattcgtttctcttctgatttgtataaattcttcatattccataaacactactcctttttcataggtgttgcaaatcatcttctttccactaatggcttctattccctttttataaagtcttttgataaactaaaatgttaatattattgttgtaaaatgaaccaatgttttacttcatagttttgtgttttgggtatgaaatccttgtccactggaaggtataaactacttcttcatattttctgaattttaaagttttttattttttattttaactcattagaaattacgtttgtttttttgtgtccagtgacaggtaggggtccaattttatattttttctcatctgtaactaatgtcccagtaccattaatatttagagttgcccattctttcccaatggacctgaagcagaagatctcatgcactgggttcccttataattcggctatttctacattttgagctgtttgtctttcttatataactctgtagtcatgtaagtagtcttatgtatggagtctcccttctgatggagttacctaccccactgatttttttttaggctttctctttactaataaatgtatttacaaatacaaaccaccttctaaagaatgctttagttgcaccaaacatatacaagctttgatatgtagtgtttttattgccattctgttctaaacataacttcattttcttatttcaaatgtatttttaaatttcgcaaagtatagtatcttgcgatcttctggttaacaaaatctatgttgtcaaattgtggtctaagaatatgatcatattaattattattattactatttttttttgagatggagtctcactctattgccaggctggagtgcaatggtgccatctcagctcactgcaacctctgcctcctgggttcaagcaattctcctgcctcagcctcccgagtagctgggattacaggcacgtgtcaccacacccagctaatttttgtatttttagtagagacagggtttcaccatgttggccaggatggtctcgatttcctgacctcgtgttctgaccacctagccctcccaaagttctgggattacaggcgtgagccactgcacctggcccgatgattattatttattgatacttgctgtggcctagtacactgcaatttttataagtgtttcatatcaacttgaaaggaaagcattttttgtcatttttgagtattatggtctgttactacccttttcataaaattttcataaatagtgttttcaaatatccttattttgagattttgtttttggtttattgctcaaccagtatctgagggaagtattatttaattgtggcaaaatacaacataaaatgacaattttaaccatttttaaatacaattcagtagtgttaagtgtattcgcattcagaacacaaccagtctccacaactttttcatcttgtgaaacagaaactacatccattaaataacttgtcccctccccacagtgagagaggtattttaaactgtctctctggaatatctgttcacttatcatgattttgtcaacttttacatcatatgtattgaggctttttatatgcataaaggtgaactttattattacttcttactttataataatgtattattttaagcattttaagtacttacaaagctgattatgtatatttagtctctaaatacctgcaaggaataagtatagtgctttatttctaaggagaaatttctgttttcacctagagaatagcaaagttccctatcctttctctctttaaaaaaatcagtctactgtttgaatgtgccctattttctatgtgctggctgggtgcaggcatctctattcccattcattatatcacaaaggtcaaaggctttatctctgatatctgcaatgctatcaacaccccaaactctaaatacagagaatggaaaggagaattgttatgtattatctagtgtctctaggtgtttctaattacaaaagttgggtgttgttgttaattatcttagccagccaactggatgaattgggatgtctccatgacataatattaatctgaaaaaatacagtttgtcgatagcatttactcagtgattccagaaatgtatactgtgagcccaccatgcacatgcttatggaagtccataaatcattctgtccacttgaagcatcatggttcatacatttgggaagagggctctatttctaaagcaggttaccacaacctgcaggcaggacgcagaaactctgaacctctgaactgagcagaaaataagtgtttccagggagggaggaataagaaaggctaacgtgtatgtaacatgtgtcccatgttcactttggggtggagacatagcatttaaatgtatttcagttaggccttgtacatcaaaaggtgaagtggaggatatgaaggcgcttagtacacagcctttgtagaccagccagagccatgctgtggtgggtggtctcttattgggaaggaatgctggtcagtttctgtgttaaagctgcaagagggaggacaagtgtcaggcagttggttgaaatcactgggcaagacttttgaaagggctggtttctgccttcacccttagggaagaaagcctaatggtggttagccattctctagagaaaccttaaaaacctctggttcctttgaccaagaggaagtctgttcagtcaagtggggggcttaggattctctttatttctcaatatataagtcctgcactcatggcctagcatgatctagcaaggattcagtgtgattccactaatgacaatttatttagtcctaagtccatgtgtatggacatgtaaatacatggaagactgctcagcaaaatattggttctgtttatctttgatatcttggtggtagtttcttggtggtaggtagtttcttcttcatgtctttccaaattatttttattttgagggttgtatataaagagaatattataagcaaaccaaaaaatgcaaatagtatatatataaaatgaaaaataattcaaaatatttaattgctcatgatgtcataaaatggtagactctcagtgagtgcatatatttccttaacatgaagttattaacatatggtcagcattttcatttcaacttaatgtagtttatagttctcactatctaaattgacatttactttaaaatatagaaaaagacttctcagatgataataatggtaaggttaattatacataatggtcccattctttttttctgtgaaccaatatgtgaaatcaatgactatcttctctatgaaagttttaggtggcttagacaatgttcatgctttattagagtctcatctcgaatgggcaagagcctgcattgcttaggttagtactggacgtagtgaagtgatccatgccacatagatgcataaatcattttgaacagctgggcagtttcaggaggccaattaatcaagtggaaaccaggtgtagaggccaatgaaaagcttcccctttgccctctgaaggtttgctgaaaaatcaactcaaaaaaggtaaattaacaggagaaatggcatgcaagtttattagtgtgcacaaagagaatcacagagtgattgtcaataccttagtggggttcagaagcctgtataccatgttgcagaaggggaatctcagagaaagcctggctgtttatttcacctatatagattttctgcacagatgcaaatctactccacgaaagtcagcttttctgcactattcctgtctgctggccttctgaatagccacctcaagatacatcaaagaaatatgttttggggtgaaattttttggtttcctttagcaaaggaaaggtttgtatacctttactccttttgtatatcaggcacccagccactcgctattgcttacctgcaccccatcctcattccagagagttatttcctgcttatatatgtttccttgaactgccataacaaagtaccatagactaggtggcctcaaccacagaaatttattttctcatggttcagcaggctgggaagtccaaagttatgttgttttggccagttggtttctggtgagggatctcttcctgtcttgtagatggtcaccttctagctgtgttctcacatggccttctttaactgtatgtataaggagagagaaagagagagagagggagagagaacttcaacaatctgacccctgctttgagcctcatactttgcatatgactcccaaatccatatgcacattaataaatgtgtatgcctttaaaaaaatctgcctataatcagtttgttttataggcttcataaaaagccaccaatcctatcagattagggccccaacctaatctgatggggtgtaactttaattacctaatgtcactttaattacttccaaatgtagtctaaatgaattcaggtcatagcaattcagtccatagcttggcttaacctggtccgcagtcacaggtgaagccgagctatggactgaattgcagcccgtccgaattcatatgttaaatccctaacctacaatttgactgtatctccagtgtagccaaattggaggttagggatttaacctatgaattgggacgggctgcaattcaatccatagctcggcttcacctgtgactgcaggccagctctgacccaggtaaacagatagacttctctgtaattcagtaggataaaacaccttctccaataaagtcttaactacagctttggggaagggcttctctttccaagttcgttcttccttgagtaatcagctctagattaatttatagagttcactcatatcctatagttaatcttttatcatggcataattctttatattaaatttctgttgaaatcactctatggcttttatcttctgatttgacctacactgctacaagaacagacaagctgagaagcatgagcttgaaatataactgcccctggtgttaataattacatttttgtggaatgtatctgttataggactaggtattcattttaattatacttgtactttagttttatttaattatacttgtattatgattctgccatgtaaaatgtaagcctgtgaagaaaatcaaaatatttcacccccaaatatccttctttgacatcttttgagatggctgttcagagggtctgcaaatagaagtagccctgaaaagctgtctttcctcaggagggaggtttgcatccatagagaatctgccttgatacagccaggtttctctggggcccttcctcatctgagtctagtctgacacctttaaacttctcaaagaaacatttaccatctattttctgagagggctgctacctgtgaggtttcagctacataacaagaccagctttgctgccaggcctcctcttctctccctcccataacgtgtcccaccaccataacttgatttaccaccataacctggttttggccgtgctctgagctgccattctttctgtagcctcgaaatggcatacaaacttcaaccatctgaccctcgctttgagtttaatactttgtatgtgatacccaagcccatatgcatgttaataaatttgtatgccttttcttctgttaatctgcctattttcagtttgttttataggcttacattatcaaaacttcagggggaaaatgtaaacttccctgcaatgccagtgcagcacaaagcttagagcatatggtaaccctgacaggagggccgctgcatcggggggacctcacaagacaagtctggaaggtagggacaagcaggcagagggaatcagggtggcagtgtgggcaagagacctggaccacatagcgtctctctcaagagggctgcatgaaggtggtcactaggacaggctaggactgaggggtggtgtattttgaacatgtcgctggggcagaatgacgccagatgttctcatacccacactgctggcccgccatgcagcagctggaaagagcagaacagccttctttctgcttactggtatccttactggtaagcagaaatgcttaaagatgcctgtccattagtacagaacatatattgaagactgcatttggagatcagaggcaataaactgaaaactagcatgattctcttagtcacattttacataatagattctaataatttaagactttttttgtatgtgatttattgtagcccatgtgttacaaaggatctgagaattagacactttaattgtaatatattactaactttaatatggaatgttgttaccccatttatgggagtgaaatatgcttaaagaaacattacaatgtgtctaaagtaacttcttaaacttgcaaaaatcagagtggatatgccacataattgcactctagtgtgaaaatccagagatacaaagcaggtcagacaccacctgggataagctttcacctatcctccttttatgatcagaaattattttgcaaattttgcatttctacaaaattatcttaggttattatctaaattcaccatttaagattcaccattaaaaaaaatttctgggctgggcacaatggctcacagctgtaatcccagcactttgggaggctgagacgggcagatcatgaggtcaagagatcaagaccatcctggctaacacggtgaaaccccgtctctactaaaaatacaaaaaaatttagccgggcgtgatggcgggcgcctgtagtcccagctacatgggaggctgaggcaggagaatggcgtgaacctgggaggcggagcttgcagtgagcccagatggcgccactgcactccagcctgggtgacagaaagagactccgtcttaaaatataatataatataatataatataatataatataatataatataatataataatataatatagtataatacaatataatataaaaattaaaaattctgataccttctaagggaggaggatgtactatttgttctttaaattctcacggtatttccacattagagtccccaaatacaagagctctaatgagaaagtgactgctcagaaatttgggcagacgttttatcgttatgccttcatttctttcattgcttaataaactctaatggataatagtgaacacatttctatgtagtttctgatcaaacgattctgtgaaaatttagtcaaggaatcaagagaaagtacagtcatttctccaaaggagcatttcaacagacatttcatcaaaaacaaaatttaaaatggcaacctgtgtgaaacactttggcagaataataataataaataatttggatgcgagctgaatacatgaattattttactggggtggaggatatgggcattgcatgcttattacgtttttggtttgtattgccctacatgttctttaatgtcctagtgttttgacaaagacaggcataaaatgagcactaatattttagtttctgtcttcttttttttttttttttttgagacggagtttcgtgtctcacccaggctggtgcagtggcgcgatctcggctcactgcaaactctgcctcccgggttcatgccattctcctgcctcatcctcccgagtagctgggactacaggtgcccgccaccacgcccagctaattttttgtatttttagtagagacagggtttcaccgtgttagtcaggatggtctcgatctcctgacctcgtgatccgcccgcctcgacctcccaaagtgctgggattacaggcgtgagccaccgcgcccggcctagtttctgttttcttaaggaaatagaccagtcctttgcaaacacatgttttatttcctagtaaactcatctattgctacaactgtgcaatttaagggacaaatcattcttccttaatctccgttgatggcaattccatctggtgcccaagctaatgactttgggatcaccactcttcttctctcacactctacatccagtctggaaagaaatcttattggttctatcacacttacaaaacctatcaaaaaccctaccactgattaagaactccatcgtcaccaccctgatcaaagccatatttttctctttcctggaccaatttaacggcctctggaggaggactggcccctagatggcctcagcggacccagctttcttctccccttccccatttcctggcttgcagttttagaataactgtagaatgtgctaagaatgcagtatcttgatatatagaggaactttccagaaaagcctgggctttgtcctcattccttgtagaacgggatgtcctataatgcttttgctcagtgacccacccacgggatgccctcgagctaaaacccagagcggtgtgctttcagagtccttcagctgtagtgcaaagtggagcatgtgtagatgagtatatattctctttataccagaagtaagtatagtttcattcagtgaaagtcactgtccctaatctatacaatactcaaagtttaaaaaaaatactctatgttaaaaactgtgagcattgaaagctgacttatctattcagagatcacatatagtaaagggtattacagtataaaataccaagaaagcagatcagctgatgaaaattactgattttcaatgtctttttaatcattatatgacatcctgataagttttcctgaggaattaaatgcttctgggatcttaaagtacattttctacaaacaagtcatagtgttttcttaaaataagctatcaattaaagcaagaatgtggagtagatggcattggtagatacaatcaactaaaacattgtttttattttcactccagagtacggtgagcttatattcacaattagtaaaaggaagcagagctgattttctacaacttcttctgtttcttctctcaaaatcttcagagagaggaaaaggcaaaggaatgcagtattctcccatttaagtcaacattacaaatgcaattaaagggtgtataatattgctaaataagacctcatcatgatgtgtattctatgacagtttattttgactcctttaactgagcgttgtgtgagtttctttagtttatttgttagccactcggttacaaagatcaggatgtttttagctttttagacacaatatttgtcgaagctcttcttctcatactatacttttctaaaatgaatgtgaaagtattgaaatgtgttatcgactttccataaaattctcatttacttgagcctatgtaaacacctgactaaacacacggctattcactgtcaggactttctcctcagcatctgccacggaaaagattcgattgcacgcatacgaacccaatgccagcaccccaagggacagggcaatagaaatgggaggggaatgatcaagtcaatgaatgatacactccattaatcttaatgttaggacattaatattgcttggcaactgcctaaaatcaacaataagcgatcaaccaatttgttgcctaaaagttattgatttaaccatcaataacttaacagcataaccataacaataactttaattttactaactttaaataactacagttctttaacaataacaataacagcatatatgtacatcagttatgcattaaaagatggatattttttgtgtacatctgaatggagaatattagataatgtagaaagacatgagacaaagttgataatacaatcccttagagctttaataaatgagctctctcagtcaagccacagtaacgaccttttctctgtgatatgagccaggactctgcaggtgtacagaggagataaactgcaattataaagtacaattaacaggtagtagcggtctcatttattatacacacctacgcatgtttccaagccagatgatcactaagtattcacagcaagtaatcacccactggacaaaacagcattacttcaccttctgaaaaagtagtttctactactttgaaaagcttgttggtgatgagacgaaaactgaaataggttacaattctaatagacacacagtacaggtaacacaaagagtctttccttatttaacattcttaagcatcacccaaaataccaaaaagaaatacggtaagtttcaaggttttgcataaagtactacactgagcttttaaagtgaagggcttagtcacccaaatactgtcttaggccttatagtatctctcctgagttcccagtatataatttattataccaaacagatcattctccagagttcttttgatatttctagatctctctcaacttataacctaatcagctccctcaatcccacataggcctcaagctaatctcaatcactcttcttccattcatttttcattcacttatttacaaatatgtattttgcatgagttgtctgccagcactgatttaggggcagaaagaatatgatagtacctaagaaagaccctcattcttatgtctctttaaaggaagataaaaacttttaacaaggtaaatatttaaaaatactttaaaggagaccaggcgtggtgactcatgcctgtaatcctaacactttgggagggagaagtgggtggattgcttgaggtcaggagtttgagaccagcctgggcaaaatggtgaaacactgtctgaactagaaatacccacccctaaaaaaaattagccgggtgtggtggcacgtgcctgtaatccctgctacttgggaggctgaggcaggagactcacttgaacctgggaggcagaggttgcagtgagtggagatcatgccactgcactccagcctagttgacagagcaagactctatctcaaaaacaaaaaacaaagaaactttagaagacacaaaatgctataatagcagagagtgacaattgctacaaagaaaataaaatatgattatggaaaacaaatgaactggttgatccaactcctgtctgtgtccactgctaccattttggagtgagctcttgttaggtcaccactcacccaggctccagtgataccctaattggtttccttctgttaatggccttcattgttttttctgcagcgcattcagtctgtcaggttgggttctatagaagcagagcctgcaatagcaattattgagcaacttttcttgagagaataaccttatgagaggggaatagtaagtagggtgagacaagggtgagatctacctaagccaggatgatctcaacacaagactggctcagcctgacacccagagttttggagcatggattgcattacagagttggcctgacgttgaggctagaggaatagctctttataccatgtgtcagtcagtcactggctacaggttgtccaggtgaggcagctcccttaagtctggagaagtgctcaggagagaacagggcacttgtgagcccttagctaccaacaatagtatgggggggtgcaatgcagaggcctagtaaagtgggactgaatagagcagcaccctttaatttaaaagaagaagaaaatggatattgattagaaacacagcagcatctgccacagttagaaaaagcatgactatgtggtgtttctgtaagaacatgagagaatgtcagtgaagcacatcataacagtgattggagcatgagttctcagtcaatggcagttattttgattgtgacagagattgagatgtttataacttgaatagctggcactagaattcctattacagaagaattcctaacgttgaagtactagtttgatgagctgcttgggataaaattgaaacttcaaagttatgcccattggcaagagttaaatcagcaaagggggcaccaaaactatcttgtgtgagaaaaggagaccaatttagtttttgctcctgagaagagaaaagacagaagagaagggaggggaaggagggagatgcaggaaggagagccagggtcatgccagaaaagctcagagggaattagctggccaagcagtggggaattaacttttaaagaatataaggcttggcctgggtgcagtggctcacacctgtaatcccggcactttgggaggccgaggcgggtggatcacctgaggttgggagttcgagaccagcctgaccaacgtgaagaaaccccatctctactaaaaatacaaaattagccagatgtaatggcacatgcttgtaatcccggctactcaggaggctgaggcaggagaatagcttcaacccgggaggtggaggttgtggtgagccaagattgcgccactgcactccagcctgggcaacaagagtgaaactccatctcaaaaaaaggaaaacaaaacaaaaaaaaaaaaaaaaaagaaagaatataaggcttatgtttacagtaatttttgttacacctccatatcttctgtaaggttattgaaaataaactaatgggttatatgtatatgtgtctttttttggtgaaaattgagggagaaaataaatcttatttatgagttaggatgtttgaatcatagagaaagaataatctataaagtgaagaagttggaattctcagccagaggtgactgtactatctggaatatcctgagaaacagaaccaatagcagagacagagggagagcgagaaagacttactatagctaattagcttatgtaattctggaggctgagaagtcaagtttgcagttggcaagctggagacccaggagagccaatgggagagttccagtctgagtctgaaggcctgagcaccacgagagtcaatggtgaaagttccagtctgaaaactggcaggctcaaaatccaagaagagccaatatttcagtttagtctgaagacaagaaaaaagtcatgacccagttcaaacagccaggcaggagttttctctttcttactggaaggtcagagtaattttagttctattcaggccttcaactgattgagtaagggctactcacattagggagagaagctcgctttactcagtctactgattcaaatgttaatttcatccaaaagcgccatcacagacatagctgggataacgtttcattaaatatctgggcacctcatgacatcgtcaaatttccacatgaaattattcatcacaactccacctcttgtcaacttggcatccatgcacatctccttaaactatacttaatctctaaataaagaaaatagcaaggccatgcttctgtctaatatatcatcatcccatgtacaactgaagacacacctaccccttccccagaaaaggaggtataatcctcgaatgatgtttacttttctccttgatatcctgtaacttaaatgttataatataaaatcaacaacacttaaatgcaatgatatagtcaatacctcctacattaaattataagggaataagacagcagaaaaacaataatatttgcttaatgcacccacacacatttgcatgtattcataacaaaaaaggaggaaatgctgataacaatttcaatcttgatttctgtaagtggtcatgtggtcatagctggtatttctagctaccttcttccactaagcacctcacttcttccactaagcacctcacttcttccactaagcacctcagctggtcgtgattatttccttgttgggatgacccaaggcttcattcctgaagggtctgggccattagttgtcctgcctggattaggtggttgtcattttccattgaccataagtacagaatattataatcccaaggacaccctaagggtatatatattgcagacacacccttccttatctccatttggaagtacgagtccaagttccccttgccagttaagatcaataaccagaactagcccagtaactctcttccttgcctattgatttacaggcatgaggaatccaaagccactgggtaacagttttaatttccagttctaaaaaggcactgttgtgtctcttggaggaagcaatccttcatttgaaacagacttctaggccagcagatcataaagttgtagaatcaagaggcaaacattttgctagtaggtcactaggaataaccgtgagtgagaccactcccactttcttcccttgattcctggacctgtgaattctgccttttggagaaacagcatcatattttggatgctgatttaaagcatacagactcctgaggattctttccccagctcagtactgccacctggctgacactgtaactgagtctgcaaaaggccatttcatcattctaccaaaccagctacttcaggatggtagaaaacatagtaaagtcggtgaattccacgaacatggacccattgctgcacttcttttgctgttaactgaattccctgatcagaaacactgctgtatggaaaacaatgactgtggttaaagcattccgtaagcccatggatggtagcttgggtagaaacattgcatgtagggaaggcaattctatatccagagtgtctattccagtaagaataaaacactgccctttccatgatgaaagtggcccaatgtaatcaatctgtcaccaggtagctggcttattaccccaggtgcatatcaaggattcagagttggtctgtgttgcaggcatactgggccctcacagtggccatggccaggttggccttggtgagtgggagtccatgtaggctaagtctccatcctgccactatggatactttgttcctaagtctactgggagatgacagaagtggctggcgaaagaggctgataggtatccacagaatgggtcatcctatccacttgatttttaaaattcttctctgctgaggtcatcctttggtgagcacccacatgggacacaaatatcaccatggttttgtcactcattcagagaggtccacccacacatacctctttcccaggtttccttgtcaccaatcttctaattatgtttacacattatgccatttgttctttccaagcaaagtgaacaacctggtgcactatttgaagttgagtccactgggacaacttctcttcaccactgtccagggatgtcccagagaggggctacagtgctgcagctatccactttcagatggttcctgaatattatgcaaaaccctctgtaatccaggcccaagtcttctcttctttagtcaactgataatggggagctccccatgggaccataggtgcaggctgcgagagaaaggtcagtgtagcagatgtggggaccatgggcttttgggtcactttttcacgtaacttacttgtgcttcagagcctgctcagacctaatcatgtgtataccacttccattagatgctggagtgctcctctgcatgcctagcttcatagcttggtgaatcagataacacccagctcatcacatgcagctcagatcacatggcaacttggtggcccagggttacgagttctgtaactactaaggtctagtagcaggccaagagttgtttctcaaaaggagaggagttattcgcagaagatggcaggactttgctccaacattctaaggccctgcgctgttactcacttatagggcttgtcaaagtctccaaacagtatcctatctgccactggcacttcaagcaccattggatctgctagatcatacggcccaagcagcagagaagcttgcacagcagcctggactgctacagagcctcctcttattctgggtcccactcaaaagcagcagttttctaggtcactcagtagatggctcagagtaacacacgcaaatgaggagtatgatgcctccaaaatccaaagaagtccacagggtgttgagtctctttttttcgttgtaggagagaccagaagcaacatcaccttaaaaggaatatcttgatgtgcccaacatcactggacctctcgaaattgtactgaggtagaaggccccagcattttagttggatttattaaccactccctgacatgtatgtcttaccagtaatgccatcagtgtaatggaccagtaatatcttgtggaagtaaaaggtaatcaagatccctgccaactaaattttaacatcggcctagaaagttgacatatctgtgaggcaggatagcgaagatggattgctggccttgtctgctgaaagaaaattgcttgtaatgagacttatgaacagatacagaggaaaaaaagcatttgtcatgtcaatggctgcatatcagaggatgtgttaatttattcaacgaaaccacatctgatacagcagctgcaattggagttactatctagttaagcttactgtaatctgtcattctccaaaattcatttgttttctgcacagttcaaataggtgaattgaatgggggatgtggtgggaatcaccacccttgcatatttcaaatccttaatggtagcattaatgtttgcaacctctccaggaatgcagtactaactttggtttactactttccaaggcagagacagttctagcggcttccatttagcctatctcaccataataacccttgtcccttacacaagttaaggaaccaatgtagggttcttccagcttctgagtatatctattctaatcatgcattctggaaacaagaaataagcacaggatggatttcgggactcactgggaccactgtgagacagacatgggataaaactccctgaatcacctgatctccataagtccttactttgactggtgacccacagagggggtttaggtgtcctggaattagtgtcagttcagggccagtgtccagtagtttctaataggtctgattatttccttttccccgttgcatagttaccctgctaaatggtaccttacttttggggaagttgtgaggaagtttaacagtgtaattttttttgcattgtatggtgctccttcctcaagagtacttggcctcccctccagggggttctggggctataaactggctctaatctgggaattgattgaggagttgtgactctggtctaggttaaacttatattcacttgacctaggaattttctgcttacccagtgatacagtttggatatatatccccagccaaatctcaggttgaactgtcatccccagtattggaggtggggcctggtggaagatgactggatcatgggggtggagttctcatgaatggtttggcaccattcccttggtgctgttctcatgagagtgggtgccttctcatgagatctggctgtttaagtgtggcacctaactctctctcttttgctccagctttcaccatgtgacatggaagctcctgctttgccttccgccatgatcctgaggcctctccagaagcagatgtcagtgctcatgcttccttgtagaaccatgagctaattaaacttctttccttataaattacccagtctcaactatttctttatagcaatgcaagaacagccttatgtatacagagaaagtaagaatttagtagtcttccagagtatttcacctctagaaccatcatgctcaactaaccaacaccataaatctgcacaagtgagatgattctgattgctgtcttgagtctgcctcccttacaggaaccacacccactctcactttggtaccaccctttggctcctgtcatcctgggatccaattactcccactgtctagatttcccaaacagtgactgcattctccactgtaaggtctggcaatcacaaagctcttcagagacgctgaggctctccttacaaattgatttctcacaatagcagtgaaaagaagtacatcttctgttttctcccaatgagggtggttagatctgaaatggcaaatctattctaacattctgatctccctaagcctttgatgctttcctctacagatggtcccctttaagatggttcctgttgcaatggtgtgaaagtgatgcacatttagtagaaaccacactttgaattttgaatcttgatcttttcccaggctagatctgctgtatgacactctgttgcaatgctgggcagctgcagggagccacagatcccagccacccacaccatcacaagggtaaatgaccaatactcagctgcgtactgtgagtgtgctgtgttgccagtggtttttattttttatacttttaatgttttaattttttcttatttttcataagttattgggggtacaggtggtatttggttacatgagtaagttccttagtggtgattcgtgagatgttggtgcacacatcacccaagcagtgtacactgtaccatatttgtagtctttcatcccttgcccccctcccacttttccccccaagtccccaaagtccattgtatcattttacattctcaagcttcatcagaagagagagaaaccaataaccctgtcactataacctctccatcagccagcaattaattttagttcaatgtttcaaactttcttcaggctccgtgcactttcagctgtgtacattaatggttagtacccatacaagtattctgtttttcactttcagtatggtattcaataaattaggtcagctattcattactttattataaaataggctttgtgttaggtgattttgctccactatagaataagtgttctgagcatgtttaaagtaggataggctaagctatgatgtttggtaggttaagtgtattaaatgcagtttgacttgcaatgttttcaagttatggtagctttattgggatgtaaccttatagtaactagaggggtatctatacattcaaccaaggcaggtctggcatttccaacttactcactgtaggccaccttttggtctaggctttagtcaaccacagaaagtgttagagccctttctgactcctgagatgcacattaactgtataatctatgcttagtagaagtaatttcagcctgaggtaagttggtgttcctccaccaatatctcacacacttaatatccattctcacatgtttcctaggtttctgtctgtataattttaaaaactcaaataattattgtagagtgtagcacacctcctcatgggccacactttatacctcacctttaggggcccgctgagatgagtctagttctagatccagaagcaaagaaagatggtaggcatggttcctgagaatattcagcattttcttgatggcagcttcctcaggggaggccactaaaatttcatcagtcactaagaggttactctcttcaaatgggggtagagaggctgctccccctggggctggggagacatcttccagcagaaaagaacttagtggttcagtgtttccagcttcatccaggtcttccctcacatcacatccccactccaatattcagattccattccttcccaatcaatgccctcactttccccataaatactctacaaggctgggagttcaaacttacattgtaattcagccagtcacaggatgagtttctgggcttcattttcagcaatcttagaactgaaattacaggagataaatgtctccttcagggcacacatagaagctttcagatcatttaggtagcatttgagctgggaattttaatcgttaagctcatctttctctttctatactttgtccagcaccattaggaacaatcagtcctaaactgttatattcaatagcttgtcggaaatgtttgaaattaccatatacacagtcatccatatccatgctttttgtaagtagttgattaggactatccaagggtgatattttgcatatttctattgccaaatcatgccaggtactgtgagtgctttctttaccactggaaacagaaccactagcatctttaattctaatcagattagaaagccaattctggaaacttcagaacaaattcaagaaatttattcttaaaattttgtttctctagaaccactgttagtactaaatcatgctaatctcagtactaatctgtattagtcacgtaccttccaaaagaaaaaaaacccagaacccactagatgctcagatggatatgtggacacataggtacatttattgtaagaaattggtttatgtgattacagagactgaggagtccaaaatttgcagttggcaagctagagacccagggaagttggtaatgtaggtccaccccaattccaaaggcctgaataccaggaaagctgatggtgtaagttccagtcccagtctgagtccaaaggcagaaggacactgatatcctgttcaaagactatcatagagaaacaattatttattactcaaactttcattccattcaggccttcaaggaactatatgaggtccacctacaatgtggagagcaatctgctttactcagtcatacctgggaggcttcaagacttccaagaagggtgttaaacttccttcagacatggaattaaattttgattcaattttatccaactgtcttgggaaaaggggaatgcttcacctactggatggtttaaattattttgttgtaatcattataaaaatatgtacatctgtggacaaaaagaaacaatgaatgagccaaatacatacttggaaattcacaaaaatgttagttttatatagacataatctgataagcttggaaattttaaaaaaatgcttttcgaataagctcagtgtttacaatagtcttgtttcttttacttgtcaaaggctctgccatctgaaagtattcaaaccatgagtttcatgggccctgcctgtgagaaaatgtgcattttccacataaaatccatttccttgtcagataatttacaactcaccctgtttaaacagactctgtatttaaagctagaagatttatcacgcagcaagttcaacctcaggaattccatataagtccacaagcgcatgtgtctaaaaactgttgagtaagtaaattcaatgatgaaaactgtaatttatatcaaggatgagaaatactctctttgtaggtctattgtcaatgactaatatatgaagaattaatgcagttgatcatctaaataatgctacacatgtctgtttccattggcctgtggacaagaacatgtgtcagtaaaaaaaagagttttgaaataaatctcagatattatgattgtttcattttctctaataaaatgtgaacatttattcattcttggaaaataattttgaatagaggtatattcaggtatatgtgttatattcctttgttaactttataggcattagtttcattaattaaatataatgtggctttggtggaatgaaaaaacactagcctgaagctgaactggtcacttttcagttttgtgtttggtgggtgtggacagacatgatgtaattctttggagaattgagacaacttgggagatttacagggcacatgtgattgtatttccattagtgaaattgtcacacattaaagacagagtaggcatattagagctaaaatgtattcaaaggacctttatcaaataaatgtcagttgtggaaataaatgttaagctggaatatgtgaaagacaaatggaaaataaatggagaccattcattcacggacaggtagagaaacattcagtgaaagctaaaaagattgaaatagggtcggctgggtgcagtggctcacgcctgtaatcccagcactttgggaggccgaggtgggtggatcacgaggtcaggagattgagaccatcctgactaacatggtgaaaccccgtctctactaaaaatacaaaaaaaaaaaaaaattaggcgggcgtggtggcaggtgcctgtagtcccagctactcgggaggctgaggcaggagaatggcgtgaacccaggaggcggagcttgcagtgagccaagatcacaccactgcactccagcctgggtgactgagcaagactccgaccgtctcaaaaaaaaaaaaaaaaaaaaggaagtttgaaacagagtcatgaaaggcgatttatttgttttcagataagtgacatttagataacaacttgaaacgttgataggaaagttccagtaggatgggaatgattgaaagaacaagagagtagggaaataattgacaggagatgccaggaggtggacagagagcacaagtagacagattttactttcccggagggattcctcaactggattggaagggaaggcaacaaaaagtgactgggacatagcgtgattttaaaggcagaatacatcaaaatctgggggtagttgatgcagaagactttgaacaaatgtgaatatgtctttatggaatgttcccatcctacaccaatataagtgtgctgctaaaccagagagagctctctggaagggacttccttgctagtgttacaggaaaggggtccctatacagaccccaagagagggttcttggatctcgtgaaagaaagaattcagggccagtccacggtgcaaagcaaaagcaaatttattaagaaaataaagtggcgaaagaacagctactccatagacagagccgggagttcccaaaaggaagaagaggaacgcgtccaccctaggtacgacacttgtttatatataggataaataaagatcatgggaagatgtgctatgctacaagggtttgtgataaaggattaattttcttatgttttgcaaggatcgatattattatctttaaagcaaaattaggaatgcttctgttctcaagatatcaggatatcaagacaatcccaagtctgggccagtttagtaaacattatcaatctgttctcttagcagtaaacatctagaggctaggaatgcctaactttctatgaatgcagcccagcaagtcccagccttattttcttagccttcactcaagatggaatcattctggctggaaagcctttgacactaggaaaagcacaaattgtataagtggaacaatttggaaacaagtgtcaggtagtctttctttagacacaacacgactttgacataacaattgcaaataatgctttgcaaccatgtcaatagtggtatcttgaggggaactacagaatttgaaaataaatgtactctttacctaattactaattttttcatttattcttatgtcttacaaatatgattatatttatttaggaataaaaatttgtttcttaaggaattcatctatttttgttgtagttcccattggaaaacacatttttttttgttagaatagtataatcccaataagtgacctgtattcatgaaggctaagaatagaaacaagtaatggtagctcagaggctcaggttggaacataatggctctgcctcctgagaagagggaaggtctaatattacattagaccacatgtggcatctttatatttgctaagggatagttagtgcttgcatttctcaaaacaggcttacattatcacaatcggcgttcaactagttcaaaattcaagcttagtggatttttttccacagtagtcatgctaatgtaaatagcacatttgcagtgaaaatgttccagttttattcttaagatgttttagggcagtgcttctcaaattgtaatgtgcaagatccttatgatcatgttaaatgcagattccaagtcaacgtaggtgtaagtagggaagtctgcatttcaaacaagctcccaagtgaggttgtgccttgcatagtaaagttgtcgtttgcagttagatacccgcttaccaacagaaagtgaccagttaagaaggaacacatgctcaccaaatgcttatctcaataaatttctttacacagacttattaaaatcaacttaacataggatacacatgacacatataacatccctgtctttagaaaaataaattgattgtttttatgtctgacatatatgccaaataaatggaaaactgaagataattttttggttaaaatttggtcttcacattaaaattagtttgaagggtatttttctgaaaaaagaatctctctttctccatatatataatatttaacatttaactttaatttgaagtaacatttgcaagaaccaggctgtaaggtagtttccagggaccaaattgttaaaatagatgtttgtaatcaatacttaactgatgtgaacattttgtattatgacattaaagagggaattcttatttgaactctgcattagctgaaagttcagtgcattctgtagctttcatatgaatttcttccactacattaggttctagattttaatatttgtagagttggctgcatgcagtagggaaaatgccttttgctcttagaagtcatgagaactaaggggtcacaaggcgaattagtgcatttaagccagatttcatcctgtgaaatccagcagcagatttttttttttttttagccaaatttagttactttaagaaacaaagaatagaaattcctttaacaaagaaaattctgtctgttaatgtagttgacataaagataataagatattgaattttttaatgatttctttgagtctaggatgtgcccaaggaaacctgtcccttggcaggaaaatagtagacattttcttgaaattatcgactcatgcaacaacttggataaatctcaatggcgttatggtgagtgaacaaagtcattcaaaaagttcatactgtattgattccattatatgacattctcaaaggataaaactatagggatagaaaatagatctgtgattgccagtgcttggtggcataaggaaggctttgataaagaggcagcatgtgggaatttttttagggtgatagaaatgtatcttattgtggtgatcgttatatatatgtcttagaatttatagaaatgtgcaccacaaaaaggtcaattttactgtatgataattataaaaacaaaagaaaatagaaaaaagtgtgagacaaaaaatattaatttacctcagaaactaaatgagattttcccattgtatggagctgaggatttatgaaaattgctttcttccatatgcagccaggcatgaagctgacttgtgcctccattccctggaagaatccatcggggaaatggtggtaatagaagatgtgactctgtttgctggatttagatgccattacttcaagagcacagagtgcttcatgtagttgcagacagaaactataatggaaatattacttaacaaggtatcactttatatttcttctttcttttttttttctttttttgagatgcagtctcgctctgtcgcccaggctggggtgcagtggcacagtcgaggctcactgcaacctctgcctcagcctcctgagtagcttggattacaggcatgtgtcaccacgcccggataatttttgtatttttagtagagatggagtttcaccatgttggtcaggatggtctcgaactcctgacctcatgattggcccacctcagcctcccagagtgctgggattacaggcgtgagccaccgcgctcggccactttatatttctttgaatataatatcccaagtaagaatttgggattgtggaccgggcatggtggctcacgcctataatcccagctacttgggaggctgaggcaggagaatcacttgaacctgggagatggaggttgctgtgagccaagatagcgccactgcactcctccagcctgggccacagagtgagactcggtctcaaaacaaaacagaatttgagattgtgtttaaatatagtaagtacatttgataatcaactgcatggcagtcaaatcttaaattctaaaaccactacatctctgagtcaaaaagttgtatttgtggtagtagtctaaaagaaaaattctcaccaacaacacctcagggcattgtaaaaagtgttgctgattcttttcattagggtgataattgctaattaaagcctaatgtatggtggggttataagggctttctttccctccatgttggaataaaacacggtgtaaggacaaagctggtgtatattaaattagccctgatgcagactggctttccatattccgtataaggaatctgaggtttattttttattttatttaatttttttctgagatggagtctcgctctgtcgcccaggctggagtgtagcggcgcgatctctgctcacctcaagctccgcctcccgggttcacgccattctcctgcctcagcctcccaagtgtctgagactacaggcgcccgccaccaaacccggctaattttttttttttttttctgtatttttagtagagacggggtttcaccgtgttggctaggatggtctcatctcctgacctcgtgatctgccctcctcagcctcccaaagtgctgggattacaagcgtgagccaccgcgcccggccaggaatctgaggtttagagcgttgaaggaatttgcccaaagtccaggcactggactgggttctcagcaagagaagccatgctgagaacccagtctcataactccaagcgtgtcttgacacagtcaggtactccctgctctctgctaaaggaagtgagtagttaccatcatttagtcatccactcattcaactagtatatatcgaatagaacttaggtgacaggtgctgctcctggcagaaggcgctgttctgttaatagatgctggggttgtttctctcattagaaatatattaaaccttgtacaaaaacaaatgtcttcctttgagtttcctttgcacttccagagtttagctaaaaatgcctatcaagtgaaagcagttttctgctcggaatctgcaaataaacgtggattctgagaattattattttagaaattaaatcttcccttcagttatgtataaataacttgaaattactagaaattaaaatcaaagaaaatctggaattactgaaaattttatttggagtttattaaagaatgaaattatacacacacaaatacacatatacacgtatactaataaaaactaattctttatatcatgccaacaaaaagtaattctattgtttctgttcctacaacacctagctttactatttaattttatgttaaattttgattattcacatttaaacacaatgagagtgctttttggtcattgaaagaacatgatagtatcataaataaatattgtaaaatattaaatattactactaataaagaaactaaataattaaaatactagtaaatatggtctcaatcattaaatgtaatgacaattttattttgatccttagcccagactgatcttttcatacaacgtcgttagaaggcactttgatttatattattgtttcagcaccatgctggtagtacctgctaggaaataagcaacttcccacatcagaacgggcaatgggaacaaccagaagccgcatggagatctggcacgggggccagcgagggcagaacgggagtcagcattgcgctcatggctctccaagagggtcttggcggtggagcacctgaggaaatgggagagttagccatgaggcctggtacaccagcatttcctccacctttcctatatgccaggggatttacaaaagatttttttttataggaacaaatagactatttatatccccaacaatcacctttttttttttttttagacagaatctcaaagtcagttttcagaaagtatgtgaggatttattgcgttccaggtaaaagcagctgcccattacatgaaatctttttttttttttttttttgagacagagtctcactccgttgcccaggctggagtgcagtggtgcgatctcagctcactgcaacctccacctcctggattcaagagattctcctgtctcagcctcccgagtagctgggattacaggagtgcaccaccacacccagctaatatttttgtatttttaatagagatggggtttcaccatgttcgtcaggctggtctcgaattccagatctcaaatgatccgcccacctcggcctcctgaagtgctgggattacaggtgtgagccacaccgtgcctggtgcaccaatcacctttgacacttcatattatagcagagaatgtctttcctcctgattattcaagaaaaaatatataaatgtatacattcatttctatacaattatgagctaaacaatactgaatatatcttactagatttaaataaaatttaagtaacaattttatttcatcatttctaatagtacgagttaaatagatactatgagtagaatttgttgtatggataaatggaagtaagcatggatatgtttgtatataataaaatacagtcagcatgaattttatccaatttttaaataaacatagagttataaattaaaattaaccagccataccaacccatttgaatctatagtttcctacaagggaatgaaatgcgaagtaatagcgagcctccaaatgttttagtcacgcagtgtagagcacccacaaatcatctcacccctctgtcggggggcgctgtggggtgccccggctttactagtagtgcttctctaaactcatgcctgcaccctttcttctggaagcctgaacaatgatgcagagatactgttttctttgttgtagaaaacagcagaaggtctgtgctcacgagggcaatattaggtcctcatcagctgtggcttgctatctccagcacatcaatgaatggagaaaataagatttaaacaaagatcagtgtctccattctctaacattttactcaaaatattggttaggttagactccacacccaccaaaacccaaaagacattccatctcacagatgctctacattctttcaatacagaaaccttacgacaaagcctacaatatacacttgttttagtaaaataattggtccagttagtaaaaaatgagttgaattagtgttctccctctcacacattataactataacttttttcaattacacaggtgtttacagaatttatctgaggtgctttctgtgtatctctgaaaacaccttcataacagtaggcacaccctggctagtggttctcagccctggctgctcactggtatcaccaggagagctctggacatactgaggcctgagcccttcccccagacactaatttaatgggactgtggtggggcctgggcatggatgtttttagaagcatctgctgatagataagcaataaatacgagtttattaactacacatggtgatttgatttccatggattcttccctgattttctgatccattggcccgtatatgaacaggctaacttctagtgtgtgaaaagactgacaggatattaacctggctaagtgtctttgaaaatataaatggagggaccatgccttaaaagagttatgaaaaaaaaaaaaacagaaaatatgcacctgagaggggcgcaaaggaagcaggcgaatgtggggtcttggagaagtcactcctgatcttgagtttctatgagtacacattaaaggaagtcattgcagttttctatgtactgtgcatttggatattttcacaaactgaaacaataattcgctgcttcgggaaggggaacagataatgtgttctaacgtagcatctttactttctctattattagaaacattttaaaaatctatctttctttggcttggcatggtggcttacagctgtaatccagcactttgggaggctgagactggcagattgcttgaggtcgggaatttgagaccagcctagccaatatagtgaaaccctgtctctagtaaaagtacgaaaaacattagctgggcgtggtggcgcatgcctgtagtcccagctgcttgggatgctgaggcaggagaatcgcttgaaccccagaggcagaagttgcaatgagccaagatcatgccactgcactccagactgagagatagagcgagacccccatataaaaagaaaaagaaaaaaattatctttctttggagtctgtcaaatgtattaccactttattattagtgaaatttggtgagttatatcaaatgatcagtgataggagataatatctacaagatttaatgattgactatagggaaggagaagagaaaggaatagatttcttcttttttttttttttttttttgagacggagtctcggtctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgagaaaggaatagatttctaagtcaaattccattgataatgatgagaatcatagggggaggagtcaatgggtaggagaaaaaatatttggtttaggacatgctgaatgtgaggagcctgtgataaaggataggataatatgaaaagcttccaaaaggagtacaccagattatgagatctaccttttccccaaacttataaagggaaaaaatatcaactccattgttaattctccattgatcctgatgaaacgtcagtactactgatgagatgtaaaaataaaaagcagcaagactaaagttctccaagattcctctaggatatgtttggtgtctgcatttgcatttattgttatttaatctacgttattcaagatgctttctatttggaaccccaaaacaaatggttgaatgggcttgctctgactatctatttccacagaacaaccacccaaaatttagtggcttaaaaaaatgacagcatttattttgtttatgaatatgcaataactccgcatggtttggggatggctcaaagaccaggggcgaggatcatctgcaggctcatccactcacacatctagtggttgatactagctgttggatttccacgtggctcttcagcttcctctcagcctagtagatggatccaatggtgagtgtaccaggagagcagaagggagccaggcataggtgtctggcctttcctaactgagctgaggaagtcacatggtgtcatttctaccatattacagtcattagaagtgagccagtaaatctggctcatattcaaagagagggaaattagactctatttttaaataagtgtcaaagaatttaagggcatattttcaaactgccagagcgatcgcagaaggctctgccacctacaaccaactatttctttgcattttaatagaatttttaagagaaatcatagctgaagctgcggttatattttggagtcgtcacagtaaaagaaataaagtacatgtaatttgatatttcagagcattttttccctttgtccaagacattttaaatttgaaatatggttttggcagttttgtaagagatattatgtaaattgaaaggagaagatgagttttggagtcaatcttaaaaattcattttggagaagcacaacatttgcacagcatccgtctgatttgatgccgtttgtataaaagagccgtgctttcccaggagtggaaactacattattggaaaaatataggctccttagggtaaatgatagcacaaagatagtaaatgtcttttcatttgaaataacctttgtggaaatgctattattctcaatatattgtaaaagagatgaatcagaacggtgttagaaactatttaatggatcatctatctgtgacatattacaaagctaaatgttgaattagcacttggctaaaggaggcctcatggccagaaagggttcagctttggaatccacaactctggttttgaatcttttttttttttttttttttttgagacggagtctcactctgtcgcccaggctggagtgcagtggcgggatctcggctcactgcaagctccgcctcccgggttcacgccattctcctgcctcagcctcccaagtagctaggactacaggcgcccgccactacgcccggctattttttgtagttttagtagagacggggtttcaccgttttagccgggatggtctcgatctcctgacctcgtgatccgcccgcctcggcctcccaaagtgctgggattacaggcgtgagccaccgcgcccggcctggttttgagtcttggtttgacttttctttgccgagagatcttgaagttttgttatgaggattagagcacaattcctggtatctgctccctggctgacactcagaaactgagatttgtcattaagattgtgatggtgagatgatgatgagaaattgtttgactatctcaggaatagtagaaattattaaaatattgaattgtacccatgagactatgtggccaggcaagaagaatgagataggccctttcttcaaagtatatgatttttttattattgaagaaattattcataaacacttgaaaacaaagcatattcaaagttttaaactgtacctaaaagatagtgccataggagatgtgagattttgctaaatattttgaccttaaaatgggaaactcatgaaatatgaattattttaagggtctaatttattgcattttttgattcatatgaatttccctcgacaatgttaattcagttatcaggacaaatgaaaaagtaagctttgtaaattaaaatacagaaatatttacatattgtggcttgtctctggaacttttataatgggatattatattttaacataatgttgatgtaaaatattataaccaagatatcagcaatatagttacaagttgttcttttgaaacacagggtcataactcacaggtacctgatttcaaaatacttttggcataatttacaatttataaatctataatctctttaaggcgaattgttctaatgcataattaatgcactagtgccatgactaacttttaagaatgctgcattttccacaccagttcactgataacctaaaatattgcagtcattcttttaagaagttgttaaaaatgtctctgtaaaatataatggcaaatgctggctattttatgagtgggaattacaatagtaaatagtaaaacaaaatattttccaagaataaatgtgcttcatgtgggtttgatcagcacatctgattgaagatttgaggtgagatacattgtccccattaagtttaagggtttcagcgcaaaatcagctgatctactctttgaaacgcagggcatttgtgaaaatgccaaacgcatctctattagaatctcatccatgagcaaatgagtaatgtaagtcagatacaatggttaattctgtggtttgccaaatctgtacacttcctgttactttgtagattgtaaaataatgatgcagcattcaccctaatgatcaattgttttccttactaaaatgtaagcatttaaaagatctgcctaattttttctaagtgtatgttaggcagatctatacttcctactcctaaagcattcttctaaagcagtttattagagcgcacactaatggcttatcaattaagcaaacatgatcagtattgagcacttgctctgctccagggtgccggtgctaggttcacgtgcatcagggagacagagttatagtcctcatgaagcttacaggggggcagattgattgaaccgacacctctgattcccttttaagcctgtaagcagctgctctgtaaagcaggtgtttcaaacacaaccaccttcagagacgaggtgattctgttgagtgggtgaagcaggccaggcatgaggccgcaagcagtggtttagaccagttcattggagaatccctgccttattaaaaatatttccttccaaaaatgtgaaaggaagacttgtccttttccccaaatcatttagaaagcttgctttgtcacctctgcttctaaggagtcctggttggtctccaaaaggaagctttctctaaagaacagtgtagtacaaagtaagatgggacaagactcagggggcccactcctgagctgctcagccacttgcccacctcaggtaaacactgagcctggtggtctttcagtcattccaggtctgatgttctacagttttgtcaggttatctgggagaaattttgatgctgaagagtcccgaaagtaggagaagcatttcaaactgaggcctaagatgttttcaagttgtggcagagttgccttgaagaaggtaactcgggctttgccctttgcccttttgccctttgccctttgccctcacctgcagcctgcacatccatacctcacctctaatacagcaacccctgtttgacatgttgtatatattaagcttttacttaagatgtcatttaatgaaaaagattttgctgcttaaaaagcagtggagaataatagctagcctcttgagtacacagtcccgtaagatttgagcacatgatttttagaaaaagaatagaaaataagagaaaattataacctcactttacctgtcgggatattgacatcactgtcagatttcacaaagccacatgtgcatctggtgaaatcccagatccaccctttctaactgtatgctcttaggtagccaattaatctttctaggactcagtttttcattcattaaataggaaacttaacacatagggcttttgagagggttacatgagtcaatacaagcagagaacttagtacttcctctgtcacgtagtaagcactccttgttatccttggattttgtggtactttggaggagaatggcactcggatctctgttggtataatttttaccaaagtaaaatctggttgaaatagcattcagatttaggcttaaggagaggatatttcttagaaaggaaggctaagcttaatgggggaaaagagttatcagtgaggccttggggcaggggactgactccactgggcattacttgtgcaaaagggataaaatgtagagagagtttttttttctggtatattattttattccattaaagtcagtgttctacttttattttgtaaaatcatatttctgagtcctgaacaaaagactttcaagatagattttactgacagagaaatggagtgccacattccatagctttgcatatagagcttcacatgcaaagctctttgcatctcaagggctaaaactggctgacttacagcaagtagctttcctgtaaactgtaaagtagaagcgaacggagacagctatgaaggtgggaaaaatgcctcctgcagaagaagagcagacataggggagcataaatagtataccctgcctggaccctgagaaggacccagacctgcatgctgcatattgagacagacatggctgtggattctcattacttgggattctcagtgatgcctcaatccacaattttgtattaataaaaaagtctttaaaatatttgcatctaggaatcaaagtgtcattcaatgacttattggtcctcaaatgacagcttggggttgtactttatcttctatatcatggagtaactcctacactatattcattccaggagaattaactatgtcaattcttatgttcatctcttccttggctgattatttgttagggaaaaagcttttgcttgtttattaatttgtctccttcctactcttctgattattattttgtaatcaaaacaggattttaaaattcatagacactaaaatattctagacttttagcactggtttctaatattttgggaggagaagcttcattttttcttgaaaatgaaggtgtaaagatactaaattccttgagtggaacatctgggcttcatagaaactttggagctatatgatagttagagagaatgtagacagggttcctcattgtatagataatgaaactgtggaccagagaggctgagtgacttgtagaaggtcccccagtgagtagcagatcctggatgcatgcagcattgctaactctgagagctaagtcctcatcatgtccccaccttcaccacaccacacagttcaggagaaggggcacatctctagaatatggctggaaaatacactagggaaaactttagatccactagcagagtccagtgctcctcttggagaaagtgaccagaaagaataaagcacagttagctgttgaagaaaagctgatttctcagccagattatgtacattagcatccatgttagttacctttgctgaataattctctcctcaactgagctctctgaagaaacctccaggaattagcagggctttgagtagagatggcatatgtttgggccctgatgaaaatgataaaattgtggcctggttgcagcttgtgtgctgaaggaagagcatgatgcagttcattggtatgaaaaatgaatgcaactaaaacctaaacattaaaacttggcctttattaccaaagtgaaagtgcttctaattgaggctccctgggttttaattgttcttcaggaaaattagatgttgtcaaagtagaaggttaatgtctgttcacagtctggagtttttggaataacttccttcacagcgtgtgtgttttaaacataaaaagggctttttggtttgtatatagttagtgggattacaactgcctcactagatgcttacaacaaatatttaagaaatccataaggtctactatttataacagaataaacatttaaatttaagatattttgaccattttggtaaaacatttaaaaaataaactatcatgaactgacaaaaccaacatcatttaaaaaaattcaacatggcaaaaactttatgagacttataccatagaccaaatttgtaactttagccttgatacattactgcttgtaaatagaaatgttcttactacaaagtgatgtgctcagatacacccaaaatttattaaaggcatgtcaacagccaaattctgtggtacaaggtttttcatacattattttacataacctttgaggaattccaattttatattcccattttcagaagagttggttagttactgaattcaacaaatgagtgtgagcaggggcctggagtacttaaaaagaataaacaaaatgcctttaaatcagaaacacaaaattgctagtaatttcagttaattgcactttactccatgtagctacaattgtagatatctagaaaaaatatctatgataaaagcctgccatctggaaaagtcaaaagaatgatgagctggtattaaatctcagtaaccctgacatatggaatatctctgccatgttaaaagcagaccttggtatgagactgactctgggctttacatatgaatttggaattgccaatatctctacttgaactatgtgagacaataaaagtgctcccttatacactttagataatgggccctttgggggatctgatgttcattcagcctttcccagaaaaatacaactataataaaatgttgtaatcagtttcagtttatttattgctgatcttttatttttgttttaatttaacatggcaatccactttctatagtcaaaagtgcaatttaaagaactctaacaacttcacaatctagaagaatgtctttggaaattttaggattcaaatctaaaacaaattttgagatttctttttcctagattgtactgatgttataagtgccttatgtaatacccagttcttccccatggagatttctcagtgaaagaaccacatcacatgttcacaagagcatcaagaataagagggtcaggtacctaggaagaaagattggctagcattctctctcccccatcaaatataaatggatttagcacagggattttgtttaattcactactgccagcacctagaaaaatgcttgaaatttttaatatgacaatgcacaattcaagaggaaataataacattgtattagtctgttctcacactgctataaagacatgcctatgaagtggtaatatatgaagaaaagaggtttcattgagtcacagttccacaggctgtacaggaggcattgctggggaggcctcaggaaacttaaaatcatggccaaatgcaaaggggaaacaggcacatcttcacatgactggtaggaaagagagagcggggaggtgctatacacttttacaaccatcaggtctcttgagaactcactataatgagaatagcaatagcaagagggaagtctgctcccatgattcaatcacctcctccaacattgtggattacaattcgatatgagacttgggtggagacacagagccaaaccatatcaaacattagtatgtgaaagtagttattatgataaaacatattttaaccaacatacaattagttatacgatttttataatgttttcagtgttaaaatttttgaaaaaactgcagaaaaacaagtggaaatgaacaaaattacattgacagtagtaagttgtaatgtttaattctttgaatgtttcagtgggagctagaaattggtttgatatactttttagttcagttggaatacttaacacttctccactttgcctaatatatgctgcagcaataaattaattttccttctgagatttctagtaatttggggagtgcttatttgcaaagaattgaaaaaaaaagtgacacaaattgatatatcacgcaaactatgtggttttgtattttcaactaattgctgaagagcacttatacacaaaaaatatcagattcctcaaagaggagatatttaaggcaagcaaagaaatgtataggtcagtttccttcaaataattttatttcttactcttaaaaatcttttatttcagattcaggggctacatgtgcgggtttgttacatgggtgtattgcatggtgctaaggtttgggcttctattgattcccttacccaatactaaacatagtacctaattggtagtattcaaaccctgctgccttttctcccaccctatttttggagtccccggtgtctactgttcctatctatattttccagtgtttagctcccacttataagtgagaatatgcagcgtttgtttttctgtatctgccttaatttgcttaggaagtggtctccagctgcattcatgttgctgcaaaggacatgattttgttctttttacggctgtgcagtattccacagtatatatgtaccacattttctttatccagtccatcgttgatgggcacctaggttgattccatgtctttgccattgtgaatagtattttgataaacatatgagtgcaggtgtctttttggaagaataatttatttttctttgggtagctacctagtaatgggattgctgggtcaaatagtagttttatttttggttctctgagaaatcatcaaactgctttccacaggagccaaattaatttacattctctccaacagtttataagtattccctttctctacagccatgccaatatctgttgttttttgactttttaataatagccattctgactggtgttccttttgcccactttttaatgaggttatttgggttttctgttgatttgtttaagttctttataaattctggatatttgttttttgttgggtacacagtttacaaatatcaaatattttcaatgtagaaacttggatctttgatttttatgatgataaattgaggcatattgcaagaaaaacatttgaatcagaatatttaccaatattatcataatagtgaattacatttttacttgtccctacattttggtaataacaattaaattttgctaaataataattaagtgctggtccaagatggtggactgattattcttccaggggaccaatttcaatgacaataaatgagaaaatgatgtgaatcagtaacaatactaatttaagctaatttctatatttctatggtgtacatgttctttgaaacaacaagtatctatcgctgtaagaataagacatttggaaaatgtcttatatatgtgagatatgtcatatatatgtatgtaaataaaccataacctttctatggtatatgatgtgagctattttcaaatatgtgagttccaacttccctctgttaaggaacatttaactttgagtgattcatgtgacttctgagaccagctgtccccagcctctgagattcagataaaaacaagtatccttagctctagattaatccagtggcactgagcatctatggtgatgaaggatatgttttcggtagtcattttaccaaagatggtgctgtgaaaaccatcaaaatataaatcatggccttaaccatctatctgagaagacaagactaatacacttgaaacacaagaaacaaatgcaagataatatacatatatttgtcattgaattttgtaatacagcctacaaatgttatagaggctcatctaaatgaggaagtcaatgatgcatagtataatcaagatatgcttcctagaatacattgtgtagatggatttgaataggcagatggataaagatgaacatttaagacatgagcaaatgcctacacacctgaaaaaatgtggcaagtctgtataggagagaagaacatatctgagggcttgagctacggtgtgataaggagctcatttgaataatctggtggaatcagatgggctatggaagcctgatggagtaacacaagcagataatcaacaaagatgcttatcagctctaagaaggaatagaaaaaaatttcagaatataaaccatggaacatgtctcaaggaaataatttttatatgtataaaatttaacctaaatataattctataatgtaaacagaaaaaaataatggactggaaactattttcatcaaatatgaacattataaattactatcatgtgttactcaatgtactttaaattttagacattttaaaatgattcaatttttcaatttgtctttaaatttatatataatatatttgagatataaaaaaaccaaactgtttttcttagtctcacacactcaccactcaatacattacttcacctctggtcaccaaaatatgtatggatttttccccgcatgcaaagtaattctccagcagacaccactagggtggcctattattgaattcaattctgacactatctacttggatatagggtcagatcccacacagtaagggcacagtctcacaagacttcccttcacttcagatgccaactgcaggtcccaggatgtgacctgtacttctggccaactggctataaattggaggttcccattaccccctgtttaggttcaattaatctgctagaatggctcacagaactcagagaaaaacattatttacatttactcatttattacaaaggatattattaaggaaactaatgaacagttaggtggagaagctgcatagggcaagcttgtccaacctgccttattttgttgagattgttgttgttgtttttgttgctgtcctgttttgttttgctttagacttttagcaacctgaagccatggtttttagtttctgtctatagtgataagcagaaaagaggaagaaggaaggggctttactggcccaaccgggaacagaaactaagaactcatgactgtattccctcccttggacatcactgaaggtgtgagagaaggggtagggagcttccgtgccctctctggtatgccaccctcaggcacctccatgagttcagcaattcagaagctctccaaactgattttggggttttatgaaagcttcattatgtagaaatggttgattacatcattggccattggtaatcaactaaattttcagcccctttcctcttcctggggaataaggggttggggctaaaagttcttatcctctaattacatggttggttttcatagcaatcagctcctattctaaggctatccaggagcctaccaagagtcaactcattagagcaagagatgctcctataatccaggatattccagggatgtaggagctctgtatcagatactcctatcactcaggaaattaaaaagttcttcggagctctgtgtcaagaaccagggtcaaagaccaaatataagaacaaaagatactcctagcatccctatctggcaagggttttagaagctctgtctcaggaatcagggacagagaccaaatacataatttttattatatcacaatatcacatggcataattcacttttatattttgtatatagttcaataagttttaccaaatgcatgaagtaatgtagctaccactacaatcagtaacacagaatagtctcatcaccacaaaacaactctccctggaatcccctttgtaagcactctctactgatatgtaacctctagaaaccactgatctgttttctgctcctataatctggtgtacttcagagtctcagaaaaatgtgataataggaaatgaatgataaaaagctataaaacctacagaaaacaaatagcagagtgccaatagtaagttcttccctttaaatgtaaatagattaaactctgcagccaaaagatatagattggcagaatggatttttttaaaaaaatccacacaggatccaactctattctgtctataataaactcactttagccctaagtacaagcacaggttgatagtggaaatacggcaaaatatattctatgcaaatagtaataaaaagaaagaagggtgcctatactatcagccaaaatagactttaagtgaaaaactcttataagagacaaggaagggcattatatagtgataatagaatcagttcaccaagaagacataacagttttaaacatatatggaccaaacaccagagcttcaaaatatatgaaatattttcctaaatcagagtcatgggtattttctcctagattatcttgtaaagttttataattttacatttatgtctataatccatttttaattttttataaagagggagttataagtagaggtttatttttcacataagatgccaaattattccagcaccatttattaaaaagaaaattctatctgttctttgatctttatcaaagatcaattgaccatatatgtgggcatcagtttatggattctctattctgttacattgacctgcatgactatcttgattactgtaacttaacatcagatagtgtgattcctctaactttgtcattttcaaaattattttagaatttttgcccctttaccatgccctatacaatttaagaatcagtttgtgctttatcaggataagaaaattgcctttatttgtactttgctgagagttttcataatatgtggatattcaattttgtcaaatatttttatgtacctagttgtgtgactgttagattttatcaaagcattgtaagaaaattgctatgagtactgcagaggattagctcttcttgttattcccagatcagccctatattttgactggaatttttcatttcactaatatgtatctagaggactgtatattcttccctatttatttaagcaattatttatatacatttagaattaaaaataatttaatactttgagatataattcaatactactttgcttattttattgcacaaattgttctagttttggccactgggagttctttctgttggctcctgtattcctttgatatacccccatcattgagggtttttaaaatgtggtttattattaatgaaattaaaatgatctattcatagcacctgagatgatttcagatatcatattatgcaagcattaagataatattaagaattagtctggtaaatgaaaatcatagaatcagagtacttactcaatgtcaagttttgctaataattgcaatgacacaagcagttatatgacacaagtgaagcagaaagtgttctgggaccccaatgtgacttattgggtcatttcttctcacatgagatgtgttctggtacagatcttgcacagaagaagccacttaggtcatgaattactgagttacatagtttatgtgacattttccttggagccatcccctgtaaacctaaagattccaggtctgtttaccacaggtgattctagataggcagctatattttactatatgtatttcatagttctctcttgctagccaaggtcacatactttgtttgccaggagagctgccattataatgtttacaaggcaattagacaagataatatgctttctttcttcctttgatgcatcacccaaactctgccatgagagagaagggcatgcaggtctacttcataagtcctttctttctagatattctggtacagtattttaatgtattttatgatacagatactctagcatttaatatattttaatgtatcatgtttaatataagctcgataaagaatcatcacttcacatactttggataataattgtacacagtgcaaattcatggagaaaataatcagaaccattaatgctgataattttggggcatttaaacctttttcaggtcaatggattaatagatttattagctcttgcagaatgcaagcatattacagatttatagtataagtggttaaaaacatttttatttcactgaaaattcatgtaaagtgaagcctttgcaaaactgtaacctttatgcttttaataaaacagtatttctgttgtacatggtaatgattttgttctggaacactatgtataagcagattttgaattgaaggcagtggagcaagtctgtcaaaaatcaattcaattgatttccatttatgtagatgcattgagttttacagtggttgaagctctctttaaattgattggattcagaatgcaggccagtggtccgcatccatattctacaccttttttccaaaacttggtaaagaaaaatgctttagaaactttcctgaacaaataatataaagatcataccatctatatgttaaccaattagttatgaaatctaaaatcattaaggttacatttcaaaagtgaagttactaaaaaggtgaaattcaaatctaatagaaatagggtaaaatgcagaacatttatgaaacataaaagagggactatctgtgttagcaattaagggctgtagcaatttctgatatcagattccaaatttgaagagatccagacacttcatatacaggtttattttgccctaatattttgtcttattgagaattgtggtaaagagagaagacctgagtttcattcttataatggtttgagacatgaggaagtcactgaacatttctggacgtaactcacttgcatgatttcaactatcacatatacttggatgcttgaattacaaacctatgtagactagactttcctgctaagctgaaaagctgtatatgaacatttctttcatgttagctccagttgactgtttctcaggtactttcaatttcacatgtcccaaatttttctgattttcctctggcctctgaatgccctttctctgtgagcagcatcgtcacacaccttgtcacccaatctcaaaaatggaaagacaccttccaaatagcctcttctcaccacccttatcctattccacaccctgtttcaaacactgtgaaggtttttggggtagctgttcaaaggacctaccacaattagtttctgaaaagaacaaaaaaattactagctccagctggttgaccatcacaattgagatcatgcttgattctgcctctgatgtaagattttcattgctcaaggcagtcaataaattttgattcttaaagacacactctgataattttctgtgaagtaggaaactcactcaagaagaccagcctttgagtggtatcacagtctagactttaaatttataaggtggaaatgggctatagttggaatagattcttagctctgtggattctatttctatcacagctctcctatccacctccctctccattgcccatgaaatggcctaaatccaggcctttaacactttttatttgaattattatggaaatagttaactgtccttactgcctccagacatgcttccctctagcttcctccttcatattgatgtgcaatgatataaactccaaatctgatccaaatctgctgaaaagcctttaataaatgacttcctacattttttcaggaaaaagtttaagttttgtggctcatcacataccacattttttgaatgaatatacagtaaaataaaaagtagtagaaataccatttgacccagcaatcccattactgggtatatacccaaaggattataaatcatgctgctataaagacacacacacacacacacacgtatgtttattgcggcactattcacaatagcaaagacttggaaccaacccaatgtccaacaatgatagactggattaagaaaatgtggcacatatacaccatggaatactatgcagccataaaaaatgatgagttcatgtcctttgtagggacatggatgaagctggaaaccattgttctcagcaaactgttgcaaggacaaaaaaacaaacaccccatgttcttactcataggtgggaactgaacaatgaaaacacatggacacaggaaggggaccatcacacaccggggactgttgtggggttggggaatgggggagggatagcattaggagatatacctaatgctaaatgatgagttactgggtgcagcacaccaacatggcacatgtatacatatgtaacaaacctgcacgttgtgcacatgtaccctaaaacttaaagtataataataataaaagaaaaaaaagtagttgaatgaatatagagtaaacaaaaatgggtgggcctcatgcttctataaaatacaaggctttattaggtaaattaaaagtttcttaagcttccaacattttcttattccacaggaagctgtaaaattttctgcactggatccacactttgtctttatattctcctctcagcacaccatttcccaatatttggcaacccacaggttagcatcgaaaataaacaagtcagggtggctggcaaggtggccaaataggaacagctctggtctgcagctcccagtgagatcaacgcagaaggcagaaggtgggtgatttctgcatttccaactgaggtaaccagctcatctcattgggactggttagacagtgggtgcagcccaaggaaggtgagctgaagtagggtggggcatcacctcactcacgaagtgcaaggggttggggaactccctcccctagccaagggaagccatgagggactgtgccatgaggaatggtgcattacagcccacgtactatgcttttcccatggtcttcacaacctgcagaccaggagattctctcgggtgcctgcaccaccagggccctgggtttcaagcacaaaactgggtggccatttggacagacactgagctagctgcaggagttttttcataccccattggtgcctgagaatgccagcaaaacagaaccgttcactcccctggaaagggggctgaaaccagggagccaagtattctagctcagagtatcccaccccaacagagcccagcaagctaagatccactggcttgaaattttcactgccagcacagcagtctgaagttgatctgggatgcttgagcttggtggggggaaggctactcaagccatcactgaggtttgagtaggcggttttcccctcacagtgtaaacaaagctgccaggaagtttgaactgggtggagcccactgcagctcagcaaagccactgtagctagactgcctctctagattcctcttctctgggaagggcatctctgaaagaaaggcagcagccctagtcaggggcttatagataaaactcccatctccctgggacagagcacctgggggaaggggcagctgcaggcacagcttcagcagacttaaacgttcctatctgctggctctgaagagagcaatggatctcccagcacagcgctcaagctctgctaagggacacactgccttctcaagtgagtccctgacccctgcacatcctgactgggagacacctcccagcaggggtcgacagacacctcacacaggagagctctggttggcatctggtgggtgcccctctgggacaaagcttccagaggaaggaacaggcagcaatctttgctgtccggcagcctccgctggtgatacctgggcaaacagggtctggagtggacctccagcaaattccagcagattggatgttattggtttatagaaatgctactgaattttggacattgatattctatcctggaactttgttgaagttgtttatcagagctgggacccttttgtcagagactgggattttctaggtatagaatcatattatctgcaaacagagatagtttgacttcctcttttcctgtttggacaccttttatttccttctcttacctgattgctcttgctaggacttccagtactacaatggctaggagtgatgagagtgggtatccttgttttgttccagttctcaaggggaatgtttctggattttgcccattcagtatgatgctggctgtgagttgtcacggatggctcttattattttgagttatgtaccttcaatacttagtttgttgagggtttttaaacacgaaaagatgttgaatgttattgaaagacttttctatgatgatcatgtggtttttgtttttagttctgcttatgcaatgaatcacatttatggatttatgtatgttgaaccaaccttatatcctaggaataacgcctacttgatttggtagattagcttttcgatgtgctgctggatttttgttgaggatttttgcatctatgtttatcagggatattggcctgaagttttctttttccattgtttctctggcaggttttggtatcagaataatgctggcctcatagaatgagtgagggctcagctcaggctctttgttcactccccagcttgcaggcagcaggggcagggaccttggcagtgacaatgttagagggcgttacacttacctcttggagctccaacccagagaaatgcagagcctctgctaaccaaaatgatcagcccggggtggagtggctacatcacacacccaagttgtaggccttgcctggtggtgagcagggggtgggggctcacagggaagacagtctggcctctttgggaaagagcaaagaacctgagtgcctgtggtgtgctggaggtgtaataaggcactcaggttctttgttctttcccaacctggtggcagcaatagcaggcaccgctgtagcagtggtgtcagagggatcgtcagttgcctctgagaactccaccccagagatacatgaagctactgccaatgggaatgatcagctgggggtggggtggctgcatggcaggcccaatccaggggccctgcctggtgtagagcagggggtcaggggttcacagggaaaagagactgggttcctctctgtatggcagctgcagcatgctggaggtaccagcaaaacagtcaggatctttgttctttccccagcccgagggcagcaagtgcaatatccctgcagctgagatggtagacagcctttgggtcgtctctgggatttcctctccagataaacgcagtgccaccactgactgaagtgctcaggcgggggcaggatgactgtgctggggtccaggttgggaggccctgcacaatgaggagtagcaggggcaggaatccacatgggaaatagtctggctgcttttctgtatggcagctgcactgcgttggagacatacgatagtccttaggctcgtcacttactccctctgccgcctcagggcagtaggggtgggggctgcagcagcagcaaaaaggcagaactttcagttaactctgggagctctggcccagggaagtgcagagtcgctactagcctaagtattcaggcaggggtgtgttggctgcgctggggacctgggccggtgggctttggctggcaaggtgtggcgaaggtaaggcctatagtctgtctgctcctcagcactgtgaaagcagcatgtatcttgggagcatgcaagagggcttggcctcacctgctggcagagctatggcagctgaccctgggatgctcaggagcccaaggcccttgaggctccatatgtgcctgagtggcagctctgcccagactccgcacagcgctctgtcagtctggaggccctggagagagagggtcaggggatctcctgtgcccaggattgcagagatgcatggcaagagtatgggctcctgggggctcttgctcactcaccctttccctgtggtgagaagccttccttggctccatgccaatcccaggtgggcagctgtcctgtctcactcttctctcggggttttgttgcttccttgatgagtcccaacgtgtcctcctgggcaatccagttgaagaggtagtgtttattggccattctgtccctttatattatgcaacccatctgagccatagtccttcagccacatccatgaccaagtgcctgggagatttaaataaactcggtgctccgcttgtgtagtaaaaacagactaccacctaagctgagatttttaatcatcacttatggaaaggatatccatgaaagtccattaaaactatgaatatatacagattgaatatctgataagacacatcttgaaaatacgtaaatattttgatgcataatgtttaaggaaggagaaaagaacagagacctttttttaaccttttcgtcctatgtgatatctgtatttagaatacagttaactcatctgcaaatccgattctaaataacagagaaaaaaatctatgttaatttttccccatttcacttgtattatttggggatatgtaatttctaaaaggcaataggcaatacaatgatattttaatttttaaaaacaagcagtttttttttttttttttttttttttgcttttctcacttggaatgccaatcaacaagggttttttggttttttggttttttgcttgtttgtttactccacttataatgaaatcaagtagtttttctgaacagaataatatattcaggggaagaaatagcttataagattattgactgaatgtgaagctcaaacattaaatgagatgaaaaaactaaattagttattccctgagacaaacagggatgggagaatacctctgggaggcagctccttttcctcagttttacttatgtatttagttcaacatatccacacatagtgcttatcatataccaggtactattgtaaaatacgtaactgttgatttactggattctcataactccctgggaaggttattattatcattttgcccttttacctgaggcaagtgaggctcatacacggtgtgatggttgattttatgcatttacttgactgggcatggggtgcacagacatttgatcaaacattcttctgggtacttccatgagggtgttttctgatgagattaacattgcaatcagtagactagttaaagaaagcagattgtccttcttaatgtgagtggccctcatctaatcaccagaaagtctgttaagtagaacaaaaaggctgattcttgagcaaataagaaagaactgctcctgcctggcggtttcagcttggacattggtgtcttctgtcttcagactcagctgaaacattggctcctcagactcacactggaactacaccattggctctcccaagtctctagcttgtcagttgcacatcttgggacttctcagcctccataattacatgagccaattccttatcataaattttattatatatatgcatgtgtacacacacacacacatgcacacatatgcacacacgcacgcacacgtgcatgcacacacacacacgcactcacacatacacacacaatctgtttatccagaggactctaatacagggagtaagtgtctcaaggccacatagttacaaagctcacccagggagtctgactccagggcccatgctctgggcatcaaatatcactcaatgttcacataaaacataatgtcttaggcacattacatgtacagtaagtcataacttaatgtcattgataggttatttgaaattgcaactttaagtgaaaagacatactgtatgccataggaacttaactcttatatcaattagcatatggtaaaattggttttgttatatagtacaatattttacttaaagttgcagtttcttttttttttttttttttttgagacagagtctccctctgttgccccggctggagtgcagtggcgcgatctgggctcactgcaagctccgcctcctgggttcacaccattctcctgcctccgcctcctaagtagctgggaccacaggagcccgccaccaagcccagctaattttttttttttgttgtatttttttttttagtagagactgggtttcaccatgttagacaggatggtcttaatctcctgacctcgtgatccacccgccttggcctctcaaagtgctaggattacaggcatgagccaccatgcccagcctaaagttgcagtttctaagaacctgtcaatgccattaagtgaagacttactgtactcctgtgagatcaatactaatatctcaatttgagaaatgaaaaatttgagtctcagatgatttaagcaaaatacccaaggttacatagttctatgtagctgaggtagaacttgaacccagatctttgtggctccaaacaccattttctttccaatttgccttctgtcagttatctacctttaattaatataagtatttatctacctttaattaattactatacataatcatgaaataagctgaattatctctgcattttaagatctagataaaatgggtttattaccacactggtggaaaatcccagtagccctcctgcatttatgtgaatttcagattccctgactctgaattgacaagttctctaaactcttttttctctttgcagcatctagaaacttcttacttccacatgaggaatgcaatgtcatttgttggattttcacatgacaacaaaagaaaataataaacaagaccttgcttgcatggaaaattcattgcctattgtaggaaaagtcagggatgtcattacacagagcaaagaaaataacagaggttaatcaatgttactgctagcttgctcttatatatacttattttcatttctgatgcttttttcctctcaagggtaaaaaaacaaacatcaaacctctataaatctctcatgcagggcacccagctttctgcagctctgtccttctttggtttgtaatccacacttttgaagcccttctaagtgcattcatagacaaggccatctctccccttggcctctgactgtggggcagggggtaaaaagtgggaggtgggttatatgcttctagttgggtaaatgctaagcgtttttatgtgggttgcattttatttttgctttctaacaaacataattgaacattcagaaagggtaagtaactttccaaaagtttcacagatactgaaagataagtcagggttcatactttggtctgtctgatcacaagccagactaagatttgaacttctatgagactgtttcctcaaatttaaaatcagaatcatgttatctaattcactggctgaaccaagctcattcctcacccattttttattggtacttcttaaagaatgtggtcctcactctctagattccatgttttgagcgtaaaattcctatccctgtaccccaggcagagaggactggaccaggcgtggacctctgacctacaagatccaaggcattatgtttgcctggttcatcacctccttcaattgtagatgctgcagatgctgccctctctgtagaggtttaagtaaacaggaaagaatgtttaatgaaaataaggggaacaaagaaaccatgtggagtaaaagcagagatgacacatcaggaggccacaaatgaacaataagtgaaacattagttcctggacctcaaaccttcatgccagcattcaggaggcttcctaggcaaggaagtaaattggtgtgaggtgactgaactgcaagatgaggtggaatttcaacattcagactgccctctctgcagaggtttaagtaaacaggaaagaatgcttaatgaaaataaggggaacaaagaaactatgtggagtaaaagcagagatgacacatcaggaggccacaaatgaacaataagtgaaacattagttcctggacctcaaaccttcatgccagcattcaggaggcttcctaggcaaggcctgtcagctgtcctatttcttccactagatctctttcttttgttttgtttaagctagtttcaatgacaggcaactatctcttgtaatgaaatgatcctaagataaagggttattgtaaagttcaaatgtaattagataaggaaatgtgcgtacatgtggttagcacatatctagaaaatgatggttattaaagagtaactgtttggttacaattatctcaatcttagcactattaaaatttcccggaggtcagcctgcttttttcaggacaaggattataatattccacgagattcaaattagtcatatatttttaatttgaaaagaaaactacaaaagatgttataattcaatgtaagcacactttatagcaaatttattgtttgatttcattttcatgctatattaaaattttttgtatcagtgcttgtccaacatggtacaatggaaacaatcacattggaataatcaaatttttgaattacttataatatgctctttcattttaccagattttttgaaacaaaaaatgaatattgaagaatattcatagtatctatagctattttctgttcagtttctgaaagaatgaggaatagtagcttttcaaaagttggattttggtttttgtttaattataatatcattcaaaggactaataaagactaaaaggaacaatgactttattgtaaagatacatatagactgactcttcaaagtcaccatgaggaaggctgcactgtggctatttaaatgtaaatatatttaaatcaaacaaaactaaaaatatagttttttagttacatgagccacatttcaagcgctcaatatgttgctaccatattgcataggtatggaagatttccttcaccgcaggaagttctgtaaagcactagctttctccacatctttctttctttattaggcattgttttccataaaattttctacctgctatgaccactcaaagctctacttccatctcacccatgggcaaaatatgcgctacagtggccatttacctttttgttaaagtcacagaaagaatgtagtaacactcttattttttttaatccaacaacctcttttaattgtgaaactgctgcctctgactacaagcatgagcaattgaccaggtctaatctcatcaaccatggctccttatattccttactctagttgtgagtccaagggtaggcatggaatcgtattaggatcatagatcctctatgagattataatattccaatattggggcaagataggtctctcttgcttttacttggaacaagtgatcgatggagatggcagaggccatcttggcaccatagggaaaaggcctgcttgagaatgaagctaagcaaatgcaaacagtgctgagagatgtggcattgttcctaaatctcaacgtgtgaaaaaaccaattcctttagcttgaatgtggttacagctgtttgcaaacaaaatatttctgaggctgaggagggaggattgcttgagcccaggagtttgagatcagtctgggcaatgtagcaagaccctgtttccatgaaaaaaaaattacctgggcctggttgtgtgtgcctgtagtcccagctacttgggaggctggggtaggaggatctctcaagcccaggaagtcaaggctgcagtgagccatgatgacactgctgcactccagcctacgcaacagagtgagaccatttcaaaaaaaagtctggttaatatatgggtatttgtgcattttatggcattgtgtattaaaagatacatatttacaatactacattatttaactctctaagtagatttctatatagtataatactgccattatgttttgtctttgacattgcatattgtcaattttattcagtttatttagtgcatactttatgtaaggtactctcatattcgacaaaaattcttctaataaaataaatggacaaatcaagaatgtatcaaagaatatgagttctgtcttgatcattggtacagtttggatatttgtgccctccaaatctcatgttgaaatgtgatccccagtgttggaagtggggcctggtgggaggtgtttgcgtcataggggtgggttcctcatgaaaagcttggtgtcctccctgtggtaatgagtgggctcaggttctattagtttacaggaggtctgattggtaaaaagagtctggcacttcgttccctctctcgccatgtgagaggccaactcccccttcaccatctgccatgattgtaagcttcctgaggcctcaccagaagcagatgctgatgccatgctttttgtacagtctgcagaactgtgagccaaaataaatctcttttccctataaaccactcagcctcagccgaccgcggtggctcacgcctgtaatcccagcacttcaggaggccaagatgggtggatcacgaggtcaggagatcgagaccatcctggctaacatggtgaaaccccgtctctactaaaaatacaaaaaaaaattagcctatcgtggtggcgggcgcctgtactcccagctactcgggaggctgaggcaggagaatggcgtgaacccgggaggcggagcttgaagtgagccgagatcgcgccactgcactccagcctgggcgacagagcgagactccgtctcaaaaaaaaaaaaaaaaaaatcactcagcctcaggtattcctttatagcaacgcaaaatttactaatacaatcacaattactttttaaatgcaaactagctgggaaagttgtctgtctcaaatatttaagactataattttatgatcatacaactcatactcccagcactcagtaaagacaacttatatttctgtcagtctttcatatgcacaattagaaaatgattaaaatagtctgataatagatttccctgttaagttcagaagcccagtattctttcttggtttttaactggcatgctacttttaattttatatttatttctgttaatgatgaatatagaggcaataaatactacttttctttatataggattggattacaattaactgatgaatttaggaaaggacttaaagatttatttttatcatcttgtaatttaaaacaaaacaacagggctataaactccaactatgcaagtaaatgtaaagctcaacttcaaaaaataaatgacttgacaatgatgaaaaagtagaaaatgtttgagaaactttatagaaatatccttttacttcaaaaacaggagaaatgtgtactacaggtaggcccctacttacagactcctaattattcatatgtgaattctcagaaggcaagggctgggggtaatactgcttttaatgaaaatctgcttttatgagttttcagatgccataaccaaactgacattgtgtaccgttgttctctggggagcttcatgcgcagaatgaactcatatgttacatgaccttgggtcaaacaatatcttaaagaagtaatcagtataacatttcagaaattgaggtggccaaagtcggtccaggaaagtctctcaggatttgatatgctgagtgcaggagaattcattttccattcagagaaaaggtcgtacaaagtattcatgtgcctcaagtgctgaaagcaatatagaagaagaaaaattgggcttaaacaaaattttaaaaaatctgtcttcattttctcccccatgatcctttatatctaggaaggctattactgtggagaggacttaatatggactatttagaccagtcatttgaataaacgtcctaacaacagcagaaaaacatgatcagtgttctgcagaatctggacttgtaatcaagtagtcagtgtttaagagacaagtttaggtcatggaaatatactggagccaaaaatcagaattctagtttttgctccagcactgatttgttcagctatgagtgatgttttcagatagatttctttagggtaggaagcaataatgttatatgacttggaaaggcttgatgaatgttactgagtaaatagatgtttgctgattgctgttgaacagtggatcaaattattaaagaaaagttaggatagaaaaatccaaatacaggcggggtgcggtggctcacgcctataatctcagcactttgggaggccgaggcgggcggatcacgaggtcaggagatctagaccatcctggctaacacggtgaaaccccgtctctactaaaaatacaaaaaattagccgggcgtggtggcaggcacctgtagtcccagctactcgggaggctgaggcaggagaatggcgtgaacccaggaggcggagcttgcagtgagctgagattgcgccactgcactccagcctgggagactgagcaagactcggtttccaaaaaaaaaaaaaaaaaaagaaagaaagaaaagaaaaatctaaatacaaaattataacagtatgtagccatttagagtccattagttacaaagctgttaagattatagatactgcatattataatatatacctgtggaatttctggaactgatattgtttttgtttaggcagttgccagtttggcaacattttacattttctgtagtgagtgaaaacaaattatttgatctgtaattactattttatgaaacatattatttgactgttaaatcatcaattcttttggagctggccaacaatgtaccaatttatttttagtagtgcagcccatgataaagaaaagcagaaagccactaaggacaaaaagattactgagagctcctcctcattgtacttaaattttgtttaggatgagataaatggaaaaagagcttcagactttgaagatctagaaatttgggcaaattttccaaatgttcgtgtggatgagtaaactgtcacatttccagaacgaagaacattgttttttattctgcatggagtagtattagggaaaatgttcaattgaaaaagttaccatataagaattatatccagagtatcatatttaattgattttttgcttacgcaaaaaaaaaaattcaattatcaatgtttttgagcaaaaataaggcaacaggtcaggctctaaaaataaatataagactataaaagatgcatgtcttatattctaccatggtaaatggggcagtggtaaaggagaatgcagagtcctccttctggtatacagaatttatattattgctttattattgcctcacacacatcaacccttgaggcagaaaagatgtgttcatagaaagcaacttaccagtgaccgtgccagacatgttcaaatatgcttcactatttgaagcatggtaagaatacactaatattatctacactaataactaataacatggtaagaatacactaataacatcgacaggaattcagtaaagatagaaatctgacaatagtaacaaccatcattaattaatgagtccttgttatataccaggcactgtgttagtgctctctgtctttctgtctgtctctctctctcagaaactatgcatattcatatatatttatataaaatgatcatacaattccagcagccacataaaagtttggaagcgtttccccttttttctctttttgaagaaatggggaaacacaggcacagacaaatatggaaactttgcagcattcatgcagaggatgcagaatggagcctgaattaaaatgctccctcggatagaagaggctttctttctagaaagactgtgtggtgaaggtcctggattgtgacaaatatgctatttcctctaaacccagactccctcctcttcaggtggtttgaaccatctttcctacccctaaacctgtagattatgcctccatctctcccatccttacactccactcaaaaggtaagctgctctcttcgttctttctcttagtccattctgcctccaaatgtctccaccatactctctctggaacaccattccattctcatcaactccctccacatcctctaccttacacaccttgacttaagtgagccttctataaagacactgcccacctcccacctccagcaattgcaaagggatgcttctcagagttggaggcttcttggggttgggaggagaggccagtgttctccaccctcagtgcagttccagaccattcctcctatgaaacaaaccctttcccttgaggctgacaacatccagccatgtgaccctgtacttctttctcacactcttttgcttttactgaagactttgaagctttttctctaagtttcaccatcatttttgtatctggcacatagtagttgctaaattatattattaaaaaattcacagtgattattcttaataaattatgtgtgatacactcacaattcatggtgaaatgaccatgtatctcgagaagagagttgaaaaggacaatgaggacaccccttcccatactccaaactctaagttgcatgatcttgtcagtctcaggattgtcagccatccactcccacagccaaatcctagacatgctggagcttcgaaatattcgattataatatcacatacatacacacttattccaaactgcattcctccagccatcactcatcacctccactctgcctttcttcattgtattgtaaagaatgaattgggttagtgtgacagtctttatcagtattcccattactctactactttgtcttcctactgtacctcctgtggaaaaaaattccacatcatcatccaccagaccgtcttctgttctcctcctacacaaacaactctcctacagatgaagaaactcatataactgcattaaaagttcatttgaaaggcatagttgccaaactcagttggaataccacctggtatttctatattttcctgggcaactttctctttcacttcccacagagcatatttcaaacttctattgtgctttagttttctttattacatcaccatatgaaagtgtaattcatttattctgcacttacttactagacatctgttatgtgtcaggcaaagggtgctgggtattatggtagaaaaaagtataacatttgagtttgttccctctcacttctgcctttgttcctaaaagtattcacctatctctgtgcccaccttgcctaggggaagatatatctccctccatgcccaaccattctacctgtactctgttagctcagccattacctcagttagcttatccctctctcctctacctgaaaattctccatcctactggctcactgccccagcagcacttacacttatttatttctgtcctatctttaaccaatcaatatgaccactctcaaccattatgtttgcttctaagtatttccctatatcttctacattcttcagacccgcggtacagttgaccacgctcccctcctcgttcatttcattctctctccagcctcctgcagtttggcatcttcactattctaccgcagcagtcccttccagggtcaacaaagcctctttattagaaaatgcacagggcatttactttcttcagtctttgaactctgcaggcattttgtgtgtgtgtgtgtgtgggtggagacagaattttgctcttgctgcccaaggctggagtgtcatggcacaatctctgctcactgcaacctccacctcccgggttcaagtgattctcctgcctcaccctcccaagtagctgggattacaggtgcctgccataatgcctggctaatttttgcattattagcagagacagggtttcaccatgttggccaggctggtctagaacccctgacttcagatgatctactcgcctcagcctcccaacgtgctgggattacaggagtaagccactgtgcctggccaggcatttctttttataaacggtgtaccctgcctctgggccaccagaggttcctggtcttcttccactcacctctatgttcggttactctgcctgtcatgacatgcggtgatcctctatgttcattcttctctccttacagtttgtgtgttccatgaatgacattatttactccctcaaatccaagtgcatattttatttgtgtgaatccccaataagtaagttcctatggacagaggctgtgcatgttcgttgttttagtcctgacacctatcacagctgcctgacaacccagtgcccagcaacacagaaaaatgcacagactgaataatacaggaaattgtaggctgggcgcggtggctcaggcctataatcccagccctttgggaggccgaggtgggtggatcacgaggtcaggagatcgagaccacgatgaaaccacgtctctactaaaaatgcaaaaaaattagccgggcgcggtggcgggcgcctatagtcccagctacttgggaggctgaggcaggagaatggcgtgaacccgggaggcggagcttgctgtgagccaagatcgtgccactgcactccagcctgggcgacagagcgagactgtgtctcaaaaaaaaaaaaaaaaatacaggaagttgtaaccaggaggacccactgaaagtggagtgtattctttcactcagtattcactgggaatgcactatacactagttccaatgcttgtgttgggaattcagtgaagagcaagaaagacaaagtagcccctggcacttacattctagtaagggaaatagtcattaaacatatgtactatacagggagtcagagagtgacaagtgccacgaagaaaataaagcagggaagggagttacagagtgatagaaggtaaaagtgcgccagctagttagggtagtctgggaaggaaggctttttggtggcattaaccctgaagaaatgaatgtaatgagaaaatgcctagcggctatttgaaagaaaaccatttcaaaaggaggaaatggtaagtacggtgaagtgggaaaggctttggggtacttgaggagcagaaatcaggccaaagggattggagctgaagttctgattctaggtagaatataggaggcagtggcactgcatcactcccactgcaacaagtagttcaaaaagtaaagaaattggaaatgtaatcgttttaaagatatccgagagctgtggtggcatagatgattagatggactacaagtgaagttgagatgactcctatttccttcactgagaggcaaggtttctgttcagacttgccctaagctgaggtgtttcgccaggggaaagagaagacaatagagcttactttctacgtagcttcattgaggtatgactcatgcaccgtacaattcacccatataaaatttacaattcaatattttttagtgttttagagatatgtgcaaccatccccacagtcaacatttgaacatttttatcacctcagaaataaaagccatggccgggcgcagtggctcacgcctgtaatcccagcactttgggaggccaaggcggacagatcacgaggtcaggagtttgagatcagcctggccaatatggtgaaaccccgtctctactaaaaatacaaaaattatccaggcattgtggcacacacctgtagtcccagctacttgggaggctgaggtaggagaattgcttgaaccctgcactccagcctgggtgacagggcaagactccatcttaagaaaaaaaaagaaagaaaaaaaaggcacatgcttcagctattactccttgtcttcctaagcagcaactaggcttctttctcccagtagattgtcctattgtggacatttcatatgagtggagtcaataatatgtggtcttttgttactgacttctttcagttaacataatgttttcagggttctccatgttgtggcatgtatcagctcctcattccttttttgtgagtaaacaaaaaataacaaaatttaacattttaaccattttcaagtgtacagtacagtactgttaactgtatgcaagttgttgtgcaataggcctctgtaactttttcatcttgccaaagggaaactctgtacccgtggaaaaactccccatttccccctcttccctagctctggttgtcacattctactttctgtttctatgaatttgattactttagaaaacgtatacacagggaatcatgcagcattattccttttatgactggcatatttcatgtagcataatgtgctcaagccttatccgtgttgtagcatacggtaagattttcttctttctttaggctgaataatattccagtgaatatatggtttatacattaatgatttgtcaggagatattagtgttcttccaactcttggctattgtgagtaatactgcaataaagatggatgtgcaaatatcttttcaaaatcctactttaaatttttttgatatatacccagaagtgggattgctggactatatggtagttctgttttaaattttttgaagaacctctgttttccatagtggctacaccattttacgttgccaccaacagtgcacaggggtttcaagttctctatatccttgccagtatttcttattttctgtttctgttttgtctttttggatagtgatctagctaagagatgtgaggtgacatctcattgtggttttgatttgcatttctctgattagtgatattgaacatatttttatatgttggccatattgatgtcatccttaaagaaacgtctattcaaatactttgttaatagggttttttgtttgtttgtttgtttgtctagttttgatgttgttgagttgtaggaattctctatatgtttggatattaaccctcatcggatacatggtttacaaatattttcttctgttctgtacgttgccttttcactctcttcattatttcctttctgtgaagaagatctgaagtttgatttagttccatttgtatatttttgcttttatttcctctgcctttggtgtcatgtccaagaaatcattgccaaatccaaaaacatgaagcttctcccctatatttttatcttactaggtaattttataattttataaattttagttttataaatataattttataaattacagttctataattttaggtcttacatttaggtcattaatccattttggtttgtttgttgttttgagacagggtctctctctgacaaccaggctggagtgcagtggcatcatcacagctgactgcagcctcaaccttctgggctcaagcaatcctcctgccttacccccacctctcccagtaggtggcactacagggtgcgcgccaccacacccgggggaatttttacattttttgtatagacgggttcgcagtgttgcccaggacttgagcgatcctcccacctcagcctcccaaagtggtgggattacaggcgtgagccactgcacctagccgttaattcattctgaagtgatttttgtatataggtacaggaaggtaagggtctaacttcattattttacatgtgaatatcaagttttctaagcaccatttgttgaagacactatcttttccccattgtatagtcttgatgcccttatggcagattattttaccatatatgtgagagtttatttctgggctctctattctggcccattggtctatatgtgtgtctttattccagtattatgctattttgattactgtagctttacactgttttttgaacttgagaagtatgagacctccagctttgtatttctttctcataactgtcttgactatttggaatactttgagattcctaatggattttggattttttttctgtttctgcaaaaatttccaatgagatttttatacggactgcattgaatctgtagatttggggggtagtatgaacactgtaaccatattcttttccaatccaggaacatgggatgtctttatatttattcgtgtcttcattaattactttcagcaatattaagagtattcagtatacaggtcttttgcctctttggttgagtttattcctaagtattttattctttttgatgctcttgtaaaggggatttaaaaacattttcttttctgattatttattcttagtgtctagaaatgaacctgatttttgtgggttgattttgtttcctgcaactttactgaattagtttattagttgtaacagttgtctctgtgtgtgtgtgtgtgtgtgtgtgtgtgtgtgtgtaatccttcaggttttctacatgtaagattatatcatctgcaaacagagataattttatttcttcctttcaaaattgaatgctttttactcctttttcttgtctaattgctctggctagaactttcagtactgtgttgaatagacatggcaagactgggcatgcttgccttgtttctatttgtagagggaaagcttgagtatgatggtagctatgggcattacctatagggcttttaatatgttgatgtaattttcttttatttctatattattgaattttacatgaaagggtgctgaattttattaaaagcttattattgcactaattgagatgatcatgtgacttttttacctttctgtcagttaatatagtgtattgcattgactaatttttgtatgttgaaccatccttgcatcccaggaataaataccacttggtcatagtgtactgctgaattaagtttatgatattttgttgagaatttttgcatcaacattaagcaagattattggtgtgcagtctttttgtggtgtccttctttagcattggtattaaggtaatactggcctcataaaatgagtttgaaagtattttttcttctgaaatttttcagaggagtttgagaaagagtgatgctaactactctttaaatgtttggtaaaactcatcagtgaaaccgtctagtcctggggcttttcttcattgggagatttttgattactaattcaatctcctaagttatagatgtgttcagattttaatttattcacaattcaatcttggtaggtagtatatttctaagaatttatttcttctaagttatccaatgtactggagtattgttcatagtagtctctcgtaatctttttacttctgcgtcctcatttttaatgtctcatttctgatttgtgttactttagacttctattttcttacttattgaaagaatttgttaatttttttatttttttaaaaaactcttatttcattgatttttctatttttttaatttattctctatttcatttatgttttctgtaatctatgaccttccttttgctaactgtaatctaggaccttccttttactaactttggatttagtttgctattctttttctagttctttgagatacaaaattatctccaattattgattggggttcttcttttaaaaatacaaacatttactgccacagttttggtgtgttgtgttttcattttcacctgctttaaaatactgttaaatagtgatttcttgactcatcaagttgttcaagagtatattgcttaatttccacatctttgtgaattttctagttcagagttttctagtccagatttctagtttcatgattattagaaaatatagttggttttctttcagtttttttttgaattgttaaaacttgttttgtgtcctaatatgtgttctgtcttggagactgttttatgtgcacctgagaagaatgtgtatattaacatagggtggaatattgtttatatatctattagagtcaattcacttttagtattgttcaagttctttatttccttattatttttctttctggttgatctatttattattgaaaaagagtattgtaatctcctcctattattttttttaatctaattcttcctccagttctatcaatgtttgcttcatgtatttgggtgctctgctgtttggtgcatatagacttataagtgttgtactgtgaattgacactttcatcaatatgatgtgtcttgtttttctcttgtgacagtttttagcttaatgtctattttgtctgatatatgtatgggcacccttgctattttggttacctcttgcatggaatatatttttctattccttcattttcagcctgtgtgtgttttcaaagctaagtgaatctcttgtagatagcatgcaattggatctttttaaaattgattccgccactcggtcttttgactgcggagtttaatccattcacacttaaagtaattattgatggggaaggacttactattgcaattttgttaattgttttcagtatgtcttagagttgtttgtccctcttttcctctcttgctgcctttgtgtttcattgatttttttgtagtgttatgctttgaggacttccttattttctttggtatgtcttctatagcaattttctctgtaagttaccatggggattatataaaacatcttatagctataacaatttatttaaactaaaaatttaattcaattgcatacaaaacctctactcttttacctccaattcaccttacattatcaatgtcacaaattatacttttagtattttgtatccattaatataatttaataattatggttatttttatgcttttatttatacctgatttaaaaatgatttatggaccactattgtagtatgacaagattctgcattttttttttttttttagacagagtctcactctgtcacccaggctggagtgcagtggtgcaatttcagctcgctgccagttttgcctcctgggttcatgccattctcctgcctcagcctcctgagtagctgggactacaggcacccgccaccatgccctgctacttttattttattttattttttatatttttagtagagacagggtttcaccgtgttggccaggatggtcccgacctcctgacctcatgatccgcccacctcagcctcccaaagttctgagattacatgcttgagccactgcacatggcctagattctgcatttgactatatgtttacctttaccagagagccttatacttttgtatgctttcaagttggtatctagctttcttttatttcaactgaaaggactaccgttagaaattctagcaaggtaggttaatggtgatgaacttcttcagcttttgtttatctgggaagatctttatttctccttcatttttgaagggcagatttgctgtctattcttagttggcagttttctttctctttcagccctttgaatatactaccccattccctttcagtctggaatgttcctgctgatgagtttgctgataatcttatgagagttctcttgtatataagtcacctttctcttgctgctttcaagattgtctgtcttggacttttgactgattataatgtgtcatggtgttggatctttaggttcatcttagacagagtccttcaagctgctgaaatttggttgtccatttcatttttcagatttgggaagttttcagccatttcttcaaataagctctctgccacaggctactcttcgttgtgcaatctgtggacccagttgtcatctgccaccactgtctagttatcttttgactgccacaagtggactccaaaaaatctccaaaagaaattgttaccataacaagatggccaactagacacagccaggaagcactgctcccactgagagacaccaaaatattgagtacaccaacgtattttgagcccatcttcagagagaaaatgctgagagtcattacagaggtgatgcagacaacaaggctgaagagggaggaagctggaaaccctgcacaggatacttgcatgacagggctagttcccagacctggatgcctcctggggaagggataagtgaagggatggagggacaggccactctcactgtggacctctgggatcctaggtacatagaacttcacattctccatggacatttgagctggcagggggatcttcaaagagagttggcagagacagggcttcaccggcatggagcctaggagcttttgtgcatgtggagctgtggcagagcatggcctagacacccatcccccagggctccccacctccctacaggcagctctagcctcagctgattgctggcccaggagagagtgtggctggcttccctgtgggactgggaaacttccagggcccctgcctggccaccctgcaggaggtgtgcacagagtagcctctgctgccaagcctgggtgctttgcttcacctgagtaccttcctggtggcctgggagcactttggatcccccagaacagctggggcccaatctcaagggtctggaggatgaagctgaaagccagtcctagctccccaaaactacacaaatacatggaaattgaacagcttgctccagaataactcctcggtgaacaataaaattaaggaagaaataaaaaaattctttgaaataaatgaaaatagggacacagcttaccaaaatctctggaacacagctagaacagtattaagaggaaagtttatagcactaagcaccttcagcaagaaattagaaaggtctcaaattaacaatgtacctttgcaactagaggaactagaaaaaaacaagccaaccccaaagcaagcagaagataataaatatctaaaattagagaagaactgaatgaaatttagacacaaaaatccatagaaaagatcaatgaaacaaagtgttttttcttcaaaagaataaacaagatcaataaaccactagctatattaacaaagaaaaaaagagaagatctaaataagtacaatcagaaatgacaaagaagacattgcaactgatcccacaaaaatacaaaagatcctcagagactattatgaacagctctatgtacacaaattaagaaaacctagagaaaatggataaattcccggaaacacacaaattcccaatattgaaccagaaagaaaatgaaaacttgaacagaccaataagttccaaaattatatcagcattaaagaaactgccaaccccaaaagaaaaaaaagaaaaagaaaaagaaaagccctggaccagatggattcacagacaaattctctcagacataaaaagaagaactggtaccaatcatattgaaactattcaaaaaaatcgaaaaggaagggcacctctctaacttatcctatgaaaccagaatcagtctgataccaaaatctggcagagacacaacaaaaaaagaaaacttcaggccaatatacctaacgaacataggtgcgaaaattctcaacaaaatactagcaaactgaatcccgcagcacatcaaaaagttaatttaccacaataaggcaggctttactcctgggattcaaggctgattgaacatatgcaaatcaataaatgtgatccaccacagtaacagaattaaaagcaaaacccatatgatcatctcagtagatgcaaaaaaagctttcaataaaatccaacatcccttcatgataaaagccctcaacaaactaggcatctaaggtacatacctcaaaataataagagccatctacaccaaacccacagccaacagcatactgactgggcaaaagccagaagcattccccctaagaacaaaaacaagacaatgatgcctactctcactgctgctattcaatgtagtactaacagtcctagccagagcaattaggcaagaggaagaaataaaagacatccgcggctgggtgtggtggctcacgcctgtaatcccagcactttgggagaccgaggcgggcagatcacgaggtcaggagatcgagaccatcctggctaacacagtgaaaccctgtctctactaaaaatacaaaaacaaaaacaaacaaacaaacaaaaaagacatccgcatgggaaaagaagaggtcaaattatctctcttcactgacagtgtgattctctctttttttgaaactgagtctccctctgttgcccaggctggagtgcagtagcaccatctcagctcactgcagcctctgcctcctgggttcaagtgattcacctgcctcagcctccagagtagctaggattacaggtattcaccaccacgcccggctaatttttgtattttttagtagagatggggtttcaccctgttggccaggctggtcttgaactcctgacctcaagtgatctgcctgcctcagcctcccaaagtgctgagattacaggtgtaagccaccatgcttggccactgataatatgattctatatctagaaaaccctaaagactctgccaaaaggcccgtcaaactgctaaatgacttcagtaatgtttcagggtacaaaaataatgtacaaaaatcaatagcatttctatatataactgagtacctcagcctcgaaatacatttttaaactatttttttcctttccttcctaatctcagaatgtagccttatagtgtaagactctttgttatgccctttccctacaggcatatctgtgtacagtgcttgctcatctaactatgtgcttgcttagaaattccaggagccaattttgaaacaaaccaggcagagagaccaagccacagatcttcccactcaaggggagttacgcccaagtcaggatgatgcaaatcagatctctagatgggagattacttgagataactatgggaacaagacatgcagatatgcactcccttttcactactcatgtctatatcccacacctttttccttcttaaaccccttcactcagcccagaaggctgagatggctcttttgaggcttatgcccagacattgtcccatctgctagcatttgaccaataaaagttgctttcctttcaccacacctcagttctcatgctttgacttctgagaggagagcagctggacttgagctggttacatatacaccaataatgttcaagctgagagccaaatcaagaacacaatcccatttacaatagccacacacaaaaatgaaatacctaggaatacagctaaccaagaaggttaaagatctctacaaacctgacaatgttggtgttgtcgtgtttggaaatgattaactgattaaggaaggagctagaatgaagaggacaagagccattgtggacattccagttggtgaggagctgttgggtcatgtggttgatgcccttggtaatgccattgatggaaagggtccatttggttccaagaaccataggtgagttagtctgaaagcccctggaatcattcctcaaatttcagtgcaggaaccaatgcagactggcattaaggctgtaaatagcttggtgccaattggccatggtcagtgtgagctgattattggtaatggacagactgggaaaatctcaattgctattgacacaatcattaaccagaaatgtttcaatgatggatctgatgaaaagaagaagctgtactgtgtctatgttgttattggtcaaaagagatccactgttgcccagttggtgaagagacttacgatgcagatgccatgaattacaccatcgtggtgtcagctacggcctcagatgctgccccacttcagtaactggctccttacactggctgttccatgggagagtattttagagacaatggcaaacatgttttgaccatctatgacaacttatccaaacaggctgttgcttaccaatcagatgtttctgttgctctgccaaccccctggttgtgaggcctatcctggtgttgtgttctacctatgctcccagttgctggagagagcagcccagatgaacaatgcttttggtggtggctccttgactgctttgccagtcatagaaacagactggtgatgtgtctgcttacattccaatgaatgtcatttctatcactaagggacagatcttcttggaaacagaattgttctacaaaggtatccaccctgccattaatgtcggtctgtctgtgtctcgtgtcagatctgctgcccaaaccagggctatgaagcaggtggcaggtaccatgaagctggaagtggctcagtatcatgaggtcaccacttttgcccagttcagttctgacctcgatgctgccactcaacaacttttgagttgtggtgtgtgtctaactgagttgctgaagcaaagacagtatactcccatggctattgaagaacaagtggctgttatccatgtgggtattaggggctatcttgataaacgggagcccagcaagattacaaagtttgagaatgctttcttgtctcatgtcagctggcaccaagccctgttgggcactaccagggctgatggaaagatctcagaagaatcagatgctgaatttgaaccttaaacgcctgtggatttacatcaaataccagttcagttttgtcattgtttattctagtagattagtttcatttgtgaaagggttactctcatactccttatgtacagaaatcacatgaaaagtaaaggttccataatgtgaaaaagaaaaaaagatatctacaaggagaactgccaaccactgctggaagaaatcacagatgacacaaataaataaaaaaaaattccatgctgatggattggaagaatcaatattgttaaaatgaccatgctgcccaaagcagtttaaagatttaatgctataactaccaatgtcatttttcacagaactagaaaaaactattctaaaattcatatagaaccaaaaaacagcccgaatagctaaagcaatcctaagcaaaaagaacaaagctggaggcatcacactacccaacttcaaactatactataaggctacagtaagcaaaacagcttggtcctggtacaaaaaaagacagatgaatggaacagaatagataatccagaagcagttctgcacacctatagccatctgctctttgacaaagcccacaaaaaaatgggaaaagggtcccctattcaataaatagtgctgaaataactagctagccatatgcagaacaatgaaactggacccctaccttttatcgtatacaaaaattaactcaaaatgaattcaagatttaaatgtatgacctcaaactataagaatcctggaagaaaacctaggaaaaacagtattctggacatcagccttggcaaagaatttttggctaagtccccaaaagcaattgcaacaaaaccaaaaactgacatgtgggacccaattagactaaaaagctcctgctcatcgaaagaaactgtcagtaaacagacaacctacataataggagaaaatatttgcaaagtatgcatctaacaaaggtctaatatccagaacctatgaggagctcaaacaaatcaagaaaaaacaaacaaataaccccattaaaaaatgggcaaaggacatggacagatacttctcaaaagaaggcatacaagcggccaacaaacatatgaaaaaatgtccaacatcactatcatcagagcaatgcaaatcaaaaccacaataagataccatctcaccccagtcagaatggctattatgaaaaggtcaaaaaacaacagatgctggtgaggctgtgtgtgcataaaagggaatgcttataaactgttgaggggaatgtaaactggttcagccactgtggaaagcaattgaagatttctcaaagaacttagaactaccatttaacctaccaatcccattattgggcatatacccaagggaaaataaatcattctaccaaaaagacacatacacttgtatgttcataacagcattattcgcaatagcaaagacatggaattaacctgggtgcttatcaacggtagattgaattttaaaaatgtagtagtagtacatatacaccacagaatactacacagctatagaaaataatgaaatcatgtccttttcagaaacatggatgcaactggaggccataaccctaagtaaattgttataatataggaatggaaaaccaaatacagcttgttctcacttgtaagtgggagccaaacactgagtacacattgacataaatatggtaacactaggcactgtgaactactggaaggggcaggagggaggagagatgggttgaaaaactgcctgttaggtaatatgctcactacctgggtgatggaatccatatcctaaacatcagcattattccacatacctgtgtaaaaacttgcagctatgtcccctgaatataaaataaaatcaaaattatttttttaaaaagaaattgttgtcattacaggaagtggtagatattttgggttctgcctaggctgtttctgaatcagaagggagtccatatgattctgtttgacataagtatccctgctcaaacctttctggaaggaatcaagtttatacatggagacatctgtcatctctctgaggtagagaaagccttccaggatataaatgttacctgtgtgttccatattgtcttttatgttatgtcagggtggaaacaattgaatcaaaaactgcttgaagaagtcaatgtgggggacacaggcaatgtcctccaggcttgcaggaggataggagtaataaaattagtttacactagtgcttttaatgcatatttggaggtgaaatggtcagaaatgaagatgaatctgtctttcttagctcttcacctctaaagcaatcactactctcagacaaaattgactatggacaaaaagatagtggaagtaaatggtgtttttcctcccctacatccctaacatcctgaatcccttcccttaagtctgtgaccactgggatacttggtcccactaagatagctttcctccactatgattcctcatctacatgttcagtgtcatcagaagaatgatgtccttttccagatagctgaattacacagcatttaaatttatcttatttcattttttatgagaagttataatattggaataaaaagcagaaacaaggaaagagattttctgaagtatacattttatatgagccaaggaattagtacctggaaaaataaactgtgatgtttaaaattagtttatatatggagataattatgtttcttgctaaaatgcctatcaccctactgattctcaatttgaaataagcattataacttttacatgtatgaatatgaaattttacaaatttgacaggagaggccagagaattagcttgctctttttccaccatgtaggaataaaataagaaatcagcagtctccaatcagcagttactggaactcaaccatgctgatgccttgatcttggacttcccagccaccagaactatgagaaataaatatttcttgtttaagccacgcagtttatgataatttgttatatcagcctaaactgattaagacaaaaatgctaagaaacagaaggaccacatagtaaaattccataaactgttctggaattttatatctactactaaggtctagaatccagtaggtcctcatggattgaatatggcaccagcaagggggatgtggacatgagccagatcctaacacaaaggatatttgccctcagacctcctttatggttccttccaggagtgtgcagcccagaataaaggtttgatggagtgactggtgccacaggtatgagcaatcggctcataatgggggcaacagtttggaatcagagaatcatgattattcttgtaaatgatacttatggaccaaagaggcacattgggctcagaacatagcattttttcccctaggtctgtcagcctatatatcttttacaggccaggtatgtcaagagtctacatttgggagaggtcataaaatccatataatatacattttgtacacaatttcagaatttgtaacagattatactcaagatactgcattttatctagtgtgtttttacattataatttcacagggtaacagcttctcattttcaatgctaggttacttttatgtgatattcacattttgtaccaatctggtgttcagattttatattgcttgatatgattttttaagtgcataatcactttcttaaagtttctgtttaaaaacttatgggaagcatgacataatataaattatattagagatggaatacttaatatcccctaaaataccagataacttagaccagtatcccagtatttaaatatatagttgataactcaaagtaatttatcactgtttctctgtaatcattttgatgtcacaggttgtttaaggcttaatgatgattaagaacatttagtgaatttatgaacactttaatgaattgatttaacatttcagctgtttatgtgcaaggacccataaaattatcaatttaaatgacttgagaattaaaatataatagtttattcttggagcatcactttttctctctccagttattggtcaggctatcaaatgcttttttaaaaatctaagttttaaatatttttatttatttatttattttgagatggagtttcactcttgtcgcccaggctggagtgcaaaggcatggtctcagctcactgcaacctgcacctcccgggttcaaatgattctcctgtgtcagcctcctgagtagctgggattacaggtacccgccaccatgacccactaattattgtatttttagtaggggaagggtttcaccatgttggccaggccggtctcaaactcctgacctcaggtgatccgccccgattggcctcccaaagtgctgagattacaggtgtgaaccaccatgctggcctagatatttttacatgagattgtggatgataatctcattttgggtagatttgtattctgggtagatttttatcagggatcctgatttaaaaagaaaaaaaataaattttttttctggttatgattagcatttttcattaattaccacctattttagttaaagtagctctatttaattcatacaacattttatttgttagtgcatggtgcaattaaaacaatagttacaatgtcatgaaggacctgcgccaagaatcacatgacaccacatagccatcagtacctatgacaatgctacttttaaattctcattttttaatgagaatattgaggctccaagatgttaagtaactttcccaagaatacacagctagtagattcagatttataaggccacaaagcctgggttctcagttactactctgctcactggaacttgtgggagcaaattctgatcaacttataagctcttcttccccaaaagatcttatcttggagaagaaggagacctctatactgcagagctaaagttttgagtaggtcgtgcttgacttctggggcatgaaaactggttttatgaaggtaaaatcatcagcatttccatggagcatcttgtgtttctcagggcatgggaaccaaccatctgcagtataaagtaaatttttaactcataagtcaatggaattgttgttggtatggatatcaccatattatttggcaggtgattcttattttttttttttttttttttttttttgagacggagtctcactctttcgcccaagctggactgcagtggcgctatcccggctcactgcaagctctgcctcttgggttcatgccattctcctgcctcagcctcccgagtagctgggactacaggcgcccaccaccacgcccggctaattttttgtatttttagtagagacggggtttcaccgtgttagccaagatggtctggatctcctgacctcgtgatccgccctcctcggcctcccaaagtgctgggattacaggcgtgagccaccgtgcccggcctaggtgattcttattgaaatatcataaagggcaagtattgtgacaacttttctccatgattaataaaacaaacagataatctttataatactaatcattgctgtttctttataaaatgttcttgattacttaaagtactaataaattaaaaatcagatttttgcaacatgtagaaggctcttttaaaaaaactataatattattctatattgtatttctgtaggtataatatcacatcaccataatctgcatggtctaataaaataatagactgtttctcaataaatagctttcccacaatatggaaacattggcaatgttttgtttttttttttgtttgttttgttttgagatggagtctcgctctgtcacccagactggagtgcagtggcatgatctcggctcactactacttccgccttctgggttcaagcgattctcctgcctcagcctcctgattagctgggactacaggcatgtgccactacaccaggctaatttttttgtatttttagtagagatgaggtttcaccgtgttagccagggtgatctggaactcctgaccttgtgatccgcctgcctcagcctcccaaagtgctgggattacacgcatgagccaccacatccagccggcaatgttttttaacatgtagtttagtcttcagaccctctcaaattacttactgaactaaagtatgccttttataagaaacaacattcagtaatataaaaataaactctcatctcttctttactttccatttaatttaaggtacattttggaggacattcttgtgcttacttcatgtaacctcacttgcttttaggtgaattcaaaattctaatgttaatcccttgtattagggttctctagaggaacagaagtaataggatatatgtatatacgaaagggaatttattaaggaatattgactcggatgatcacaaggtaaaattccaggataggctgtctgcaagttgaggagcaagcaagccagtggtggttccgtctgagtccccaaacctcaaaagtagggaagctgacagcgcagccttcagtctgtggccaaaggctcaagagcccctggaaaaccactggtgtaagtccaagagtccaaaagctgaagaacttggagtctgatgttcgagggcaggaagcatccagcacaggagaaagatgaaggctggaagactcagtagtctgctcttccatcttctcctgcttcctcgctggcagctgattagatggtgcccaccagattgagggtggatctgcctctcccagaccactgactcaaatgttaatttcctttggcaacaccctcacagacacacccaggaacaatactttgcatccttcaatctaatcaagttgacactcaatattaaccatcttcttactgagcagttaactcataataacactgccaaagagaactctaacagttaacagaagcgtcgtttgttgtcctaagtctgtcataatattctgtataacctttgaagaaacatttaaattttcctctttcaagcaatgaaatatgcattccttaaattgaaagaacatgagcttccttgatgcgttgcctgacatggtgggaaaggtgagcccctgagtcggaggactcatcccggatcccattctctcacaggcttgtgaaagcagaagtcaccttccttctgaccttggcatgtatcctgcttcaagaatggaactggaggcatatctattcttattacaaagaaaatttaagtcattctcctatagaattttaatttcaatcattgttttaggaatttgcaaatatatggcttgctttgtcttaactaatagaaaaagtgtcctttttcaaaaagagaagtgttaatgtaatgataatagtaatgacttcacagaatgtgtgttctgttccaagcactttaagcatattaacaatttaatcctcacagtaatccttggaggatgatatcatcctgattttgcaagtgagacaactgaggcacagaaaggccaagccttatatagcagagctgggatttgaacccaggatgtctggctcttaatgctgttagtttacattcttaactgtgggccagatgtgtgtaactgactatcaaacgtggttctgacacaaaattctacatctaaattccaatctccattttacatttctgctaacctgacgggggaaaaacttttattttaatatgaccagggatccacattttgaaaaatattgccagtgcagtcctgacagccacttcttcattcttaagcacctgggaggaaactgttcagaagtggttggttatgaaatggtaaaatcagctctgccctgctgatgaatccagaataattaccaatgactaagtccagcctcatgaccacttcttgagtgacattgagtttgcatcctaatttgaagtttacaattctggcaagatattggacagctgcagggataattttgttcacaaatatagatgcaaaattctatgctgcgttaaagctattttaaagagcatattttaggactagtgtttatttccttgtgtctaaatttcctgttttgcatttgcttcagctaagattgttttgggctaaacttatcttcctacacagacccttgatagcatgtaaatcaaaataatcataggcatatttaattatatgacatttgttgtctctacactaaagtttttctaacattcttaaattttgtctacataatgaatatatttttaacagaaaaaaaaactataggtttgattgcctgcttatttaaataaaaagagaaagaagagatagaagaactatgaactctttattggttgccaaacaataaaaatacctttttggggccgggcgcggtggctcacgcctgtaatcccagcactttgggaggccgaggcgggtggatcatgaggtcaggagatcgagaccatcctggctaacaaggtgaaaccccgtctctactaaaaaaaatacaaaaaattagccgggcgcggtggcgggcgcctgtagtcccaggtactcgggaggctgaggcaggagaatggcgtgaacccgggaagcggagcttgcagtgagccgagattgcgccactgcagtccgcagtccggcctgggcgacagagcgagactccgtcttaaaaaaaaaaaaaaaaaaaaaaaaaaaaaaaaaaaaacctttttgggaaaaaagtaaaccccattgtttccttgaatgtgcttgttctttcagctcagtcctaagagtggatgattactgagcacagggccctgagatgaactgagggactcgcatctcattcaagcctcacaaagcagtggaaggattaacgttttcttcattttataaagagcacactgagactaagaatggttgattagtttgcccaagttctcaagagtagtaaaattttgagccgttaatttaaaacagaccatctggaggtagactagagctgagaatgatctcaattaaaggaaggaattctgtcactttgtgaagttttatgaagagataagatagaaaccaacctactgagtattaaacaaaaggctatttcccgaaaacatccttccacattcattcttcaatcagtaaaattttactaccattaaggcagaaaaagggttagacacaattccttccttcaagaagtttagaggttaatagggacactacaatattcgtgacataacttaaaagctacataaaaacagtatagaaaggtaaagatttctctgtgaaagaggtataaaaaagaaaatattttcctcatggtaagcttgaagtttcttcctccctgggaggcttaaaggagtcttcgtgatggagatctagaatccatctttagttggttagtgtgtgcacatatgagagggaaggccatgctgggcctgatccaagaatgaggctggaaatgggtgtacttttaagaaaatgaataaataaataaatgatcttgtttgcctaggagcctgcaagggactaatggaagctgtgaatagaaagaccctttggaaccaatttggagatgtccttgaaaacgaggggagtatagaattttctccaaaagaagataagaaacctttaaaggattgtatctgcggaggggcaagatagtaacaaaatcttcgaagaggaaataagcctttacctcaccgctgttcaccttgtttgagggcttacctttcacagcatgggcccctgctcctggccctccccattgcctaggcagagtttcactcttagcctctgtcaagtgtgatcaccagctgacttatctatatcttttttttttttttttttttttgagacggagtctcactctgtcacccacgctggagtgcagtggcgcaatctcggttcactgcaagctccgcctcccaggttcacgccattctcctgcctcagcctcccgagtagctgggactacaggcgcccaccaccatgcccagctaattttttgtagatttagtagagacggggtttcaccgtgttagccaggatggtcttgatctcctgacctcatgatccacccgccttggcctcccaaagtgctgggattacaggcgtgagccaccgtgcccggccatctatctcttcttatcagtaattgggcagtcttgatactgagcttcccagctgtggacccacaactaaattaatgtaagacccaaagatctgaaacgccctttaagatgccacccttgagaataaagaatgttagataccagcagaggtttatgcaagaagaagatggagtggtggagaaaaactgggagtaagaaaattaaaggaagagaaaataatagaaaagaacagtgatcatttgtattaaataatgagagtgaaaatagggctaacagtattttacaggtgtagtggatcacaggttgttgacatgtaaccaacaagaactggacgatatggctgcaaccctttgtctgcaaaagctcacatgtattggctagtaatgttcaagtaattaagaggacattaatcagttaaatatctatccacacatgttttctctaaaaaaattcaagtctccattttttttctgtctaatacttctgacttcaaggatagaatcaagagaactgggaccaggaattgcaactattgcaatgaggcaaatccccacaatgtcccaggtcagagttgagagaggcagctaaacaatgggactgtacccacctatgacatgaccttttaaaacagctctttttttgtgcttctttagatggatagaagtgaacttatatctatgctttgatttttgcaaaattcttagtctgtaaaagatatagttgtgactaggagactaactctcatttgcctcagtcctaaattcagtgtgttcagtataacattgaggaaataaaaatcataataatgatttcagaagtgacatattaactccatatttttgaaagaaagtgtggtcaggctctgtgctaaaaaaaattctacctactgatgttgcaaaagcgtgtcttgagatgatctttacaatgaaaactagatttctgtgaatgtgcaatgacttttgggtccttttcttttcatattcaaatattatttcccttctgtgatatttccccttatttatgggtttctttaatcatatgcatatattttttatgttgaaacctagtaaaggtataagcttttgtttcatttttagcatgaacctaagaagctcttccatcatgatctatggctttcattattgattctgtttatagacaggatataaatataatatgaaaatcaaaaacaagttttaaacaaaaattgtttttaaaattagatttttctcttcaacttaaatattttacccttccaaagggtgagggaagggggaaagatgaaagtggcagaattaatgtagaaataaaatgtttggagcagagcttgggctttttcccatagagtgaatactaaattttatcagtataatgatccatcacagtttaaagaagcaacacattttccaattacaatgataacttttaacatatctaacattttaacatctctgtatcttctaatatattagacttgaaaaattctgtagtgattgcttgtctcagcattttgcaaacatcatccttgctgtaccaaaacagagttcgccagttttggaaagatgtgtgcgtggctgaacctcttctgggactggacaacggacagcaactactatacgtgcaagtagttgttctctggtgagctgaaacagttactcacatcacttcccatgctctgaggttcagatgaggagcgctggtagagaaaggcagctctagatctttgtaagaaggtaataagacacgaaactgtgcccttcaatggaaagtattaatataatacatctctccaaggaagggctgacaatgggagttgaaagccaccagacagtaagtggctctcaaaatgagtgggaaggtagttacacaaagttggtgcccccatacttgtctggaggcctagctgaagaaccaatcctagcatgcccctccaatcatcgtggccactctaggaaccagccctagccacagccctactaggcaagagttgtcatgcttcttttacaaacttcgagtagacttaaagttttccttttgtcttcttcaccagagaaagaaaaagtttacttttggacaggttgcattaaagcactttagatattctcttttctctggtggaagcccgtatcttaggagacatggggaacctgctgctggctcacctgtcacagaactggatcatgaagctttcatctggtttttcccaggtgggcattttaaatttctgcttcaaagtctgtctttgtacttttaataaataagacatttgtactgatggaatctgcaagacaggcttgaaggaaaaaataaatgtctcaaagtgaaagtcagtttctttttacatgaacagtcatgtaaaaaatgtattaaaaatagcctttttgacttggagatctattatgttcagtagctaaactataacacagaagaccacatggagcacatacatgaaatattgttgaggtggccatttggagtcctgggttctagtaaggactccacttcaattggccgcatgatccaaggacgggcatatcacttctccaggacttagggtcttcatctctaaagtgaaggctgaacataacaggtacccttaaagctgcaaagcatcacacaacatttcacacctgtttaccttctcattctcttagataacactttttctctcttttctctttcctcaaaatgccagtgtctcttctcccagtctcattcttagctccctacttcaccagaaaactgaggcaatcaaaaaagaatgtccatgagcttccaacatcacattggcttatggctctgatctgaatgtgtctcctccataattcaggtattgaaacttaatggccaatgtgacagtattaaaagatgggcctttaaggccatgcgggctcctccctcatcaaagggataaaggtctttctaaaagaggcttcacacagcgtctggccctcttgccatgctaccttctgccaggtgagaatgcagcgaaaaggacctcaccagatgccaaaaggacctcactgtctccttgatcctgaatttgtcagcctctagaactgtgagaaaattaatttcttttctttttttttttgagacagagtttcgctcttgttgctcaggctggaatgcaatgacacaatctcggctcactgtaacctccgcctcccaagttcaagggattctcctgcttcagcctcccaagtagtgggcattacagttgtgcgccaccacgcctggctaattttgtatttttagtagagacagggtttcaccttgttggttaggctggtctctaactcctgacctcaagtgatccactgccttggcctcccaatgtgctgggattacaggcatgagtcactgcacccagccaatttcttttctttacacattactcaggctgtggtattctgttataataacacgaatagactgagaccaaaattgataccaggagaatggagtgttgctacaacaaatacccgaaaatgtagaagcagctttggaactgagtaatgggtagaggctggaaccgttttaaagggaatgctgaaaaagcctgtatggcccaacatggcacattaagggtgattctggtgagggctcagaacaaaaggagagctgtagggaaagcctgaaccttcttagtttatcttagacaagttcttatattatctcagtggttgtgacgagaatactggtagaaatatggacagtgagggcctttattatggtatcttaaagagaaatcagaaacaccttactggaaactggaagaaggccatcactgttacaaagtagccaagaagttggctgaattatgttcctgcctcagtattttgtgggaggtagaacttaagagtgatgaactaggatacttgatgaaagaaatctctaagcagcaaaatgttgaaggaattgcacggcttctctcaactgctcatagcaaaatgcaaaaagagagaaatgacttaaagatggaatttataatcaaaagggaagctctcacatgtaaagaatgtaaagatttgaaaaattctcagcctggccatgtaaataataaaaaagcatgtttagtagagaaaaccaagggtgtgcccagttgacagtccgataagcaaattagtgtgaatagcaggaagccaggagcaatttatcaagataatgagaaaatgaccccaaagacatttcagagatctttgaggccaccacattcttcacaggcagagtgctagggccttgggggctgaacaggtttgagggaggggcccagggtgcccatgggaacttggggcttaccatccagggccgcctcaaatctctgctccctgcattctggcacagtgctccttggctgccccagctatggctcaagcaggcccaggtgtgactcaagtcactgcttcaggaggtataggccatagcacttggcagcacccatgtagtgcgaactctgcaagtgcacagagttcaggagctttgaaggcctagcttcctcccctaggtttcagagaatgccacagagtgtctccaccagaggaatacacagtggagctgtgtgagtggggccacctcagagagtactcactaacacaaaatctagtggaactatgggggtagggccatgctggagacctccacattttagagtcaccaggatgcaatgccagcgtgaaagagctgcaggtaggagactccaacccatgagggctgtggtgtgggctgtgcccagcaaagctatggggttgtggcctttggagccttggggatccaacccctgccccagtctgccttgacggtaaaacatgagtcaaataaaattattttcaagccttaagatctaatgttgtttgcccttttgggttttggatttactcagaacttgttacccctttcttttagccaatttctgcctttcaggatgggaatgtctatcccacacctataccaccattgtgttttggaagctaataacttattcgactttgcagcctcattgctggagggaaatttgcttcaggatgaattgttccttgagtctcactcatacctgatttacataaacctctggactttagacttttgagttgttgttggaatgaatgaaaacttttggggctattgggatggaattaataatgtattttgcacatgagaaggatatgaattttgagtggccagagaagaatgctatgatttgaatgtatttctgccaaaattaatatgttgaaacttaatgaagaatgtgatcatattgagaggtgaggcctttaagaggaattaggccatgaggattcctcctccatgaataggattaaggactgtcttagtccattttatgctgttacacagaataccacagactgggtaatttataataaatagaaatttattggctcagtattctggagctggaaagtccaagatcaaggggctgactcctgcctagggccttcatgtgtgtcctttcatcgtgaagggcataaaaaaggggtgagagagaaaaaagcaggccaaataggtccttttatagggagcccactcccacaatagcagcattaatccatttatgaaggcagagccctcatagtgtaatcacctcttaatactattttaatgataattaagtttctaacacatgatttttgggaggacacattcaaactgtagcaaagcccttaaaaaacaggctaaatgcagcatttggctctcttgcccttctgccttctgtcatgtgcacaggcagcaagaagggcctcaccagacatcaaattctggcatcttgatttcgggcttcacagtttttatacctgtgaaaaaattaatcacccaatctgtggtcatctgtcacagcagcacaaaatgaacaaagacacttacccaccagtacctacaccctcagagtctgccttctcaccttttaacttttaaccttttaactacccttacacatatacaaagctcatacttcaactattcaaaaatagaagtcgcaagattagctcacctctggcctttggatttttccttggaagattctattagcatccagtcctgctatattccctatccttaagggcacgacaacaatagaacacaaacaaaaagaaacttttcttggctttactttctctgcgagctcctgtcccatttctattctcttttgcaacacaattccttgaaggagttatccacactcttttaaaatatttttctctgttattcttgtaaacacagtccaatcagatttttcagcactccccctacactgctcttgtcaaagtgtccaacaaacctcacattgctaaaatcagtggtcaactctcaattctcacattactcacactatctgcagcatctgatataattgattacgactcttccttgttaatttttttcttgtttcagtcagtcttttggcattagttccatccatatgccactgacttccaaatgtggctctcttagccaacacctctctcccaaactgcaaactaaaattccaaaaggcttatttgactctttttagatgtcttagagatatctcaaacttatcaatgttcaaacctgaactcctgatctttgcattcaaaactttgtttacctgtaaacttcctaatctcatctggtggaaactcaattctcacactagcttacaccaaatatttaagagtcagactcatttgatggtctcttatgagctcacacttgcagtttcactcctatggagctcagccagggctagaacttccattatggtttaaatcatatggctggtagttgtgctgactactggctgactctggggctctgttctcctccgtcagtctagcttagctttctatcagcatggcagctgcattccaagacataaaaaatggaaggtgtggggattcttgaagttttgtctttggagttgcacattgtcatttctaccacatgatattggttaaagcaactcataagattagtccagatttaaggggaggtaagatagagtctatgtcttgatggaaaagtggaaaagtcatattgcaaaagggcatgtaagatagaatggagtgttgcagtcgtctttggaaacaatcgaccgtataggacatcttcaaattacaaaataagctacttgccctagaatgtgccctctttccccttctgttacaagcacatgacccagctgtgattaggcagatatggaccataccctagggcatggaatagcaaaaagttgaaagaaacctgtacttggataatcatgcaaagctgagttgctcatcccatgactgttaggtaaagacaaaaaactttcttccatctccgtttctacccgttccctttcaccctcaccccttgtatctttgatgttccctgaactggccaggcactctccagccttagtccttttaattgttctgtccacctgaaacattctttccacaaatatctacagagctcgcttcttcacttcatgcaagggtttatttaaatatcacccacttaataaagtatttttgaccacactttttaaaataaaaatccatgactaatgaagactgacacacatttagtcctttgaacaatatctagataaaaatgtctgtggagtgaaaagaataaatgctgactttgctgttcactggttttcttcaggaaagtctcattatttctcagactacttcatcagaaaatggagataacaatggctttcttttacggtcattgtgaaacttagatggccccgtgtttgagaagtcctccttatgaggtcgccctcatgattgctcttcacttgagttcaggctcccgctctttgtcactcccctttgtggagacagacagactttctggagctgactaaccttgactaacctctcactacccaacccacatctggctacaggggaaagaacattgtcacaggaactaggctggttgtaccatccccacaagagtgtattcagattcttcttgagaagagtctagaattgcaccagaactctgatccccagcccaaaagcttgcatcaatgtggtatttttataaacatgtacatactgaaatgactaccataatcaagctaattagcatatccatcacctcacatatttaccttccttttttattgtatgagaactcttaagatctattctcttagcaaattccaagtatacaatacagtattattaacaatagtcaccatgctgtacattagatctccaggacttatttctcttgcataactgaaattggactctttactcaacgtctcccaatttcccctacccccaacccctggcaaacattactctatgctctgctacctggatattttgtctctctacgtacattttagattgcacaaaataatttgctgttgtaatgaatggcattgcactggatccacaaatcaagttaggaagacatcttgacaacattgagtctctctatccatgtatatggaatagctctccatgtatttagttctttgatttctttcatcagctttatagctttcctcatacagatcttatacaaatttggtagatgcatacctatgtttttaatttctaggggtgctaatgtaaatgatattctgtttttaatttcaaattccacttgtttattgctgatgtataggaaagtgattgatttttggatattagctgtgctcttatttttatttccctcattttccttgttttgaatttactttgttcttctttcttatttcttgagtaggaacttaagagtattgacttgaggacacaaatgatgctgaatagccaaaacaatatttagcaaaaagaacgaagctggaggcattatactccctgatttcagaacatgttataaagtgatattaattaaaaccacataggtactcctataaaaacagacacattgaccaatggaacaggatagaaagcccagaaataaacccagccacttgatttttgacaaaggttcctagaacacacagtggggaaagcacagctttctcaataaatgctgtgggaaaaactgagtatctgcatgtagaagaatgaaatgagatccttatatcataccatatacaaaaattaactctaaattgatgaaagacttaaatataagacttgaaactgtaaaactattacatgaaaacagagaaaatgatccaagatattggtttgatcagcaatttttttggatataaccctgaaagcatagggaacaaaagcaaaaataaacaaatgggatgacatcaagattaactatcttaattatattatttgatgaatagaagtcattaatttatagaagttcaatttaataaactttaaaaatatttggtgtctttttggtcctatttaagaaatctttgcctatctcaaggtcatggaagatattttgtacttttttgttatagaatttgtattgtttttactgtctaagcttccacattgtggcctatgatccatcctgaataaatgttgctaaaaattaaactttgacttagcttactataaatgatatttatatttatgtattacataatttatttacatattctcatatgtaatacatattattttactataaacactataattaaggcagaatagatagtttagatacatattcatgaagatgccacttccattcaacggacaaaaggatagtcttttcaataaaatttactaggtcagttagatatctgtagatgtggtgggtaattttgtctttaaacttggctgggccacagtgcccagatatttggtcaaacattattctgaatgtttctgtcaagattttttcatttggataagaataatacataaatcagtggacttagggtatgcacattaccctccatagtgtggatgggccttctccaatcagttgaaagacttaatagagcaaagactggccgggcacggtggctcacgcctgtaatcccagcactttgggaggctgaggtgggcagatcacgaggtcaggagatagagaccatcctggctaacacggtgaaaccccatctctactaaaaatacaaaaaattagccgggcgtagtggcaggcacctgtagtcccagctactcaggaggctgaggcagaagaatggtgtgaacctgggaggtggagcttgcagtgagctgagatgccactgcactacagcctgggcgacagagcaagactctgtctcaaaaaataataataataataataatagagcaaagactgacacttcctgagcaaggaggaattctgctagtagactgcctttggagtcaaactgcaactcttccctgggtctcgagcctgctggcctaacctgtagattttggattaaccaagcccttacaattgtgtaagccaattttaaaaaataaatctcttgatatagataggtagatagatagatagaaggacagatagacattctgcttttctgctggttctcttttcctggagaaccctgactaatacaattcggaaaaacacgtatcttgacctgcacttcaccatgcacaaaaattaatttaaaatgaatcatagtatcctgctcatttttaattcttcagataaaaatttacctactatatctttagaataaacttttaataaaagttaattaaaattaagttttaattttatttttatgtttttttctctcccttgtgaaacagtagtacacttgaaaacaggagaattttttttaatgttaccaacgcagttcctggtaacaaatttttagaggctactatgtgtcaggctctgtgataagcattttaagcactttacttccataagtcctcggaataatcataccctcttatgtaagtattattatgaccaccaaatcacagataagaaaacaagcattagagagaaattaagtccaactgattctaaatgcaggacgcttgtacactaggtctccctacatggctcctcaataaataaattcattaagaaataagaaggggctgagcgcagtggctcaagcctgtaatcccagcactttgggaggcctaggcaggcagatcacgaggtcaggagatcgagaccatcctgactaacatggtgaaaccccatctctactaaaaacacaaaaaaattagccgggagtggtggcgggcgcctgtagtcccagctactcgggaggctgaggcaggagaatggcatgaacccaggaggcagagcttgcagtgagccgagatcgcgccactgcactccaggctgggcgatagagcaagactccatctcaaaaaaaaaaaaagaaagaagatgggcttaaagtttcataaaatatcagtcatatgagaataaggaaaaggaaaaaagaatgtaaatgaaagataaagacagagaacaagaagaaaacacagcggagaatcagaaataaagaagattgttgaaagaagagaatatattactatatttatttattgaatatattgattaggctctgttctaggtggcgggataaagatagatgtattatctatgtaaataatatataaataataaatatatattacataatttataaacaagataaattatctatttatagtccaatcatgaagatggcacattaatacctgacaataacaggtagaaatagagccagtgaagatgagacagaaagcatcataaggatcgggaaacacaaggacaacatggaatgggctggttttggagttttaactctgcctcaagaagttatggtacttgcctaagcaaagaggtggaagtcttacagaaaaggaaaatatgaacggacatagctgagtgttggaagaaaagatgagggttgagctaagttgagctgccagggtagagagtagggcagaagttaatttccaacaaggtgctcagaaggatctgatcatggaaagtctgggttttatagatttcatccttttaacagaggagcagctaaagcagacctttcctttgggacgattgtcaggacggaggacacagggtccgttagagaagggtaacagaagtgacgaatgaccatggaagcttatgggtggtttaggcataaggtaaccagggcctgagaccagagaaattccagcagcaagagaaataagagaaaatagaaatgggaagtataggaaaaggaaacattttaaagctcttattccatctttgggcgaggttatacgtatacggtctagagttttttctcttgttgatggtgaaagggaataaacagcatgaaactcaccctggaggctaagatagtttgactcagagttccccccaccgcttgacctttcatgaccctgggtacacactaactctgaagttagtgggcaaggtgggcaggggctcatggactccataaaatccatctgactgttagctctgtctttcaccaggtgggggggccaggggctgtggcttaacctcattgtgcctcagccaattcttctgcatgtaaaatgaggatattcactatgtggccattgtgagatgatccatgaaaacctgtgtagcactgagcacagtgttctcagtaaatgctgagccctaatacccaatatacccacagctccatgcatgtgctccttagcaagcatacgcagacagcttggcttatctgcttgtgtcacattataaaagttggcttcctggttatttctacagtgcagcccataataccgatttccttaagagcaaaaaaaaaaatgccttatttctttcctcaaaaatgagaattggccttttaaaacttttcctcaaatgacaggactggtgctgtaaatgcttatgaagactggtccctttgcatgtacgggcttatcttcctgaagatatgaagctgtggctagctgctttcttctgtttcctaacgaccacagaatgcacaaagtagaggtgcaagtggaagctgcaaagagctctacaacctctgtcaaggtgcttgtccttgcccaagctattactgttcttggtggagattattccccgctgatctaaaatatgctctaaggccaaggtgggcggatcacacgaggtcaggagttcgagaccagcctggccaatataatgaaaccacatttctgctaaaaaatacaaaaattagctgggtgtggtgatgcacacctgtaatcccagctactcgggaggttgaggcaggagaatcgcttgagcccaggaagtggaggttgcagtgaaccaagatcacaccaccgcacttcagcctgggtgacagagagagactccatctcaaaaaaaagtaataataaatacatcataaaatatgctctaatgttggagccaaaggtcagcactgtcactacacaaagcctcactttgagtagagatgcctgctgctgctatttcttgggacatgagcattctttaactgagtttaaaagttcttgaattataaatggatagaaatacagcttcacagaggtatgctcataaaggagtcttcacacttgaagatacagtggacacatacacacacgcacacacacacacgtttagagaagttcccttaatcaatctgacagcatgtagttataaaaaacacaaattggccgggcgcggtggctcacgcctgtaatcccagcagtttgggaggccgaggcgggtggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggctgagcttgcagtgagccgagatcccgccactgcactccagcctgggcgacagagcgagactccgtctcaaaaaaaaaaaaaaaaaaaaccacacaaattttatgaggtgacggtacagcttctgcttccctatatactatacctctggagaacgaagagcactgaatactatatttttactttctatgtttggaactacacttattatcatgccattactcaacaaacatgcatcacaatgtccccataccaccatgaatgggcacaaataaccccatcctattgtggtggggttaattttttaggacagcaggtgctgtccactgttaagagcgtcagtttgcctgattttttcaagtttattctccaagagcctttcactcaggttgggtctgcaaagcaccagcaagtccaacaactcaaccaaatgtctacagctgcgggtggcagataagtatagcagctaacccaaagcaaataaaaacaactcctaggggaaataagagggatgctgggagggctttttatttgagtgccactgtggtcttactgatttgagtgcccacttgtttcagaatttagggtgtgggagtgaccaaggagcacagtgactagaggaaactagaaacaaaatagacattgttcactttggttgctaaatttaatatgtccctattgcactttttgttttgggaaatttttccaacattaagaaaagcccttttaaagaagagtgttaaaacattggttacatgagaaccaaggaggattcaccttacaaggtgaaattatgtgttttattcaattttcacactactataaagaaatacctgagactgtgtaatttataaatgaaagaggagttttttgttttgttttgttttcactcaaaattcttcagtttttacaaaactaacagggtggagtggggaggctggggggcaggcagcctcaggagtagggctggtgagaggcgctatgcttctgtctccacctgagactggctccctgccgtgttgctcttccactccgccttcatctctgtgtcagtgggatggtctcctgagcaagcctctgccttggccttgttctcctcctcagccagcctctcaaacattttggcatagaacttcttccgggcaagctgcctgtggatccgctgctgacacacagccagctgggccctggcggctttgttgttggggtagagctgcaggaccttctggaagtcagcccatgccagttcaaagtcattcaccgccaggtgggcctctccccggcggaaggggcccttctcgttgttgctgtccagttctagggccttgttacagctttcaatggcagcagagaaggcctgtagtttcagctgacacatggccaggtcgaggtgagaggccagtggaggggcctgtgccttctgtgcttcctcattggaaaaactagacatattccagccaggacacaatcttcttacactgtagtaaagcttgcttgtatttgccttccttgaagtacacactgccctgctctttcactacggtgttctgttccagcttctcttctgaaatcatctcccaagattccttggccttttcaaaactcttgagatataattcatatttcagctcggcatttggtgggatttggaacttttccttcccaacactgccaaaagcatagctgggcttgaggtacacagtggaatgttctcctttctccaagtgctgaatggccctctcgagatcataaggcagatccaggttctccccctcactaacctcaaagcggagcgcccgttggtcaaagagctggtccttgcagcacccttccagcgcaacctccaccatagcgccctcatcgggcttgacatagccttcaccgtgagtccctattctgcggatgattcccccatctttcaaacacaagcgtggcgttatggggagatcgttggaggactgtctgctgaactctaggcatattctggtttgcaggtgatgtggcccacctcccccaccttcatggttgctacggcaatgtcccaagccttgatgacctccccttttcccaggtcaaaggagaatttgtccttgcgatccacactggagtcaaactttgtgccctctaacagccagccagtgtagtggacaaagactaggtccccagtcatgggcatctctgtacctgtgccctctgtcttgatgactttcagcactccttcatcctgtttggggctgacatccacttccttcttgggcagcggcaccggctgcgccgcactctcggtcgccttcatctccttggctgtcatctctgcgtggcgcgaaatttttccgggagatggcgcaggcgcgagtgcactctgggccgcaggcgggggcgctacctgcagggcatgcgggaggacggacactaccgcgctgactgctgaccgcgcggaggctggagcacctctcaggaaacaggtttaattgacacagttccacgtggctggggagggctcaggaaacttacaatcatggcagaaggcaaaggagaagcaagtatcttcttcacgaggcagcaggaaaaagaaaacaggcgaaacttcctcttacaaaaaaaccatcagatctcacaagaactcactcaccagcaccagcacagcatcggggaaactgtccctgtgatccgaccaccccccaccaggtccctccttggacgtgtggggattacaattcgagatgagatttggatggggacagagagccaaaccatatcagtatgtctattcagaaaaatgtttatacatatatatatatatatatatattttttttttttttttttttttcagagtgttactctgtcacccaggctggagtgcagtatcgcgatctcggctcactgcaacctctgtctcccggattcaagcgattctcctgcctcagcctccagagtggctgggattacaggcgcccaccagcacgcccagctacatatacatatatgtatttttagtagagacagggtttcaccatgttggccaggctggtcttgaactcctaacctcaggtgatccgccagctggtgtaagccactgagcctggccagaaaaatgttatttatattctaatggtaccaacttcaatacgctttatcactctgaaccacagttttttaatttaataaggaaaattgggtagaaaaatatattaaaatatatattaatctatcaaatactacacaaagacaagtctttaaatgggttgggcaatatgctgaagttgatcaccagtaaaacgttgagtaacccctccatagaattcccatagaaatctcttcgttaccataaacctaagatcattgctctctctcactaccacagggatgtgattttagcatttgtatccaatttaccggtagcctaagccatcagtgagatatttggcattctgtatctaagcctgttccctcaccaccacacttcttcatttctcttggttctattctatctgtagaagacactgaaaagtgacgagatgtgctgttgaaaatctgtttcaaaatcatacactcattgctcactaaatattagctcttcagtcccctggaggtacctgggatcagtctctcccgcctctctatgtagaagagggaggggtactctgactgttgggcagttgtatattctctcggttttcaaaaatgtctactaattaaatgccattggacatgtgctcctacttcctgtgggggatgagacacagtgtgacacaaaagacaaaatgtcctttctgtacgttattatgtcgctttgttcatattctgtgaccctacacatttataatgtcacctttacctttcattatgttcatatgtgcacactatattctgagacccctcatttcattgttgatttgtccatttctgaacaaacagcagttttaattattttaacttcagacttttcagtacgaaaagtcatatctgatttttatcttgcttgaaaatgcttcttactcgtattctcctcaggatgaaattcccctcatcccgatactcagtaacctcattcattccatccattccacctgactttctccccatctattagctcctgctgtattcgtttctcatcttatcaagcttaggaagaatatcgtccattatttaccatttcctctcttgtatcattagtcaaaactgtgtttctccaagtgtggtccatgaaactattgcctctgaattaccaggggtacttgctaaaatgcatattcctaggccccattcaatctggaatgaatgaagcttgaaatctgcaaatggaatatgcgcctctgaagtacattatcatttgatagctgcttccctagcctctctgcccatcgcatggcatcactctcacaaaccctgactcaggatgaacctgcctttctgccttcttatggcctttaactaactggggtgagtggtgtgactgaacgagcattcaccacaatccacttcaacaggcttcaaacaccactgataatcctgatacagaagtcagcatctgccacacattctccctatcagcagtgacccaagtgttcagtcccagccagtacctcacttcacttatattaagtttcctttaatgggccactgttgctcttttctcccaatacttgtgagtctgagacaccctagtttatcaaacatgttctaaatggcactgaagctcaaagagaaatggtctggatgccacttcccttctgcacaaatggctcttttatatctctataaatttgcaaatgaaaaatagatacttctagaagcaggagcaacctcacttatcagaccattgataagacaaacatagttacaaccatcccctgaaccatgcattgggcacttgccttatacctgttatcatgagaggtactgtccaagtggttcatgccagagaaaaagagagttttcccaatgtaaatgaaattaacctctaaggatttaatacttctagtaatttcaaaatgattttaaaaaattaaacttcttctttgctccttaaatttccctgtacctcacactataaatgagtgcacaagaaagataaaaaaaaagatggcactaaaattttagctgttatttgggaatgatgaaaacaggagtgattttttaattattatttttacaaagtaacatttattaattttgtaattagaaggaagaaagataatatttatttcacaaatatgctccaacttgaaaatgctttgaagatgaggggtgaggtcagcagcccgctgtgtcagtaaggtacttcagccttgggtcctgtacacacttacaacagcaggaaaatctggtgctttgggaagaggtgtccacaggggctaaggcacaaaataagagggctgcatatggactgtgtgaagtaataaattcctgaaggcctgcttattctatgtatttaatatttaaaattacccattcaagcatggaaaagacaatttagggcctttataaccaaagaggataagaatgatctgttctccttaatggaaccccagagactagaatttaactatttcctggctccattccacttctaccaccccaatttgagtctagaactcaaagtaccattcatcctagattctatgcacacgtacaaatcatcacatttgttttacctagaagtgtaatggtaacttagtgttgcaagaaaagccctatgtctattcagaaaatgttatttatattctaatggtaccaacccctcccttgacttggctctgtaaccattctggtaaaaaggaggaattaaggtaaataagagggattacgggttgaagatggacaatcactcaaaacttgaaaagaaaaagtcactccactgcctaaagcacttcaatgattgcccattgcattcagaataaaattcaagttgcttatcctgacctttgaagccctaaacccttccattcctctgcctttctcagtttatcttatgccagtctctctctatgccatcctcatggacatgaatagtcttctttggtctgaagattattcttggttgctttatatactgcttaataataagaagacatttgccccctttgaattccaaataagataaaagaagtggctggatgttatcacaagtacaacatttctgtttgggaagtatggaatacttctcagccataaaaaagaatgaaattatattttttgcagcaatatggatggaactggaggccattatcttaagtgatataactcagaaacagaaattcaaagactgcatgttctcacttataagtgagagataagtaatatgtacccatggacatgaaaagtggaatagacattgaagactcattggagattttggagactccagtagacactggaagggtgagagggaagtgagggatgagaaattacctgaaaggtacactgtacactatttgggtgatgggtacactaaatgctgaggtttcaccagcacacaatatatccatgtaacaaaactgcacttgtacccctaagtctatttttaaaagtgattaaaatccatatgttctccccaaccagcatttgccagaacaatggtccccatgcgcctgcagggacttgaccaactattagggcaaaggcctgctacttatctacttccatggtgaagaaaaccacaacagctttggtgagcaagaatgtggaatcctttgaggaacctctgctagggtccaacctgcagaccctgacccagcgatggatgaatgaagtacactgacacacagatattctgctttgccagtccagctgagtgtctgagccacctacagactcccaggagagtactgtaaacagttgcaactcctcgatcagtcagtgagacttgcatttatttagtaaagattaattgacaaaggtcataggaaaacaccattagagggtaattgacattgtggacttcctgagtagaaagcaattaagcacccagggtacatcaaaggttagtcttaggaaaacaagttagttagataaactactctacattattttgtatttgtgccttaagctctctagctcctgcaaagagactctggctgccttcagccagacaatcagaagctatgcaaactctcaggctttccaagagagtttgtggctattactataactatcattaatatttttccaactggcctgattgaacccccacaaaactcaacttcagcagagagctggaagcagggtaaggaactgcagttgccattgcaattcattgagaataaagagaaactaaagggacttcaaactcatttgaataaccttagtctctttgtgtcgtagaatattcttaaaatactttcaagataaatcatgatatgactcacagagggaaaagatctgtcattttggagaccttaaaatacttgatttttaaaaatgtgtgcattttacttacccttgtgatataaagtactaagatttcacaggggttgtgtaaaaatgtgcattttatattcagagaaaaggctgcaagcacagagatgtcacttcagggattcagtttctagttgttatcttattgtcaatcctttcagcttggtcatctctatatccccacacaccagctcattaaagtaagatatttgctatgttttatgtataatatagagaaaagcagacatcactttccataactcatatgtttctgaaatgatatgtactctttgtaagactcagaaatcatccctctctgcttacctaattaaaaagtagaaaatcaaatatttctggtatgatgctgcttttcaccattttaaatatgactagaaaaggcttgcatgcaccttactgtagaaataaaggtagactacccacatgagaacaggtgattaattcaaagtttgggagtgggaaagctttagagtgagcaaaaaacgggagggaaagcgtgggggaaggcttcaagtatgctctgattgcatgtagttggcaaggggaagttggaagtaggttaactagaagcagagtatcttatgtggttggtttggggaacatattttgctttatttggttggttctaagttggaaacaaggcaaaatagggaagctaacagtcattaatgatatcctggaccatttgggaccaatcactgccaatgatgtggtttggcttcctggactggtggcttcagagattgtgaatcagaattctattgtcatatcatctgaccactattcatttgaatatttatcctctcagccccccattacggtcattctcttacgagagattgaccaattcaggggcagctagaaacccacatcttcaccactgtgatattgccgagtggtctccattacaaactatattgtgaggtcttgactttttgttgttgtgtcagcactgagatgtgaggtcagttggacttcctgggtccagtggggacctggggaactttcctttcttacaagaggattgtataaagcaccaatcagcactctgtaaaatgcaccaatcagcactctgtaaaatgcaccaatcagcagattctaaaagtagccaattgcccggaggattgaaaaaagggcattctgacaggacaggaacagaatatgggaggggccaataagggaataaaagctggccaccccagccaccagtggcaatcagctcccccttccatgctgtggaagctttgctcttcacaataaaccttgctagtgctcagtttggttctgtgccatctttaagagctgtaacagtcacagcgaaggtctgtggctttattcttgaagtcagcgagaccatgaacccaccagtaggaaccaactccggacacagtatggcaatgatctctggtgagaacagctgcccagtagaatgtaagacttggcagaggttgtgatggacctgcatcatggcaggtatgaccaaagtgttgcacgttttgtagttccgtgtgcagggtggaatggcgcccagcggctttttctcccctgttgcttggcgagtgagagggagggttacagtgttacaggattcgttcagtgccgcttcaccagctggaaatctctgtggctgcactgacttctgttccggcccttgctcaggcctgccgggttgctctgcccacttggcccagcaggctgcgcttggctcacattactggcccagatcctgtggtcagtgtggctgcgtgctcagctcgtagctggactgggcatgctgcaattggcttccatattgggcgctggtatctagatgaaggggaggtggtggcgccggaatacttggagatgacagcaactacaaagccccaaagggtgttacagcttttgcttggggagtcctgaggtctgagccccccggaaatgttacagttctctctggttcctgctgcctgcagctcagtgaacaggggtgcgttacatctcctttgttactgccacccgcagcttcgggagttcccacaaccaacaagaataaggtgtgtggacagcagagagtcagaaaggcagagaagaattttattgagcgacagaaaagctctcaacacaagaggggacctgaagtgggtagacttctgtgtgaaagggggcctgaaagccggcagccatctgtgtagctgagtataggatttttaagggctcagaatggaggagtgcatgctgattgggccgggggtggtcttggaaaaatcaccatttattggttaaaaggcatagaggatgttctcactccggttgtggactctacctagaactggcagttgggttttcaggggtcaggctgtctttggcttaaaggtcgggtttcaaaaacaaaaataatcactagtccctataaaatgctacagaagcagaaattctaattttccaccccagaccaagagaacatataggccacagaccatgaagatctgccttagaatggcaattatcttttttccataaggaaatgtgagatgtagagcctgttttactttgcctgtttcgttgattcaaatatagtgagaagtattagcaataacacagagctaccatgagtagccaacaagaaatctagagaaatatggttattattacttgtaacaatagagacaatgtcattaataacttctgccagagttattggtgatgaaactattggtgatggttttcttacagtttttttctgtttgtacaattctcactctgattattcacacagtgagtcagtaactcccccaggtagactgcctgaataatcaagggtggccgcatttggaagctccagtctgaggtggaatttccagacttccgtttggaaactcgggttggcccactgatattttataatggcctatctgaatccttagaaacttctcctttgaagatttacagaagacaataactttaggccgggctcggtggctcacgcttgtaatcccagcactttgggagactgaggcaggcggatcacgaggtcaggagatggagaacatcctggctaacacagtgaaaccccatctctactaaaaaaaaaaaaaaaaaaaaaaaggccaggcgtggcggcgggtgcctgtagtcccagctactcaggaggctgaggcaggagaatggcgtgaacccaggaggcggaacttgtagtgagctgaggtggcgccactgcactccagcctgggtgacagagcaagaatccatctcaaaaaacaaaaaccaaccaaccaaacaaacaaaaacattaactttagttaaggcttttttttggcataacgttctgttagaattttttctttagtttttctattaccttctttctttgtatgggcctcaaccttaaaatagccaactctagaaagtagagtgccttaacttattcattttcatggggtttccagcagagatgatgaatttctttttttccccaaagcatcccaaattcatgtagtactctaaaagcatacctgctatatgtttactacatggtcttcagctaactgacaagctctagtaagtgtaataaattccattatatgggttgattttacctcagatagaaaatatattctaaagtagagcttaaattagtgataattttcaatatcagttttgaggtatgatccatcaatgaataacattgaatcagagttcacaatgagagccagtctctcatcaatctgagtgaggtacagaaactcccctgacttataaccatcatgaggttcccttcttctggcagggggagaagagtggcagtttaaggaattgcatcagtgaatagtaaagcgagagagagggagtaaaactctcataacaagttgatcagctggttgaaaagtattgcatgctctttgtcagtggttatgtctacactggccagggaatcatgatgtgaggtggggagcctagaaatagtttaaaagaagcaccaacaaatgttgcagtggaagctgttgccttaagacaagggctataagcctttgcagctgggtcaagggtaaggatatggaaaatgatgaatttttgatggtttccatgacattgagttaaaaacaaaaaagcttgtacaagttatccatgcacaattagacaaaatggcatattgtagtcaggggtgcctaattatgaaagagagtgcctaactaccaaaggaagaggctactgaagagccttcttgagttacagaatttatatttgggcccccacaaaagacagtttcttactaaggactcagccaattcataaaaagagattgcaagctcagaaaaatttcgcagccattgtctacaatatccagttaaacctagaaatcctctcaattgtcattttgcgaggcatcgaggtgaagtttcgatagtgttctgcctaccaatagaggcaaaataatttcaccctcttaagataacttacaccctaaatactagcctgtcttttgacaaaattataatttatcttttgaaacattatgttctttttctgctatggctgagagcaagtatttacttgctctcaccttctcaccagcttcctcgttctctgaagaaagcagtggagatcatctgatcctgcatatactgcatcaaaactcaatcacaagtgaaatttagatcttttaagtcttgattgaggacttgtggaaagtaagagggggctttagtgagcccctggggtatgactatccgggtatatttgttgtcctctccagatgaaggcaaagtcgttgactgttctggtttggaagcacactgaaaaatgcacagtaaagattcaatatggtctagcaagtggttttgggcagaattgatgacaggataggtactactaggaagcaaagcaaaacaattttgttgatctttcctgaggtcatgaaaaaagtgtaccagcagaacaagtgtggtgcatgggctactgcagcgtatgagaaagtctttggatataaggtcatcaactacagttttgaagcattcctttgcttctggtttttcaaggaatatcagggaagtttgaccatggtttactaggatacttctgaacttgactaggttctgctccaataatttcccatataaatggatttttttagtttgtagagtgttaggtagagtgttgaggtctttatctggagcgtatgtcaaatataatgaaggagacaaacatatatccagagacgacatatagaggaaccctcaggagactctgctgtgcatttattatttttctgagacagagtgttgctctgttacccgggctggagtgcagaggtgtgatcttggttcactgcaacctctgcatcccgggttcaggtgatcctcccattttagcctcccaagtagctgggattacaagcatgtgccaccacaccagctaattttcgtatttctttttttttttttttttttagtagaggcagggtttcaccatgttagccaggctggtcttgaactcctggactcaagtggtccacccacctcagcctcccaaagtgctaggattacaggcgtgagccaccatgcccagctggtgcacttactattataattctatttgaaaattaagtcactccccattaaatttgcaagagtgttataatagagcagggagaaatgtttttaagtcaagtacccaaaggttgtagttacagtaggagatagaaggaatctgtgggttatttgagatacctgctacttgcttcctatgaggaaaatgttgagcaaaattgccagggtttaatgtagaaagagttagtgcctggctgggcatggtggctcacacctgtaatcccagcactttgggggggccaaggcaggcagatcacctgaggtcaggagttctagagcagcctgaccaacatggcaaaaccccatctctactaaaaatacaaaaaaaaaaaaaaaaaaaaagcagggtatcatggtgcatgcctgtagtcccagttactcaggaggctgaggcaggagaatcacttgaacccaggaagcggttgcagtgaaccgagattgtgccaatgtactgcagcctcagtgacagagtaagactccatctcaaaacaaaaaaagaaagaaagaaaagaaagagtagcgcccatattgccaggaattgctgaggttggccacctatatttatggttaattcaccttgaatgttaaattttaaatcaggatattgggtaccttcattgatgtaaattaaggggtcttttggtcttatttttactggaaaatcatttttcaggtgtcccttctgttttcaatatctgcaggtgtcctcttctatgggtcgtccactcaactgtttgatctgcagggccgtaaggttattctggatcctgtcttgttattgtcctagggctctgcaaaaatgtcagccaggtgttgaagttcaggtaaagtggctatttcccattctaattttgatctaattattgtctccaatttcaggtttaattccattaacaaagtaggtaaaagagccgttattacacttacacttctttaacactcaaatgttgttgaaaggggttttctagtttattctgaaaatctcctataatttcttcttttctttatttacatcattaaattgtggtccattttatttttactagaaatgtttcaagtaaggcttttaggatacattgccctactttttgagcctccttttggccctcaggcttattgtggaaagaaagatgctgtagatctctgtcccggtgaatccaactggcttttgccatcaggatttaatgtctgaggatctacaaacataaatacaagttgatatagttcaggtaaccctgagttgtgtacagctaaaagaatttagaattctgaactcctttgggaaatgcttagtcatagcttttaattcagctcgtgttcaaggtttaaattctactgctgcttgcgtatttgggtcattgaagagatggaactttagaggtaaatgacattccgggatcttaggagagtcactgggagaaggtagggggtctggaagaagagggaggagtcaatgaggtgtgaaaggaggatgggggaatgaggaagagttgcagagctgaagtcaactggaggagaagccgggggaagatttgctgggcaaatgagttagtttgttgttaagtttgtcatactgttcattagctctggccaaaaaatattttaacggagtaatgtctgaatcagaatttcatttgaaaacttgtgtaccaatcaaaaactgctgcccattgcccctgagaaatattctctcttttctaaggtgtttttcaaatgaacaattttgttcaagtccagtgttctccagattagccactgaaggcctaaattatccttggtatagagatgggtgcaagtgctaggatcatagcaagggtacatataagaaatgggagattttcctggaggaaaaaaaggaaaagaggatgtacactcagaaaattccatgggagctggcaatggtcagttgaaagtaatatttgtgcactttatgtcttaggcccccaacctgatagttggcaacctccaaatgcagacttgacaacttgtgcccacaggcaaatggaaaaccagaatattccctctgcatcaaatccaacctctcagggccaaaaaaaaaaaaaaaaaaaaaaagatgaaccttatcccattttattggtgactgacaggaaagtttaggaaagtttgtccagatggatgctggtttggtaagaattgcagctcatcagttgtggagcaagctgagacactcttagaggagcaatgcctgtgttctgcactgattctccttctgataacagacaacactttagacttatctcacaaaacagaagcacaaaagagaacaaaaaggaatgaaaagaaatggcagtatttttccaaaggtgccaaacaaatgggaattggtagcaaaagctgagtaccaagctgagagtcaataaccaaggatctcaatacaaagagaacagagttgaagcccaattctgttctctcacagacactgtgtcaacacagacttgacaggcctcaagaagcaaggcacaagaggcctccatagatactgcacttgatcagggtccaaagtccatggtgatgagcagttaagaatgtgtctcagtggagcttctaggaaaattacagaaatacagaccaggcatggtggctcatgcctataaacccagcactttgggaggctgaggcaggtggatcacctgaggtcaggagttcgagcccagcctggccaacatggtgaaaccctgtctctgcaaaaaatacaaaaattagacaggtgtggtagcacatgcctgtagtttcagctacttgggaggctgaggcaggagaatctcttgaacctgggaggcagagcccagatctgcagtgagcccagatcgtgctgctgcactccagtctgggtgacagggcaagattcagtctcaaaaaaataaaaaaataaaaaaaacagaaaattacagaaataaaggagacaacttaatgagaacagaagctatttatttcttgcttgctagagaaagggaggcagtcgctatcatttatgtttgacagagactcaggctgggagaatgggaaagctttatagtgaaaaggggcaaggctttggggtaggtggctatgggcatggagaggtgcaggtaggctaaagagaagcaaggcatctgatgggataggtttggagagagtatttggctttctttaattagtactaaactagaagcaggggcaatcttagagaagttggcagtcattgaccaacctctgattgttttcggcaaattgctactgaatttgtggcttgcattcctgaactggctgctgcagagattgtggtttgccttcccaagctggttgctgcagtggttgtgggtcagagttccattgtcgtacgtggtttggccactgtctgttttaatattcagtctctattactaaaaggtatacaaatggctaggcttctcacttcagttcttcatgtacaagctccttttagaggtttctgcactaaactattgtaaaaaaaaaaaagaaaaaaagaaggccaactccatttatccaatgtcaaccttgacgttaagaatgatgaatgtggcagctgtttccttctgttattgatctttttactgacccttcccattgtgctttgtcaatgactgagtatcttccctggaccactcttatctgaagtcgtcctcatctctcagggattttcagcaccatctgtcagccaggcactgtgactctgtcgtcagtgaccatttttattgacttttgtctctttctggcctttccatggtgccttggccttaaatgtcctgctaattagctcagtggtgattacagtgctggttttgagagcaccctgttgttttttcttatctaggagaattttttttctctctttatctggaaatattaccttgctggctatgctgagttaggtcattgacatcagatcagtgttctaaatctgatcctagtattcccatctacaatcttcccacacaagccaagggaagagacacacttgattaaaaccttgcactctctttcctatttggctattttttctcctcttggagaaagagtttccccaaaatactatatgaagtgttattttgtaagcctacttaacttagttttatatactgtgcacaaactttacatataatttgaataggctcagttttttgttactgtttttttagtttttcaccaaattttatatgacagactatttaagctaaataatttgttatagttagaagactgttttctcatttacataccaaaatctaccaaaatgaatttattacacttaagaatttttgttaattacgattatcacttctgtaaaataaaataaatctaagaattttatgagcaaagctttttcaagtctactatttagtttagcaattattctaaatatcaatctcaaaattagagtaagggatttccccttttaggaaaagatatcaataattatatagtaaaaatttaaaattaagatacagacatttattctgtgttggatcccaaatatctcattagagaatgatcttctctcattgtctgctattttctaaaatacaggaagatataaagtataaatctgattttttttctaccagaagttaaagaacatagaatatatttggtatgattaactgggagtttgtatttcctctgcaatctagaaatattattattttaaatatctgcaatattatttattttaaaagtttttagtttgaaaagacatttctgaaagccccaaatctgtgagcatttgctactacaaaatttttaattgtaagcaattgagagagaaaagtcctcgaatttggccaagcgcggtgtctcacacctctaatcccagcactttgggaggctgaggtgagcggatcacgaggtcaggagatcgagaccatcctggctaacaggatgaaactccgtctctactgaaaatacaaaaaattggccaggtgtggtggcgggcacctgtagtcccactactcaggaggctgaggcaggagaatggcgtgagcccggtaggcagagcttgcagtgagccgagatcgcgccactgcactccagcctaggtgacagagcgagactccatctcaaaaatgaaaaaataaataaataaaagtccttgaatttatgcaaatgacatagcaatcacttcaactcttaaataatctaaccatcatgagataagagaatggatttttttctactcgtttgtatcttgtctttttgaaagagactacttgttaataatatgcttctgacaaaacaaaaactaaggaaagtgtatgatacaggcctgagtctctctcctcaagttcagtttttaaaaataaagtataatcagggataatgtagcctctacttgtaaaggaaggctggctttatgtattaatgaaataggcagcttcttacacgatgtgatttcaacagagccaggaagtatgtcttatctttaaataactccctaaataactccttctaacaccaatatctgaaatgttgtgactgatttctttctgtcctgccctgaagttctttcctgactgcaaagaacagcacattttgaatgtttcaaactgtcatacatgttctctccagaagagtggagtgatgccccaccagacattctaagtcacaggataacatgacatattccatgattgtcagttttaccatgtggcaagtagttaaaaagatgaagtttatagttccaagaacacaaactatgttatggaataggactaaacacaaggagtaaagtagtcccttgtttttgctttaggttactcaccttgctatcagtaattgtattcactgaagtattgaggaacacattaacgttggtttcagatttgttgactttaagttccacatctgaagtatgttggcactttgaccttgcataattcaaagtcatgtctctgcaccactgtttcattctatataaagtgattgacaataatagttatcccacccaagttggacttccatttctgtcaattggccaaactgggtttcctaaaaagccttgtagcgctacaaaatatcagaaaattttatcaagtctacttttaagtaaatgtgaagctctcaaggaagccctgatggcaatccagaaatagataaaagcagtacaggagctacagttgcctggggaacagaaactgacctgggttacccagagtttggggtattaacaactactcaggggaaagtaaaagtaggccttggacacataaaatgttgggaaggctgagccagacttcttgcatatagccgagtcacaataggctaagaacatgaatttaggaaggaaagcaaaaaaatctacaagcagtatgaaaaaaaaatctccaacaccttgatacattttaatgaatcatcagatgacaaagaaatatacaaattcttgaaagtgccagagacaaatcagagattcctagagtgaaaagaatgtccaccttttaatggggttgtttttttcttgtaaatttatttaagttccctgtagatgctggatattagacctttgtcagatggatagattgcaaaatttttctcccattctgtagcttgtctgttcactctgatgacagtttcttttgctatacagaagctctttagtttaattagatcccatttgtcaatttttgcttttgttgcattgcttttggcatcttcatcatgaaatatttgcccatacctgtgtcctgaatggtattgactaggttttcttttaggttttttataattttgggttatacatttaagtctttaacccatcttgtgttgatttttctatacggtccattttctgcatatggctagccagagttctcccagcaccatttattaaatagggaatcctttccccattgcttgtttttgtcaggtttcttgaagattagatggctataagtctgtggtcttagttctgggttatcgtttctgttcccttggtctatgtgtctgttcttgtacctgtaccatgctgttttggttactgtagccttatagtatagtttgaagtcaggtagtgtgatgcctccagctttgtgttttttgctcaggattgttgtggatatttgggctttttttttttggttctatgtgaattttaaaatagtttttttaattctgtgaagaatatcaatgatagtttaatgggaatagcattgaatctataaattgttttaggcagtatggccattttcatgatattgtttttttcttatctgtgggcatgaaatgttttttcattttttggtgtcatctctgatttctttgagcaatgttttgtagctctctttgtagaggtctttcagctccctgattagctgtattcctaggtattttattcttttgtggcaattgtgaatgggagttcatttgtgatttggctcttggcttgcctgttgttggtgtataggaatgctagtaatttttgcacatcgattttgtatcctgagacttcgctgaagttgcttgtcagcttaagaagcttttgggctgagatgatggcattttctagatataggattatgtcatctgcaaacagaaatagtttcccaagaagggagttaaaacaggaacatctcacagccattacagaaattgaagtatttatgtatctcaattaaaaccaaaccatcataaacgtatttctttgaaaaatatctttttttttttttttgagatggagtctggctctgtcgcccaggctggagtgtagtggtgccatcttggcttactgcaagctccgcctcccaggttcacgccattctcctgcctcagcctcccaaatagctgggactacaggcgcccaccaccacacccggctaattttttgtatttttagtagagccagggtttcaccatattagccaggatggtctcaatctcctgacctcatgatctgcccacctcggcctcctgaagtgctgggattacaggcatgagccactgtgcctggccgaaagatttcatttttaatgcctgctaaaatattccactgtatggatataccagaacttactccttgacttagtaattaaatgtatttatattctgtcttgagtttgcctcccatgtttcaaatatactagtcttctcagttacattgccaaggccattatttatatttcgatggtattctcagcaccagctgctgtgatctttgaaatgtattcttgaccttagatgctcactgcacacttgacagattgagaactgagtagaggtgcttgttagtatctgtatctcagtggctggggacagctggactcagcttgtgtgactcatgcaaagtcagatgatcagtcatagagggaacttggaacttaaaagtgtaaactggaacttacgcttttaaaaattattctatctcacatagtgagaaatctttatgactctttagtctacaaaagggatcagtgaacagtttctgtaaggtgacagatgatatggtatagagtagttccccttatccatggtttcactttctgtggtttcaattaaatgtggtcaactgtggtctgaaaatattaaatggaaaattctagaaataatgtataagtttagattatacgctgttttgagtagtgtccctcctagaacacgaatcaccactttgtctagcatatccatgccttatacgctacctgcccgttagtcacttagtagccttctgagttatcagattgactgttgaggtatcacagtgctgtgtttaaggagccctcattttacttaataatggcaccaaagcacaagaatagtgatgctcgcttattgttagaattgttctatgttattagtagctattgttgttaatctcttaccgtgcctaatttataaactttattataagtatatatgtaaaggaaacacaatatgtatagtgtcctgtactactgaagatttcaggtgtccactgaggatcttggaaggaatcccctgtggataagggtgcaccactgtaaatatgttcagctttgagggcaacatagtctctgtcacaactgctctacctgcaacagcgccagacaaatctggctaaactttaatccaacaaagttatgagttggtctgagccctcaggctgaaggtcatgtaaactgagcatgcccagatgaaccaagtatgcaaccacaaggggaagagaagtgcccagaccaaggagaagaccaaggagcagggactgacttaagaagcagacgcagtatggaaggatccaggatccaatcaaattgagctctggcatcagcccattgtgggatcgaatcagatcatgcctcctggaatcatctcattgcagaattcaatcagatcacacctcattaccctatgcttataaaaccctacccaaacaccagctgggggtgatatattggagcacttcctcctgtctccttaccagtccacttgcaatgaagcttttttttcctcaaaagccagtgccatggtcttggcctccatgtacattaggcagcaagcccattgtttgctcagtaacaccctacatttgcatccctttgtatcgtgaaaacagccacagagacaatgtaaatgacttttatctcatttaaatgaattgtcaacctcagctaaattactacttatcatataaacagaaaatgtaaataaactgattatttctttccatccatgtttttactgtcttcatgtatagcatgtataggattttgaagttaactgtttctgaaaacttacttgcaaatttttcaacactgcaaaaattgcttaaaataatgaagccaagaaaattaagccaggttaaaaacataaaagaagaaaaggaaggagggcaggcaggtaggcatttgttaaaagcttctttccctcagcatactattatttgcgattcagctgtcttgttgtgtttatcagtaagttgattcttggccaggcacagtggcttcacgcctataatcccagcactttgggaggcccaggtacgtggatcacttgaggtcagcagtttgagaacatcctggccaacatggtgaaaccccgtctctactaaaaatacaaaaattagctgggtgtggtggcgggcacctgtaatcccagctactctggaggctgaggcaggagaatcgcttgaacccggaggcagagcttgcagtgagccgagatctcaccacttgcacttcagcttgggcaacagagtgagactccttcaaaaaaaaagttgattctttttattgtgagtactgttccattgtataccatttgttagcccattctcttattgatggacagctgggatgtttagatgttagaaataaagatgccttgaactatcgtaagttttcatgtgaacctatgttttttaattctcttgggattagaactgctgggacagaggatcagtgaaaccttaattttttttttttctttttgagatggagtctctgtcacccaggctggagtgcagtggcgcgatctcggctcactgcaagctccgcctcccgggttcacgccattctcctgcctcagcctcccgagtagctggaactacaggcacccgcaaccacacccagctaattttttgtatttttagtagagatggggtttcactgtgttagccaggatggtctcgatctcctgacctcgtgatccacccacctcggcctcccaaagtgctgggattacaggcatgagccaccacccccggccgaaaccttaattttatgaaatgttttttatgttccagaccttaactgatgagcttttaaaactaacttctaaatttgaaatgtacatttaattatggaatacgctttaatgtaatcttttgggataatcacctaatattttgccttgagatttttaatataaataacaataaaataaataactaatagtaaatgaataccttctcaatcttcctaaccttggaatatggggacaggatgtgaaaatatcttagagttttgagatctttacatggttccctcaaggcttttaaaaagagtatttaattgctggcagtggtagcttacgcctgtaatcccagcattttgggagaccgaggcgggtggatcacctgaggtcagaagttcaagaccagcctggtcaacatggtgaaaccccgtctctactaaatatacaaaaattagccaggcgtggtggcaggcgcctgcaatcccagctactcaggaggctgaggcagaattgcttgaacccgggaggcacaggttgcagtgagctgagattgtgccattgcgttccagcctgggcaacaagagcgaaatttcattccaaaaaaagagtatttaattgtgttgattttaatgattactgaaattttggctgtttttttgaaactatttcttgtttcctttctctttcccttgtaaataagctgtaagagaaaactgctcaatcacaaaacgtaacagaaggctttcatgtcagtgtccaataggagtgaattttttatggtgacaaggtagggttataatccagatctctggtaggcacatccataaggtgcaaggtgtgtagaaaatagcatcagtttttttggctgggtgcggtggctcacgcctgtaatcctaggattttgggaggctgaggaccgtggatcgcctgaggtgtcaagagttcgagaccagcagatatggtgttcttgttctcaaagccgaggtgggtggatcacctgaggccaggagttcaagaccagcttggcaaacatggcaaaaccccgtctctactaaaaatacaaaaattagccaggcgtggtggcaggtgcctgtagtcccagttactcgggaggctgaggcagcagaatggcgtgaacccgggaggcggagcttgcagtgagctgagatcctaccactgtacttcagcctgggcacagagtgagattccatctcaaaaaaaaaaaaaaaaagagtctaggatccagagaagtaaactgtattaatgatgtggtcatatccatgccagagcttatttggaaatgcacagaattgattccaagatgttttaataatgcaatctggggtttgcatctcaaagtaatgatccatcaaggatggtctttagagctattttctaactcacgtgcttagtggagactcacatcaaaatgccctgttaataggaatcagtagctggtaaactgaagcctaattcaattggtgtcatttccctgcaaattcgtactccatttctgtgctatcaactgaagaccacccacccaaagctattagtatacaatatgatgtgtaacagagctccatgacttctctgtggaataaattatttcactgtagtttttaaaaatatttttcatgtttatactcagagtaaatgagcaatgttacaactattcttctctgtaaattgtcacaccttaagttccttaggatggctcaactctttcacatttccagcatgggaaataattgtttaataaaaataaaacataacaatggattcatgatccaaagaaggcaaaatagaagatttcttgttttctatttctcttgactcctcagctaattgtaccaccactaaacctttctttatctcccctacctcacagggttaatctctaatgctgttcaacattttatacctatgtggaaactaccatttaactaaattttgtttgatgtggaaaaaaaatcattctttcaatatttgataattttggatagctaagcacttttgttagatttttattttcttcaagagaaataaaatagatgcagtggaaaggattacttctcagtccccaggggttgaacactcacccgaggactcagtgcatttgattcctgacacttatttaagtccccttttcatgcttacttactaggacttcttaaatttgtctccttccaggtgaaataattcaaaacaactcaagaatggaactactgattcattaataaagaacagaaaataaacaagggcaaaacttgagaacataaatacacaaaaacacaaagactcacttaatttttatctcagataaaaaaggaaagtagtttgctgaatttgcctttctactaagaagtctttgctttcacttggttgggagggtacttaacatgaagaagcaggaattcctggaaaacaggccccttctaccctaatgtgttttctgtggggtcattcagttattgtccctaagcagaggtaactgggaaatagccttgggctgtaattttcccattttaccttaagcaatatcataactagcaaagtgtgacacccaggaggtttgttttctagataacactctctttacaatataagggctctttgagagagttaatataataaatcctcagagtaaagtctaggatactctttagaaattaaatattacttgaaacatatgaaagccattcagcaggtgacagagctatttacaaatagattaaacatctttcaagtaaattattataacattcattaatgttgttagtgtttatgcactaaaacatagcccaaaataacatattttatcctcatattgtagcacaatttatgttacacttgaacaaaaatccctcaatgtgcagctgattttaaatccatcatcagttctactagtcaaaagtggagaatctttttgcatttgtacctctggtagccaaagtaatgtatcttctctccatgtttctttatccattcattaatgtgctgttttcacattgcttcgttttgaaattgtccatggcccagctgaaccaagcagaaagatttcccagtctggttgcattgtatttcaccttctgttgtcaattcctttggtctcctaagaataaaatcctttggtctcataagaataaaatgagttttgttttcctttgagcatgtagaatatttttggttattgttcaaaagtgaagccacaaatcagaaaatgtttttcttcttcgtttatttgctcctctagcaatgtatatttcatatatgtgagcgcttaggtctaaatttcaggtctacattcggcacagcatcttcatggacagctaatgagattgcagatggtaaagcagaacatgtgtggtcctgggataaactactccaaatatcttattaaacccttaaccctcccctctctcacaggcctcctttgcataaacattttatattacatttttataaagacatagatgaatacctccactgtaatttttcttaaaatttagcacgattatctcctttgaagaatagaatggtcctttaatcaaccaattaaaattgtataacccaccagaagaattcatatattatgtttaataattagtcacaaaccatatgtctgggactatttaatattgactttagctccatgtatattatttccatctacttttttattttagtaggttaatagtatgagtatgaatatattaatttctaaatggaaagagatgtactttattaagctttggattgtcaaggagagcaatggttaaatatgactaaggtccatttatatttaactctgctatttttttctggaattgacagtataggtgaatgcatgctcgtattgtactttctcctttgaaataatgaagaagccagacaaaaggattattgctcacagaagagaatagaaaaaaggaagagaaccagggaaagaaggacccaatccactttctctaaaattattcatgtttgagacaatgactgatttcatgagtatcttcttacctctctatgtctttttatggcatattttaaggttgatttttgaactgcctttataaatgttttctaaggtttcaatgaaggtaaatatgcctttgcaaactatttctcaggctatgaaccatgagtgtgtgggtcagtgagtggcaatgatgacatgccacacttgtggagaaataaatgatgaaaggttaaatgctttttgccttagatcaggaagaagaggttgttcacttgtttagaatgaactctctgagtttctttatctgctcagcttgtagccattgtttctgcagccaccagagacccagacagaagcacagcagcaggagatccacttgcatgggtcagattgcagatgtggcttcaatgacatgaccacagtgtgaaagttccctggagggcacacagcatgcttagaaaacacacacacacacacggaggtcattgcctttattgggtccagggcattatataaacagggagctttaaattgatgggcttaaagcaagcaggcactagtactaggaagtcacattgtgactgaaaagtgtttaaatggtcgtttagaggaagcagcaggaaagctgggagcccatcctgctaggagacagagatgcctccaggtttttatttctggtcaccacctggagccatttgggggtatagtgcaggaaactgcatcaagggtgactgaaccctgcttctggtttgagaaagttaaacacatatttaaaaatggatgctaaggcaacataaaactttaagcgctcactgcagcacatttacctcttttatttaccattgtattggaggttctagccaagataagataattaaacgaataataaagtaaagtcattcagattggaaaggaagaggtaaaattagctctacttgcagatgacattacctttatatagaaaaccccaacaatgccactaaaaaaaattattggaactaataaacaagttcagcctgacggcaaggtacaagatcaatatacaaaaattgtaggggcccggccctgcacagcgccctggggaagctggtttgaaagctctggagcgaccccagtgccgggtaaaggacaagatttgcccagacagaagggaacttggggagaggtggccgtaagagtgtgggatgaaaatgttttgggcagagcggtcgaactcacctgaggaaagcatggggggaggagtcattaatatgaatgagtggcagggacagggcgtccttgcagcgccctcggtgttggaagggaagaccgtgcagcgcgatggggatcagggcggcgggccgcagccggggtggggttgggcgccggtcagggtgccttgaagcagattctgtcctcaggagctgcagttcttcctcctccgccctcaccggcgggcgaccttaggcagggagtgaaatgcaacgggagccctggagggagggtgaagccgcgcgtgcaagaggaacctcctattggcgagttcaggtcccccagctgcggaggtgggggaccctgtgtggcagcctgctgagcggctgcttgctccgcggttggaggggggaagctctagcccccctcctctttttcagccgagaaaccgctagttacccccttatgcaaccaagactgtaataaccctgtcacctttcacggccctccgggtctgcgcctatcctctgaagattcactcatccaccccgaggcctgttttcctcacctgttgtccctctggcagaacctaggcccctcggagaccagccagaatctatctgcccgctgttcccacccaccacactccctccccagttctatcccagctccttaaactgttggagttcaaacctcagaccatgacagcacacaggcctggactccggtatggccctggacaagttccttaatctctctgagcctcagctttcttccacgtgaagcagcggtaacattgttattaggagcctcccggccccagcacaccgacatacatacaactggatatccatcctgcctgtgaggagtcgtctttactttgggttgtttcttgtccacagaggtccacactttattttcctggaggcaccagcggagtcactgatgcacccctgcatccagcatgtttaagggagacagcctggggagggcaggaagagcctagagggtcccctagtgattagggctgtgatggggatgttactggaaaagggtccctatccagaccctaagagagggttcttggacctcctgcaagaaggaatttggggcaagtccataaagtgaaagcaagcttattaagaaaataaaggaatgaaagaatggttactccataggcagagcagcggcaggagctgctcgactgactatacttacagttatttcttgatcatatgctaaacaaagcgtggattattcatgagttttccgggaaaggggtgggcaattcctgcaactgagggttcctaccctttttagaccctatagggtaacttcctgatgttgccatggcatttgtagactgtcctggcactggcaggagtgtcatttagcatggaaatacattataattagcatataatgagcagtgaggatgaccagaggtcactttcgtcaccatcttggttttggctggctcctttactgcatcctgttttatcagcaaggtctttgtgacctgtatcttgtgcggactttctatctcatcctgacttagaatgcctaagctagtgggaatgcagcctcacaggtctcagccttattttacccagcccctattcaagatggaatcactctggttcgatcacctctgacaggggcagtgtacattcacatcttggcctttgctgcctcatccttccagatctttcagatgcttgccctctggcattctaggataggaagactgcttccaaagtgacgcaggatttttctcggacacttttccaactgcagacttctggctgacgatgcccctgcccatgcctagctctgccccaggcaggaggtgccctgcccacttgggcttgcactctggtggggatcctgcagccaccgagactgcatgctcagccccagtaggagggggtgtgtgatcaagtgagtgcctcatcttgccagcaactccaagtgctggcgcaggagcgggctccctttggggcctgcagctggatcaggcctgtcggaagtgactccgggggtgaactctggcatgcagatgaagggaacttggtggcacccaaacaggaaagcactcgactctgaagccccagaggggatgttacagccatgctaacagctcttttagtcccaccgtcagcagcctgacaaacgggcatgttaacaatgaatggggggtgtgttaacaactctgtcagtcctgttgcctgctcctgctggaggctccctggctggcctggccctgcactgcctctcatggcaaggggctgccactgggcacaggtagtgggggaggggtggagggctatggtgttactgccttcttcgtaccctttgctgacaatggaagggtgaaaagggcagagaagagttttatgaagcaatgaaacagctctcagcggagaggggatgcgagggtggtccctgacctgaagtcgggtggtctctctcccagcgtggctgggtccggggcttttatgggctcagaagtggggactgcatgctgattggtttacgagtatacaaaaaaggctaaaacaaaggaaccattcaaaggtggcatgacagtgtagaaaaccacctagggaagggtagatatatgtaaagtaagtgaagggtggggatcagtcagaggaaagtgcaccaacaggaagagatgttctcagctcagtccatggatttatccaagacttgtagcttagctttcgggctttaaactgccttcggtttgaaagttggatttcgttggggacatgccactatctgcctaggggcttgtctgactcctgccactattaaaagtactaaatcagtgcatctagcctgagggctgcccctcgtccacccagcagaggtttttgttttgttttgtttttcttttgttttaattaaaattttaattaaaagggactaatatagagggtttttaaaaaattaccatatgtgttgagtatttatgctatgccaagcactttgcatatattttctcatttaatcctctaaatagcgaggttgattgccttatctccatcctatagatgagaaagctgagactgagagaaattaagaaacccacatgaggtcatgttgtatgtaagttagtttttgctgcatcataaaccacccgtttatgatttcaaacaggtaatacttgtttctcaataactggatgggggctggatggctaaggggcctcatattttagggacaggaggagctcatcgtcagctgggtgatgggaatgtgaccacaagtctcattatccaggagagcttgaacataggggttgagtttcaaaagcagcataagggcagcaacacaagaacttcccatgtctcacttatgtcatatttgctattctcccattggccaaagcaggtcacaagggcatggccagccggtatggaaggggacaaccaaaggggtagacacagggagtgagaattgctgccattttccccaacaaagaatctaccatccatagcttctaagtgtacagctggaaatcaaaactaagtttgtcttacttgaaagttcaaaactgtcttggagctactgcccggggtctaggaatccagaacattccacacattgcctaagtcaacaacctgttgcgcacacacaccagcaactgttttacaaaagtatgtggatctggttgtcattgataaaatgcaaattaatttagatgtattattcaattcatagtataattttgttgtattttcaaatcaacagatatttacatcatttcaaagcagctcttcacaaattattcattagttacaaaaggaagtcacttcacagtggaaaaatctggcaggcgccaccttaatcaagtaaccaaaatgaacatcctcagtaataggacaaattgcaatcgtgtgcctcctgatagtctagcaagaagaacacagcatcacttctatgatgctcctgccaataatacataattggaatctaatcctaaagcaacaaattcaaattaaggaaaattctacaaaataattggcctgtaatagaagtgtaaagtcatgaaagttaaggaaagactgaagaactgttccagactgaagatgaaagagacgtgagaaataagtgcagtggtgattctgaactggatcctgacttggcaaaacttgaatagatctgttggttggatggtagaaatctattaatgttgatttcctgattttgctagctatattacaattttattgcattcagtccttgtttatagaagacatacagtatgtaggggttatagggagtcaggtcaggaactttcaaatcatttagcaaaacaaaagttctttgtactttaattccaagacttctataaatttgagattattttaaaaatacttaaaaaaaaactcctttaaagtctctcaacatgctgtcctattaatagatttctaaatttgtttttatttttatcaaggttttgtgtgcccatagtttgaagtattaaatctttttttatttattaaaatattttttaatgtccattcagaggtaatgaagtgttaggttttttttttttgttttgttttgttttttttttttttgagacagagtctcgctctgtcacccaggctggaatgcaatggtgcaatctcggctcactgcatcctctgtctcccaggttcaagcaattctcctgcctcagccacccgagtagctgtgattacaggcgcccgccattgtgcccagctaatttttgtatttttagtagagacagggtttcaccatgttagtcaggctggtctcgaacccctgacctcaggtgatccacccgctttggcctcccaaagtgctgggattacaggtgtgagccactttgcctggcttgaagtgttagttttatcttttttttttaaagaaaagtagttcccttatctccactttccccctttcctgcacctcagaggcaactgctttcagctgattactttgacaggtatgaccttatttccacgtaattgcttatgtcattatttttttctttttgaggtagggtcttgctctgttgcccaggagtgcagtggcgcacttgtagctcactacaaccttgaactcctgggctcaaatgatcctctggcctcagtctcctgataagctgggactacaggtacatgctaccatgcctggctaatttattttcgcagagacaaggtctcactatgttgcttgggctgacctctaacttctaggctcaagtgatcctcccgcctcggcctcccaaagtgttggaatacaggtgttgaaatcaagtttagcctaaagccgcctccttatatatttaagtttggcctaaaagtttgtctgtatattgtgacaagtggaggtgtaaacagactacacttgtgccaatcactgagttttggccaatcaaatgtagccaactgttcaaaccatgttcagataaggcaaatgccaagctgcagccaaacccagctgtttctgtacctcacttccattttctgtccataaaccttccaccgcatgactgtgctggagtgtccgagcctactctgcctgggaaggctgcccgattcttgaactgtttgttgctcaattaaactcctttaaattaaaaaaaaaattgtatttctctactctagcaatgaacacttcaaattaagacaattccattgataattgcatcaaaaaagaaaatgcttagaaattaattattcaaaaagagcaaaagttataccctaaaactacaaaacatacttgaaagaaggtaaaaaaaaaaaggagtaaataaatgacaagacaccaatgttcagagattgggagacattattaagatggctttccaaattgatatacagtcaccatgtctctatagaaatctcaacagccttttctgtggaaattgacaagcccatccaaaaattcatgtggaaatgcaagggactcctgatagtcaaagtaatctcaaaagtgaagagcaaatatggagtatgcacacttctctatttcaaaatttactacaaagctatagtaataattacagacttgtactggcataaggatacacatatagaccaatgggatacagctaagagtctagaaatcaatgtttacattaatagttgattttcaaccagaatgccaaggctgttcaatggaaataatagtcttttcaacaaatggtgttgggaaaactggatgtcacatgctaacgactgaaactggaccctttcttcatattttatacaaaaagttacctcaaaaatatatactaaaatttaatagataaaattataaaactcttagaagagagcataggggaaaaaaatcttcttgactttagctttcttagatatgacaccaaaagcacaagcaacaaaagaagaaaatagataagttggacttcctataatttatacatatatgaatatatcacattgtatcccataaatacacacagtcattatttgtcaattgaatttttttttaaagaaaaaaaaaattttttttgaggtggagtcttactctgtcacccgggctagagtgcagtggtgtgatcttggctctctgcaatctctgcctcctgggttcaagcaattctcgtgcctcagcctccccagtagctgggattacaggtatgcgccaccacaccaggttaatttttgtatttttagtagagacggggtttcgccatgttggccaggcttgtcttgaacccctgacatcaggtgatctgcccacctcggcccccctaaatgctaggattacaggcctcagccactgtgcctggccagaatttttgtagttccaaagatgctaccaagaaactgaaaagacgacacacagaatgagagaaaatatttgcaaatcatatatctgataagatattatatccagaatgtataaagaacacttaccactcaataataaaaagacaaataacctagtttaaaaatgagcaataaatgtgactaaagatttttccaaagattggcctgtgtgctcataggaagatgatcaacattatttgtcattagaacaatataaatcaaaaccacaaaaaaggctgggcatggtggctcacacctgtaatcccagcactttgggaggctgagatgggcagatcacttgaggtcaggagttcgagacaagtctggccaacatggcaaaaccctgtctctactaaaaatactagctaaaaattagctagctaaaaaattagctagctaaaaattagctaggcatggtggtaggtgcctgtaatcccaggtacttgggaggctgaattttacttttagatggataaaatgtacattatataaactatatgtcaatacagctatgtatttttttaaagtacaaactatttttttaaatacaaaaacattacatagcgtgaactccatggcacagctgccatactgaaggaattatactgtgtttaaaaacctgattaaaaattaagtttttaaaaaatggggtcattaaattttattttaaggttttaacagttctttacccaagccaaacattttatctacagttgcccaaggaaatgcagtaagcgggttacttaatttcctccctgtggcaatccttggctctcgcccttcttaacactttattaatgcaagtcagcaactgctagttttacatcttatctttcatcaatgtttaagagatagcaagtctagggctcattatgatctgctaatatagttcttaacaagacacttagcttccatagttatttgccaatgaagcaagaaagtggtaccacttcatcattattctgattttattggagagagtgaatgtgtgagtttactgagggaagcagcccaaggaagtgggatgggacaaattctacaacagagatcacccatagacaaggagtggacccatgaaacttaaagacgtagcgatttagggagtgactttacatcctaggattaatgtctttgggggtttatgattaatatttagttccttgttgccatgtaacagaagatgtaaatgggttgctgtggtgagtcatattataattttggttttttttttttgagacggagtcttgctctgtctcctatgctaaagtgcagcggcgtgattttggctcactgcaacctccgcctccctggttcaagtgattctcttgcctcagcctcccgagtagctgggactacaggtgcccaccaccacgcccagctaatttttgtatttttggtagagacagggtttcaccatattggccaggctggtcttgaactcctgacctcgtgatctgcccgcctcggcctcccaaagtgccgggattacaggcgtgagtcaccgcgcccagccaattttggttttaattagaaactagataggatgcataccaaatatatattatgacgtgtccccaccccctgccaaatagacacatatacattgtctccttatcttttctccaatcacagtatctatttcactcacaacttttatgcaaaatcatgaaataaaaataattttaaaaattattaatcttcaaaatcttaaaaattattaatcaaatggataaatttgatatatgtgatattatttgtctttggtaattttgtaaagacttttaaactgtttttaacattcaaaaggaaagacacatctctctcttttaatgtagaaagtcagtcttggttatttacagcatacatggggggccttatctgattctccaatccctggaaaaatagagttgaatgctcatttgatcctattccacatgctactggtttccctcctgttcaccctgctccagccttgaggatgttcttgttgaaatatcaccatccaaagctcttcctctatcaggcttttgcatttgctgttcccttttccacatcttctcaaggctggatcttctttagttttcagcaaaatgtgaactctgtgaagaggcctccctgaccactcaattagccactgccccatgactagttttttttttttaacttccttaaagtgctttaacttcctcaagcccttattattattctttgagtgcattttgattatttgtttcttgtttatcatctagaagtagatgacaacttcatgacaacaggaacataatcctcatgagggcaggcattttactagtattgttcacgattactctcccactcccatgtcaaattctgtgctgtaataggcattcaataaataatggaatgaatgaacgacagacaaatgtcacacatcatgccacctgatgttataacatccaatgttgataaccgaacagaagcaaaattaaaggccatgagatattggaatggtcacactgattaaaggctttgtgggctacacctcattgcacacatttatcaatgactgaattaaggtgatatttagcagtttgatattacctatgaaaacaaaccaaatggatgtagcatgctttctttttttgaaacatatttaataattgatttcaatcattttcaatctgaattttaatatacttttaacaacagatttcatagtttggtcttgtttttcttgtttgtttagtgactcgtttacttgagcattaatattaagccagttctttgtgtagttatatgtagaagtagccatcaactcccaagcaccaactccaggccagttcaaatacggaagactcacttgaattcctgcatctcaatgatggtacagcctggagcccttctgtcctccataccaacaggcatttacagctgatttggttgtttggcagcgaatctctgtcctgctgccttcaagctgccatttcatttcttcaatatggagacaggaaatgtggcttaccatcagcaacaagctagtagtaatcatcctcatggaagacacaaaaacgtttgtcaagagggtccaaagtttgtagctggtgagaatgtacaggaaagaaggaaggaaggaagagagggagggagggtggaagagacagagggagggtggaagaaagggaggaaggaaggaaagagggagggagtaagagagtaagagagagagtctgagaaagatagaggtggactccacacataccagcaaaacaaactcatgaggtagaactttttagcatttaagctttgaccagcatccagatgattttcttttcttttctttttttttttttgagacacagtcttgggccatctcccaggctggagtgcaatggcacgatcttggctcactgcaaccccctcctcctgggttcaagcgattctcctgcctcagcctcccaagtagctgggattacaggtgcctgccaccaagcctggccaccacgccatcacttctccatgttggccagcctggtctcgaactcctgacctcagtttatccaccctcctcagccttccaaagtgctgggattacaggcgtgagccaccgcacccggcctcaaatgattttcaaatgtactcagcaatgcaaaactatcatcccgaattcttaatttggtgcattttgcttaaaggaatgtaagttgacaaatggtatgtgtaatttcccctgtggtttccctcttcagagtctgtgctccctgcattgaataatgagatgtaagtttaggaaatgcctccatggtgttcattatactttgtgtattttccctgagacaggaaacagaggactgtctgtcaaagaaagtaatttttataaattcacagccaacggggaatattcctttcattttttttagctaaatctgtgatttaacaaatgtagtgtttgtcagcaaggagattgaaaccattatgtctttctctacctgttgataatgatattgcaagtgggaagtcgcaaatatattggcatcaatagcaacacggcaagcagatgaagctccaaaactcatcacccactttgaagccaaataaaaagcccatttttctttctagttattaatgatgtgaaactacagactgtaactgcaaataatcattggcaagggcaacataaaagttataaatttaggctttgaaaacaaatcaaacttgaaggaatcctctgtaatttattcctaaattaaagatttcctctttttttttttgagtgaaagaacttatacgtaagcatggaaatgagaactaaatcatttgctgaaacaattgtctgagagttacttaattcaaaaccactcttgtctatgaaataaagcagaacttgattagcacgtaataaaaggcaattaatttaacagacagtaaatatattgctgattcctgaagtctctggccccattttctcttcagaaaactatttcaactgatagcattctctcctttcattgaagtcctatagtaattaaaatcagttatttaattatatactgccttgatatacagagttcagactttgtaggactattgctaatcatctaaatcaggagtttggtaaactatggcccaaagaattaaacttggccataaccatttttttttctttttttttttttgagatggagtcttgctctgttgcccaggctggagtgcagtggcgctatctgggctcactgcaagctccgcctcccaggttcacaccattctcctgcctcagcctccagagtagctgagactacaggcgcccgccaccacgcctggctaattcttttgtatttttagcagagacagtgtttcaccatgttagccaggatggtctcgatctcctgacctcgtgatccacccaccctggcctcccaaagtgctgggattacaggcgtgagccactgctcccggcccttggccatacccatttttttacattttatctatgattgctttcctgtgattgagttgaacagctgtacagagacattacagcctctagaacaaaagtaaatttactatctggccctttgttgaaatagaccttaagattgtcacgggaaaaaattgaatctcctactcagaggatattgtttcacaagtgcggtccctaaaatggagcagggaaccctcttggggcctgcaccccctccattccaccaccctgcacccccatgcatggaaataaaggaaaatattgagttccttcaagggaaattccaggcacctagctaaccctgagaagcaagcaacttgataagcaagaaagtaatcacagcttaaaacaacagccaaggaagttctagccataagatatttgaaactaaaggcaacattttaacatatgtccctgagttgtttttcagaaacccagactccctaccgagcagatccgctggcgggtagaacacagataagggggagctgaggactgaaccccgaactccgtttgtccttggctctaaatttattcttgagggacctggaggaagccgtgcccacgtgccagagctaataatcttttctgctgaccccaaatgtttaaacaaactcttttttcatcaattgcaaaacagtctttgaatataccaatgaccggtaatcttctacttcaaactatcccacctttttaggccaaaccaatgtatcagttcacaattttgttgtaacttctgttttcctgaaatttacccctgcctttaaaacccttacttgtggccgggcgcagtggctgacgcctgtaatcccagcactttgggaggccgaggtgggcggatcacgaggtcagaagatcgagaccatcctggctaacacggtgaaacctcgtctctactaaaaatacaaaaaattagctgggcgtggtggcgggcgcctgtagtcccagctactcgggaggctgaggcaggagaatggcgtgaacccgggaggcggagcttacagtgagcggagatcgcgccactgcactccagtctgggtggcagagccagactccatctcaaacaaaacaaaacaaaacaaactcttactcgcaagccatcaggaggtcaggtgtaaagcaggagctgctatattctccttgcttggcaccctgcaaataaacacctcttttctcctgctgcaaaccttggtgtgggtgtttggcctgactgcgctgggcaggcagacccagcttaggagtgaaaacatcccagaccagcagcatgagcaccacctagcaagttgtcagaaatataaattccaggctgggcagagtggctcacacctgtaatcctagcactttgggaggccgaagctggtggatcacctgaggtcaggaagtcaagaccagcctggccaacatgatgaaaccccgtctctgctaaaaaaatacaaaaattagccagggtggtggcgggctcctgtaatcccagctacaagggagactgaggcaggagaatcgcttcaacccaggaggtggaggttgcagtgagcccctgagatcatgccattgtgctgcagcttcagcaacaagagcgaaattttgtctcaaaaaaaaaagaaaaaaagaaaaaaagaagactgaccatgttgagaggtgaagccagctgggcttctggggcaggtggggacttggagaacttttatgtctagctaaaggattgcaaatgcaccaatcagcactctgtaaaatggaccaatcagcaggatgtgggcagggccaaataagggactaaaagctggccacccaagctagcgtcagcaactcgcttgggtttccatccaggctgtggaagctttgttcttttgctccccacagtaaatcttgctgctgctcactctttgggtccgccccacctttaagagctgtagcactcgccacgaaagtctgtggcttcactcctgaagtccgtgagatcacgagcccatgggaaggaggaaactcctgacacaccatctttaagggctgtaacactcacggcgaggttggctgcttcattcttgaagtcagcaagacgaagaacccaccacaaggaataaattccggacacaatgttacctgtcatttaaaatgtagccacttctcctccctttcctggtctctccttgttcctattggaagttacctctaacacttccatttgtttaatatcataaagttgcaagaaacgtacagagagagaaaaaggttctaacttttcttaagataatatgggtgtatatatacgcaaatatatatataatgcttgtataaattaacatttattatcttctatgatatgataaggcatatcaccaagtaatctggaatatcaaaatatcagcatcagctctctctgtttcaatacgtataaactaggtagttcactaggaactttgaatacattagctctgacctttacaacagttctatggaaaaaaaatagttatctccttttaacagaggaagaaaattgatttttcagggtatttccactcttacctcagtttcctcatatgtaatgtgggattgactcagtcatctgcttgaaagaagacgggcaaatctggtcctctgaagagggaaaggggagatgagtgaaaatgaacagaggaagccaaaaaaaaaaaaaaacacacacaagcacacaccaaaaataaagaggagacccattttaacaggcatataacaagtcagttttatctctttatttttttattttgtatttttttttgagactgagtctcaccctgtcgcccaggctggagtgcagtggcacaatcttggctcactgcaacctccacctcccgggcttaaaggattcccttgactcagcctccagagtagctgggattacaagtgtgcaccaccatgcctggctaagtttttgtatttttagtagaaagggagtttcactgtgttagccaagatggtctcgatctcctgacctcgtgacccacccacctcggcctcccaaagtgctgggattacaggcatgagtcaccacccccggccgaaaccttaattttatgaaatgttttttatgttccagaccttaactgatgagcttttaaaactaacttctaaatttgaaatgtatatttaattatggaatacgctttaatgtaatcttttgggataatcacctaatattttgccttggcattaggcatggagcatttgtctgggtgatcacatggagggccctgcctcagtttacctccctcattgacctgcttgttgactaaattatcataacttgatcacaattcctttgaagctgcctgaatcaaagccactgatctgcagataaaatcaaaatacacattcagtgttacacacaaagtaacattgccttatatactgtatctacactttattgagaactggaaattccataaagatggagaggcattactgaaggcaagcaagcaaaactctagcatgcagtcagactcatggcaggaattaggcatgatctaccttgtcctcacccttggggcactgcctgcatgtctgtaggcctcggccatgcccagctcctgtggctgcctggaaagtgtgggtttggccagttgctgccatcactactcctcaataggtcctggatctcagaatttgcctggtagtcctgggcccacctgctgatgttcaggataaagggagtggggagaaggggtcattctgcttccttcacgtggaagtgcaggtgttagttttgggggactggacagcaaagagcatggttccttgactcctgggtcatggggtgtctggccacttccacatcgttgccactcactcctagtgatacaccaggcaccagaggctccactcctgaggcacatgccccggctgcctcaacactggcccttccccccaccttggatgagctcctgttgcttcagcatgagcagggctcactctttcactctgcagcaggcctaggctgtgctggcttctgagatgccccggggcacctgctgggaagtggggtgtatgtgcgtgaggcgccagtgttggtccattctcgctgggcagccttattttcccagctttttccttgtgccgccctcagccttttgtctctcatgacttccctttcaggtcacaccactttgctgcttgatccttgagtgttagcaacccttccctgctctgggactcagtttaccttttgttggtctagaggggcaggacaggtgatttcttcccagcttgactccagatcaatagcttgccctcccctggtgacagcagagagatctgtgaatcactgcccaccctcacccccactcctgcccctcggcatactccccgccccaggtcttcccaggtcacctgctcttaggctccaccacacccctgcaggtcagcctctcccagcagccttcccgtagactccttctcctctctccccctctctttcctgtagaggctttggagcccatcagcccgaggaccaggactccaccgccctgcacccctcttgcgccaggatggccccaaacttcggcagatgctctggctctaaaacttggaccagcaccaggtaccccaggcagggccctagttctgctgtcctgccctgaaggccatgttcggtggctggcctagcctgatgggaacatgtacagtcaggaaatctctccacagctccaggcccaggtaaatggttctcaatactctggtccaagggactggtcctttgaggtcaggagcacatctcagcttcaaggaaagctgaaaaacatgcaagactctattgccaggagaatttatttttattttttctttgtgttattattattttttctttatctgccttttttttcttttttttgttttgtgatggagcccaggcgggagtgcaggggcatgatcttggctcactgcaacctccgcctcctgggttcaagtgattctcttgcctcagcctccccaggtagctgagactacaggcgtgtgccaccaagcccaattaatttttttttctttttttttttttagcaaagatggggtttcaccatgttggccaggctggtctcaaactcttgacctcaggtgacctgcctgccttggcctcccaaagtgctgggattacaggtgtgagccacctcacctggccctgggccaataattttttaataactcctaccataatatttttgtttgttatttatttgataaatatgatagactaaaaataaattagcaaggccgggtgcggtggctcacgcctgtaatcccagcactttgggaggccaaggcaggcagatcacctgaggtcaggagtttgagaccagcttggccaacagggtactaaaaatacaaaaattagccaggcgtggtggcaggtgcctgtaatcccggctacttgggaagctgaggcaggggaatcacttgaacccgggaggcggttctgtttgcaagtatagttgtaactgcaacccaaaatgtcttagaaacttgctatttgaagtattgtcatcacctgggatcttgctagaatctgcatttaacaacattctcaggcaattttaatgatcattaggtttgaaaaacactgccttaaaacaaaggaaagaatggcaggcaagtttcaattctaagcatgctatattgtatgttcttgggcaaattccactaagtctgaattttaaaacagttaactatgggtagtaatgaatgaagtgtcaccttgtaaagctactttgagaaatccaagtgttggcaaaccctttgcaaaaataaagttgctgaacatattctaatacagttatgttgggctcctgttcttatgaggcagagaaaattatgctttaatcagagcttctaagtcacaatcactggaatctattattagcctttaagtcctcattcttgagacagcaccatgtctattcttggttgctgggaaactgattatgctcttcaaatagaaactgcagcagcagatgaactttaagaaaatataatcatgtttgtaagaagaaaaatttaataaaggaagaaatgaagcaaaggaaactcataaactgatctgttttgaaattccatttctgccctcatgatagcattattgacttaataatgaagcaatgttactcattcacaattgtacagcaatggccaaagactgaatgacctctattttctgaaattgtttcattcacagagttcactcctgatgggaacatccagagacatcttcagagagctttgctttgacccccaccccccaacattttaaggcatggatctggaaataatgtagttggtttacaaaggtaagtcttattttacaattgcatattccacaaaggcatttcactttcaaagctcctccaagacaattacctccagattgagacacaccctgctcctgaattcatgcctgcataccagccattcttaatcaccttcctttttaatccagttggaaaataaaatgtttccttgttctctgaatgtacagtactcagatgtacagtgaaaatgattgatgctcaaaccgcctataaattctttgattccatcagcttttctctttctactggccatttcccattagtgtttaaacttaagactcacacatctcccatcaaataaacccccttcaccctacttcaccgatttcagtattttagcttctcctctccttatttacttcccatttgtctttcagtccatcctgctctattttcacttctacaattgcacagaaatgtctctgataaaagttcccagcatacattttggaactgatattacttgatctcacttcatggtaacaatatgctgctgatggaagtaccacagaactcacaaaaagcttttacttctccagggaatttcatcatgtctgtctagacccaacaaagccaaaccctgaacaatggccatttcagcctccatttgacccaagccaacttatattgaataaactaatgctttaaaaattataatgagccaggcatggtggctcatgcctgtaatcccagcattttaggaggccgaggcgggtggatctctagaggtcaggagttcaagaccagcctggccaacatggtgaaactgtatctctactaaaaatacaaaaattagctgggcgtggtggcacccacctgtaatcccagctagtcgagaggctgaggtgggaaaatcgcttgaacccgggaggcagaggttgcagtgagctgagatcacaccactgcactccagtctgagtgacagagcaagactgtctccaaaaataataataaataaataatgaaattcaattgataatgatggaaatcaaccaataaacctacaatactttaagattctttttaaaagaaaacaatatatttttattagaaaaagtaaaggatttattcataataagtaaatcttggtttcagagctcttaatttactgattgactgtgatcagatgccagtgggaatgtgtctgtagcaccattactcacatgagggagtattttaaccctttatatatacatcactaatagtggaaccttgaagaagtccatttctcaatattgatataaattataatttatattgacacactagttttttttcccataagttttatattgaatccaagaaagctttatcagtgtctgacaccaagaaatatgctttaaccgtaatgtatttggaatgtccacagtatattccacggtgtgtgaatctttagctttagaaattagctttgacaagggagaggtcctgaattatccaacaacaaaattgaattattgtataagatgtagcgcccatacctgcagggcatgtgaagctcagtgattggataataagacttttactaatgttatggaacctgggataagcattgcgatagaaccaggaagactgttgtagttcttttatgactcagaaacagtatgatgacttacaactaaaactttgttcatacaaggccagcactcttctaatgatgcaatatgcatttgatttatccattgttactattgtccacatgaaaagcaaaaattgacataatgtttatgatttaaataatgtaatatataattataatagtaataaaagcatatataataatgtttatattatgattacgttaggtggggtttccttcttttcccttcaaagctggataaaattgaattatatagccaataacatgccctgtgcaagtctaatactctcttgaaaagtgaaatctctcaggtaagccaaagtttcattgtcacctctggctaaaaatttctacttctagtacgtgtgagatttttttttttttttttttttttgagactgagtcttgctctatcacccaggctggagtgcagtggcatgatctcggctcactgcaacctccacctcccgggttcaagcgatttttgtgcttcagcctcccaagtagctgggattatgggcgccagctaccatgcccagctaatttttgtatttttagtagagatggggtttcaccatgttggccaggctggtctcaaactcctgacctcaagtgatctgccccactcccccaccgaaaatgctgggattacaggtgtgagtcactgtgcctggctgaggattccttttttaaaagtttctacagtgttggaaaataatcaggagagtcaggcaatgtgaaggaactactcagatgtcactggccatctggttaagaagcacagtgatgccatcttgttctaggatggcggcagtagggatggagagaacgttgaggagccattctaattcttcccattaccgtgttttatttttgtaatagcaatgatcactttctgcaattatattatttctgtgtatgtttgggtattttttatttatctactttattttcatcttccaccatgaaaatataagatcgaaatggcagagtaaagatgtgctttgtcttgtacactatatcaacagaactttgacattgctgacagacagttgatgcacattaaatatttgatgaataagtggatgaattaatgaatggaaatagagcaatagggttcgctctagggtagtgtggtatcatgcaagtgggtgtgtaaattgggagagacctgagcatgtttaaatatactggggaattatgtggttggaacaataaattaaatattgagatactcaagcaagatgtcatgggacctaatacaggagataagactatgtgattcgcattaaacactcatgtagcatgtttatacgagatcttcagacttgctatataattattcagcactcaaggtggtgcttaggaaaattgaggaactaaagactcctttgtgttacctgatctgtagaaataatttaaaaccttgtctagttttctttttttttctcctgtcataagcttgttaagagattcctccatagaaactttttttggtaaaataataactgctgttcagtgcatcatttctaacaatgtgatgttagctacaaatatttaggtagcacatcccttcaaaataggcgcttgtggcctgggcgcagtggctcacgcctgcaatcccagcactttgggaggccgaggcaggcggatcacaaggtcaggagatggagaccatcctggctaacacggtgaaaccccgtctctactaaaaatacaaaaaatttgccgggcggggtgtcgggcgggcgcctgtagtcccagctactccggaggctgaggcaggagaatggcgtgaacccaggaggcggagcttgcagtgaaccgagattgcgccactgcactccagcctgggggacagagcgagactccgactcaacaacaacaacaacaaaaaataggtgcttgcgataacttggagtgctgttcttactgatgctttcactttggtagctcacctctcctacgggaactgtgttctcagacatgtcatggggagtatgtcatcagcacagcttcattggtagagtttactaaaaatacaagttatctgtattttccttataaaggccttcgtatagcgtccaatattttctaaccagatgtacagtgaaaatgattgatgcttaaatacattttcatggtcaatgcaacaaccgttgagcaaaaaaattaacatttattgcagacactaggcagttgtcaaacaatattaatgtcattaaatcaataaatgggcacagaataatggaagcaaggtcatggatgaacagatggcagtgtaatggagtcaatcttttactgatttaaccactctcctcttatttctaatgtcccttccatcacgatgagttctctttgggatgatgtgtatctaactgaagctcctcctcaacagctgctgagaattgagtgttggtggtaattatccatatgatttttaatcagacacttttcacagattcaagtggaatgataactctatgggaaattgataggacagccagagttatgcaaattttggaaaaaaaattaatcaacagctaatacaaatattatgtctaaaggctaacaactggatgatcataataactcaatggctaataaataaactagggaaatccaagccagaattagaagtaaaaattggccattatataattatgaccaagaagttctttcttagttaacaaggggtacagctgtatgtttatttcaaagtaatttttttgtctgcagttacaatgttgaatgaaaggctaaaacaattccttccttagccctttccctttgatgtgaaaaattaactctcagtaccctcagtaactttgaatatgctttttatacccttaaagacaaaaataaagtcatcattttttcattgactgtaactattaatactatattcatgttactgtagctttaactgatgactcatttttagaacatattatcattgatctatggcaaatgcttttaaaattcctcagaagctaatcatttatgttgaaaactcacaaaactgcacataatataatagataaagggagggcataatgaagttttcatttgacttatctgggttttgggatttacccccttacagtatgtgagcctatgaataagtaggtgagcttccagtgctcaaaggtttaatgtacagtgtatttatttttaatctttgtgaattttctatagagcagagctgtttccagtgaattaaaccatatttacttctactacaatattgtagaatgtaattgttacctttactatatatatatattttttcttttttatttatttatttatttatttatttatttattttgaaaatgaatcttgctcggtcacccaggctagagtgcagtggtgtgatctcggctcactgcaaactccacctcccgggttcaagcaattctcctgcctcagcctccaagtagctgagattacaggcacatgcaaccatgccaactaattttgtatttttagtagagatggggtttcgtcatgttggccaggctggtatcaaactcttgacctcaggtgatccacctgcttcggcctcccaaagtgctgggattacagacatgagccacctcacctggccccctttactatatttaaagatgacattgtcatgtgatgtgtatgatgaaaagtatatcattgaactctattctcatatgaaagaacatctgattttctagaagatttatctgccccaggtatattcctgtgagaataatacaaaccaaattaaaatgaagtctgcttttttttttctattccttattgagattgaattcagaattccaaacaggtttgctattcattttcatcctgacaaaatcaaaacctaaatattctatgtgtcacctactgtgatgggaaagataaaactaattatttaattatcaaacatgagtaggtgaattatttttattaatcaacattacataaacgtgttttgagaataaaattttttatcctcattttttaaccaaagacataaaatataactgacattctgtagccaaatcaatgatatatacacccagattgacctttaagagtttaaaaataaatgtacgctgcatggtcaaatggatttggagatacataggctagtagatgaagcactagggctttatgaaaccttttttgagggccggtgctgtggctcaagcctataatcccagcagtttgggaggcccaagcaggcagaccacttgaggtgagaagttcgagactagcttggccaacgtggcaaaacatctttactaaaaatacaaaattagccaggcatggtggtgcacacctgtcatcccagctatttgggaggctgaggcatgagaatcacttgaacacgggaagtggagactgcagtcagctgagattgtgccactgcactgcagcctgggcaacagagtgatactccacctcaaaaaaaaaaaaagaaggttttttttttgagttagtgatacacgttaataaattaatccagagatttaaaaaccacttttactttccatgttaaaaaaaatcagcatactttccaactataacctaaaaatctacaaaaaactttccaaattctcagtaaaggaagtattgcaatccacaggagattattgctttgttctaaagacagttgaaacattttcgaatctctgacattttttagatcaccctttgcagggtggggttcacagaacattttttttcctgatcatatgacattgcctacataattttgtgattaaatgactttggaaaatcaggattgagacaagtaaacagtcctatcagaactaaatatgttaatgtatggcgtccccaaggggtgtgatatgcagcattaactcttaaatgtagataatcatgggactttaataagcagatacactttgtgaattactactttaaatattggtagtaatagattgcttaatcgaacttaaatttaaagagatgatgttggacttctagtgaatggaagccaagtatttctatttactagaaaaatgtacatgatctattgtccacagtgaactagcaaaccttccatcttgatatttagttttcatattaattgtattatatttcatcagcttacattttttactcactagggcatacttttatttttttcattgcaatagcttattcaatatctgcctattcatatattaagtaataattttttttaacctgcatctcacacagagaaatcatgaggaaatctccactcattctggtcagcatcacagttgcagtatgttgcaggattcctgggagtcgatatgattttttctaatacacacatatgtttctcagcattgggcaaataacctctccggtaactgtgcgcttttctggttcttcccacctaccagctcaacagggtatcatctgaaaaaagaatatgagaaaggcgagtcctatttaacccaactactcaccccctaatgcggttccgcttccgctcagataataacgtaaaaacagttttttggtgtgtgtgggttttttgttttttttgtttgtttgtttgtttgtttgggacagagtcttgctctgttgcccaggctggagtgcagtggcgtgatctcggctcactgcaagctctgcctcccgggttcacgccattctcctgcctcagcctcctcaagtagctgggactacgggcacccgccaccacgcccggctagttttttgtatttttagtagagacggggtttcaccgtgttcgccaggatggtctcgatctcctgaccttgtgatctgcccgcctcggcctcccaaagtgctgggattacaggtgcgagccactgcacctggccaaaagaaacagttttaagaaaataagtccaaaccctgcaacagaacatttctttaagaatactaaccagcttttttttttttaattaaaaaatatttacggctgggcgcggtggctcatgcctgtaataccagcactttgggaggctgaggcgggcagatcacgaggtcaggagatcaagaccatcctggccaacacggtgaaaccccgtctttactaaaaatacaaaaaaattagccgggcgtggtcgtgggctcatgtagtcccagttcacaggaggctgaggcaggagaatggtgtgaactcgggaggcggagcttacagtgaaacgagatggcgccaccgcactccagcctgggggacagagcgagactctgtctcaaaaaaagataaaataaaataaagagactttaatatgttcagtaattacacaaaattaattatcttgagcaggccagttacataatttcttttgtttttgttttctctttctttctttctttctttttttttttttacacagagtcttgctttgtcacccaggctggagtgcggtggcgtgatcttggctcactgcagcctctgccacctgaattcaagagattctcctgtctcagtctcccaagtagctagtactacaggtgcattccaccccacctggctaattttgtgtttttagtagagatgggatgtcaccatgttggccagggtgatcttgaactcttaacctctggtgatcctcctgccttggcctcccaaaatgctgggattacaggcataagccaccacgcccggccctgtaatttcttgaaaacaattttcaaagattgttttcataaaaataagtagcagctatgtagagattgaagctaaaatctgtttgagaccatggagtgcctatctaaaaccctaatgtcatgaggagatatgatttctgttattgcatttattagataaaactcccagctgcatattaaacatttagcgtgacatggttctacttctttgcattatcggagctcagagcacagtaccccaaagtatggtgccttggcatgtgtggattgttgcactaaaggagacaggaggggtttagaagcaagtagttctctttggccttctcccatccttctgtctcctgaaacaagccataaaatctagaaaggttatcttttacctacctcccctgagagctcataagaccctcattccagaggagtcctgccccttacctggagaaaggaatgctacacatgaaaccgtcattgtaaaattataactgaggcagtgaaagagatctgacctaaccaactccatcttgcttctaacttccaagctgtccttcgtcattccttggcgtaggctgaactaactttggaaggaacttagtttataatttatagtttaaaatgaacataatgacagctctttcccaaaacaaatccctttcttgcttagggactagactgcctttgtaggactaacaaactagtcacaagattagaaattatggtttaggagtcatgcagctggaggctacgaggttctttccagattgctccaggggataacatcactactgtaaagcctaagaccagctcttgagatattttgcagacactgcacttgatggatcagcagccatcaccccgatcgataaactggctcatctgatattgtggccccactcaggaactgactcagcacaagaggatagctttgactccctatgacctgaccaatccgcacacccaactcactgccccccaccagttcacaaattatccttaaaaactctgatctccaaatgctccaggagactaatttgagcaataataaaacttcagtctcccacacagctggttctgtgtgtattacactttctctgttgcaattcccctgtcttgataaatcagctctgtctaggcagggggcaagatgaacccattgggcggttacacacagagagaccaagaagaatcagaacaaacaggccttgctgggctctgctcagtttattaccattagatcatatccattttgtccagttacgttgctccacaactattcacttctttcatcagatttaacataaaaatacagtttccccctgggtgtttgggtcttcatttctgaagcctcctgtgtcaagtaaaactttgattaaatacctttgttatgcttttctcttgttaacctgtcttttgttttgggggttttgggctgtaaaccttgtggcgggtgaagaaaagataggacttttctcccctagagtattttaaaagtcttgcggaggcatgtgcttatgtcaaagatgtctggaggcatggcttgactgttcattcaaagacaaagaaacaacactcatggactttcctgcctggaggaaatgtcacccttggccacacagcttctcagagctacgttcacgtccaccagcggcactgataactgactcctcagcaccgtccagcgaatgctgcatggaggctcgcaggcaccccagcttagaaaggaggagcagaaggtaaatacctacctagtacacaggaaatcaaagagcaaagcttaagaagtgggcttaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaaataagtgggcttagactcatcaactcctcaaaaatactcagccacttttatgttttcttccccaaccccaagctctcatcctgaggtcctgactgaatctggagcatgtttcagtatctccctaacttacaagcgccactgctcattaaggctccctgttagatgagacctctgctgcaacagtctctctgcttgtaaacatcactgcatatatcaccacccaccccagcccagcagggaaaggaaaacaacaacaacaaataaaatgcaattctaggaatagtgagatatgcaagaaggcatcagtattaaactttctgttttgttttgtttgagactgagttttgctcttgttgcccaggctggagtgcaatggtaagatctcggcttactgcaacctctgcctcccgggttcaagcgattctcctgcctcagcctccgaagtagctgggattacaggcgtgtgccaccatgcctggctaatttttttttttttttttttttttagtagagatggggtttcaccatgttggtcaggctggtctctaactcctgacctcaaatgatccactcaccttggcctcccaaagtactgaggttacaggtgtgagccatcgcacccggccagtattaaacatttttttaaaaatcatgttgaaacttaaaactaggtagtagaaagtacgtaaaacaattaatagatggttttcaaataccactttcaacttaattactagtcattatattttctcttcagagattgaagagccaagacatcattacacctaaatgcaaaattgtgtgtttacatccaaatctctcatctttcttataaaataggaaataaaattttaaagataccaaatgtgtttagaaccattgaagatagtttaaatattgttaaacatttaggggactataacaaaaagttttgttttgttttttttttaaacgagacggagtcttgctctgtcacccaggctggagtgcagtggcgcgatctctgctcactgcaagctccgcctcctgggttcacgccattctcctgcctcagcctcccgagtagctgggactacaggcgcccgccaccatgccccggtaattttttgtatttttagtagagacggggtttcaccgtgttagccaggagggtctcgatttcctgacctcatgatccgcccgcctcggcctcccaaagtgctgggattaaggcgtgagccactgcgcccggccaagaaaaagttttttaaaaattagtgaaaatattagactctgaagaatagaaataataaataagaaaaatgtaaatgactttctcaacaactttagccactgactcccatcctcctctgtgccctcaaattcaattttcagtgaatttcgcaggccaggagtcatcattcccgttgctgacagctcagctcctcagcctgggagtatccatttttgaacatgcattttttattgtacttgcttttttaacaactcacattcatggtttcattttagaatatccatggtgtaaacaacacattacttcgtgcaatggagacaatattgcttgattgattttgtattactcaaaaaaaaaaaaggcgagaaaagaacttttatctgaggaatgtgagtccttttaaataatgaggcccagagagacattaaaatgaggcagcagtcaaatcctactccccgctttgagctaggtattcatctcctgaaactgcttattgccacaagtagctataaattaacttaataatgccagagcaaacgctataacccacaccctgtagcttaataatgtatagccaatcgctaatcaatgttatttctataaatcaataagaatgcctgacaaacaactttgtatcagccatgccttctcccccttttttgccttcaaaaatctgtttgtaacaaaggccaaactcatatccaaggttacatgggtccgagtcctcctgacagctgtcttcactttggctcagtaaactctttaaattatagagtttgtgtctcagcctcttccttttaggtcgacaaaatgatagagctttggaggtcaatatttatcaaaactgccatctttgggaaatcttctgcataaaagagctggatgtaattgagccagatgctgctttattccacagcactgcaaaatattaccctccctttcaactctaccccaattgaaagcttctggaaatactaagtctctcgtggatatttgtgtacattaacttttaaaagaaattctcgaatggcagctttgctgtggcagctgtcaggcatgcatatgaggaaatgtgttgtaagtgcacagataaggaattacctgatgtttctgtagacagattttcaaactcataattcttttcatgttcatcatcttctccccaaattaaaaaaaattatcgtctatatatttatcttttcagctagggttttcctcatctctatatgcatttctctcattttcaaatatatttttaggacgcgcatgttcagatcatgtggactatatgttatcataacttttgttaaataaaaatatattatccagtatcagctcctcaaacaaaatgactttgggtccataatggctactgaaatgtcaactgacaaaaattcaaatatatttctggcacatcgattatttacttcttttgtatttaaaaatgaaatacaacctgcccaattgtgtaacaggcaaaagcattcttagatcttttacccctctaagaccaaatgcccaactggagcatttatgctgtttgtgcagcattgcccagctgcagagaagcccaaggctcagagggtaagaagtgactggaagttgtcttgctacgtatgtggtgcaggttctttaacttacataaaaatatatttgataagatggtcaatttgcatgagtatttacccaatcagagggtgcagggaacagttatatggagatttttttttaagctattacatttacatcatttagaaatcaaaacaagataagttacctaccaagggtaccttccccatttctacgcccatcatagggagctgagaatggcctgactaataaatttgcattagaattaacaaccacagggatggcatactttacaacagcaacccagggacaaggaaaggggagaggatgttaccaagcctagggaaacaactcaggctcatggtgaacagggagggaaactgatagtgtctaactaacacaattttaaattcagtaagaaaatggtttgttagatcatgtagctcacttactcgccattgaaaaatgctgtgagtgtttccatggaaatctgaattcaaaagatctttcctttaatcatattctgagatttacacggaaaatatctaaaataggctttctttttccttgaacattatctactctatattcaccctcaggggtttttctctcaaatgaatcaaatataaagagaaccttgtagaatactgagttgggttgtggagttgacttatcaagtgctatttttctcattctcatcacagctcatagcgtgttgggaaaaaaaaagatgcctgaatagctcatatgggcaggtggtcagtataattgatttccagttatgtatggttaaaatttaataatagaaaaaacatcctccgtaaagggaagtattgagaatacatctataaaatgttttcttaagagtagaataagttaatctgtggataataggtgtgtgtgtgtgtgtgtgtgtgtgtgtgtgagaataatccctctaagtcacagatttttacaatactaatatttgaaacacccaagcacgggcacagacaattatgttatgtttccctaattgtccatagcttatcttcaaagaatgaaagaatgttagagatggagggaagaaacagcttaaggaattataagtaacctgcaaaacagaaaagtatatagctgatgttcaccacctttgaatcatgaatagacttgggagactaattttaagaatggcaaaatgttgagacagtttctgtgatgtggtggagtaagacacttcagaacgtgtttgctctgactcactggagcttgtctggcatcaaaaagggtgattcttaattgaccctttgtccaccctgtcaagagcggtcaaaagaacacacaatttagcaggttaaactattttaatttcatcatttaatgggacttcacagtataaataataaaatttactagatgtcatatgaaaccccatgtttcagttcatttgccatattacagcaattttgcaatattgcaactttttcctagtttttataatttcctataaaatgtcttctataatccatctatgtgatttctaagggaaaaagtgatcttatgtaaaaggaaaataaccttggattttcacattagataggaatgtactcattcccacgtctcctggaggaaaaaaataaagaccctgtcaagaaaacattgacagtactataattagtgagtccatcattcatgatttggaaattgacctctaagaaagtggagaaaaaaccccctgtctcacagaaggcaaaaatcatttccatttatgtcaaaataccatcctttaagaagaaatggagggcactgattctgatgagaaaggggaatgcaagtcatgaaggaattgtgaaataaacacacagagaggatctatcctgtcattttatctctaaataaagaactgatcgatgtcttggactcatgttgatgagtagtgagggatggatgtaacactagcgtctgtgcccagatacacgaggataaacgacgtgctacttcatgactctgaggatttgctgccaagatggatatttaaagtgcagaaattcttccacaatattgctgcccttacagagacagggcattggttaggccctgtattttatccaggctaaccccctcatcatacagatgaggaaaatgagtcctggaaaaattatgatgacagaactggtgaactctgacacttcgggttttgaccttggctaaattcttagattttgcccaagaacacactctaaggtttctcgctgtagtttgactgttttgttctgaggattttggaaatagtatctcctgacaggatttctgtgttttttgctgctcaactggctctgaaatttctgaacatgccttatgcagtttcaacattcttctgtaatctctgctgaaacatttttgtacctatattttatatcgatactttcagtgtgtgtgtgtgtgtgtgtatgtatgttctaggacccacttgagaaagattacccagtcaaagttcatataaatgctgcatattgttaggtattgaataagtatttggtatctctttatgttatgaggaagtaaacagtgtatctgcgtttaaatatgaagacagggttacagtggaagcatgatgctatcatctagtgacactcatcttgcagtatcatatttttactagttaagtgttctttattttaagtaggaggtacaggattctgaagcatagtgtaaaagattggaaaaggtttcacagggaaacctgtgggtatgaatcatacatgctgtggaaaccaaggatcttctcaaagtcatagttactggacttcatatgaagccctgtgattaaagaagcaagtcagcttagtaatagccaatattgactgaaaatctgaagggcatttgtttaacctccttaaatagttgttatccaacaaatctgctaaaaaatagttttcaattatttagtacttactgtctttgttcacttaaacacaacttgcaaataagaagtagttattgcaaaaggtagaaatgatcatccaatgtgcaattccttgtcatgaaaaccctccaaggctggtttaaaacagaaacttccttaaatgttctgcaaataaaaattcaagataattaaaatccagaacaaaggagaaaatatttacataaaacacacttctacagtattttaatttattctgaatcatcattgaatagaatattttaatttgttcaagtaaatattttactgtgttcatgataggggcttagtatctgcaagtgatgggccttgttaatcttcagaataagtttaaatgacagctcagcagggcagtgtctcccatgcagcagcccctgtggagcagcaggaaggaaggctccggaggaagctgcaggaagctgatggctcctgtgagaaactgcctggctgatgctgtcacggtgttgaccctctccctaagagccctgagatcacacttgccctttttacatcacccaacaggactgacttaacatccagggaggacaaataaaggggaagaataaaataatccaacaaaaccaggacagaatgcactcatgtcattaatggagctacattcttactttgaatgaattacctacattatgttaccttcctaaagacttactgaaaaaaaggtgttcaaggaactaagggaaacccagggtggcacttgaggttgcgggtcacagaccacactctgcgtagccctgaggctgggtgcagggccaggctgcctgtgtgcagatctcctggccgtgtgttagaggttgaacgatgcatctctcagaattcaaatgttgaatttttatcttatttttatttatttagtttttttgagacagagtctcactctgtcacccagactggagtgcagtggccctatctcagctcactgcaacttccaactgctgggttgaagtgattctcttgcctcagcctcctgagtagctgggattacaggcgcctgacaccatgcccagctaatttttgtacctttagtagagatgggtttttgccatgttggtcaggcttgtctcaaactcctgacctcaggtgatccgcctgcctcagcctcccaaagtgctaggattacaggtgtgagccaccatgcccagcccatatgttgaatttttaaacactgagtactgcagaacccaggaattatttggatttagggtctttacatgggagttaaaatgaggttgttgcgaagggaccctaatccaatttgactaatatccttgtaaaaagggaaatttggagacagacacacgtagagggaagatgatgtgaagagatcaaagaagaagacaggtgtctacaaaaccaggaaagaggcctggaatagatgcttcgttcatagccttcagaaggagccaaccctgctggcaccttagtgttagacttctatcctccagaaccatcagacaaaaaatgcccattgtttaagtcacccagtgtgtggctctttgttatgatgtctctagcaaactaatataccttgtgactttggcagttctgtcttcctgcctctgtaaaatgcaaatattactgatatattgcctcctagggcttctgtgaagaggcgatgagttaatacatgcaaagtgctacaatagtgcagacataatattaatactcagtaaatgttaagatgattattaacatcaacatcatcatcaccactgtataaaaaaaagaaaattggggctgatatctgatctctacaactttaccgtgcagcatccctgtccattgctttttctaaattctattattaaccttgagtgtcttgtaattgatcatgtttcaacctttctttgacagcaagtactctcagaaataaaagtattactcggaccaagcaattgaacaacatattcatgcatttatgttcatgtagaaataccaattatacacgttttattttattttattcatgactctattttgtatcttatacttatttccccattgaaatgaggtgaattaaaaataaaaactttataaattaattagctgcaaaaatacttatttttgtttgtttttccaaatggttgcaacttacatagtgtaaaatacaattcatgaaagtggaaagatgcagaaatcagaatggaaatgagaaccagcaacctgagagtcccacagaaatattcagtcacatctgtgtaaccaggggctgtacagtcttaggtggaggtattccagatttttgtttcttagtttctgtcagatgtaaaatgtgtatgtggaactattgtgcactttctttgtttggtagagacagtctctctgtgttgcccaggctagtctcaaattcctagcctcaagtgatcctcccacctcagcctctcaaagtgctggtactacaggtgtgagccaccatccccagcctactgtgcattttctattatttgaagcaaaattggggccacaaagaaggtcatctgtagtatgccaataacataaacctctgacatttcagtaaaatattgcctttgcctctgcatagtatgccagcatgttctgcagggtgggcagccgcaagcagtggttagaacaggggctctagaaccagggcctgaacctgaggctgtgctctgctctccttaatagtgaaatcagaggcaagttgcttgacctttctgctttgtgtttctgcttttgccagatgcacaatatctggtttgtggagttttttgaggaccaagggagatagtgattcctatcaaatgtttaccagagcctctgataatctgggttttcttcctccacttccttcccctccttccttcttcaagatgattctatttaatggcatgttggaaatcatgtcagcagtcatgacatgccaaggtaaaatgaaacttttttccttaaaagtaggagaatgaggtaagagatgattttagaagttaaagcctacccaaacataaaaggatatgatttgtgtcactgtcatctaaagtgtctactgctacattttccatggggctgaagttttgattaaaaagaataatgtcgtatcccaggtgtatccctaaattggtaactacttccgaaagtcttttttaagcttgtacttaaatgacttttttttaaggataatagttttgtattataaaagataaatgcacaaagcagctacatgtaaaatgccactttaggacacgctgttctaacacaaatactgtcaacatatcatttgtgagtgaactgacaagatgtccaaggaatgagttacagtggagaaaattcaacgtgcatcacagaatagttaccagctcctggccctccacagatgtggacctaaaaccacctggagggcagagtcggctccctcccgctgtgagtgcttcctagtgagccagcagctgaaggcctccctagcttcacttctccagagcgggcatggagataactagtgaaagtggtcacaaagtcggggccaagaagtctctaacccctaaatcaagattgagagatactggaccgggcacagtgtctcacacctgtaatcccagcactttgggaggcctaggcaggcggatcacctgaggtcaggaattcaagaccagcctggccaacatggtgaaacccagtctctactagaaaatacaaacaaatttagctgggtgtggtggcaggctcctgtaatcccagctactctagaggctgaagcaggaagaattgcttgagccccggaggcggaggttgcagtgaacccggatcgtgccactgcaccccagactgggcaacagagcgagactcagtctcaaaaaaaaaaaaaaaagaaaaagaaaaagaaaaaaagattgagagatactggagaaattcttcctttatgcatccctcatccttgcatcaattttttcctacaaatcaatggagtgtacacatatggggcattatttcacgttaaaggaactaagtccatatacatgatttgttttttgagaggtgaggtctcactttgttgccaaggctggagtgtagtggtgtgatcagacctcactgcggcctacacctcccaggttcagatgatcctcccacctcagccaccctagtaattgggaccacaggcgtgccactgtgactggcaaatttttacatttttttgtagaaatgttgtccaggttggttttgaactcctgggctcaagtgatcctctccccttgagctcccgatgtgcaaggattacagctgtgagccactgggcttggccaagtagaaattatatcctgctattagttgaccaaacatgattcataaactataactagtatggccgccattaatctaaaaattaatttttagattaatgtttattgacagtatctactctataaaatacaaaaataaaatatgcttttatgatgtggaccatagtatccataagattgcttttctgtttgaattggctataaaaatggaaaaagtatcattttgtaactgtgtggcatttgttcatttattcaacaataataccagagcggaaagcaacaagttaggtgtgacataatatagaaatggttttgttttgtttgtttgttctacatatattattagtaaggtttctctagagtactgtctctctctatctctctttctatctctgtctacacatagacacacacacacacacacacacacacacacacacacacacagatgttcctcaacttacaatggggttatgtcacaataaacccatcataagtttgttacaggaaagaggtccagatccagaccccaagagagggttcttggatcttgtgcaagaaagaattcagggcgagttcacagtgcaaagtgaaagtaagtttattaagaaagtaaaggaataaaagaatggttactccatagaaagagcagccccaagggctgctgattgcgcctttttttttttttttttttgagatggagtcttgctctgttgcccagcctgaagtgcagtggcactatctaggctcactgcaacctccccttccagggctcaagtgattctcctgcctcagcctcctgagcagctgggattacaggcgtgcaccaccaggcctggctaatttttgtatttttagtagagacagggtttcaccatattggtcaggctggtctcaaactcccgaccttgtgatccacccgcctcggcctctgaaagtgctgggattacaggcgtgagccaccacacccggccggttgcccatttttatggttatttcttgagatttgccaaacaaggggtggattattcatccctccccttttagaccatatagggcaactttctgacgttgccatggcatctgtaaactgtcatggtgctggtgggagagtagcagtgaggacaaccagagtcactctcatcaccattttggtttgggtgggttttggctggttgctttactgcaacctgttttatcagcaaggtctttatgatctgtattttgtgctgacctcctatctcattctatgacttagaatgccttaaccatctgggaatgcagcccaggagatttcagcctcattttacccagctcctatttaagatggagttgctctggttcacttgtctctgacaagttgaaaatgcatttaatacacctaacctactggacctcatagcttagcttagcctaccttaaatgtgctcagaacacttacattagcatacatttagcctacggttgggccaaatcatctaacacaaagcctattttataatgaagtgttgaatatttaatgtaacttattaaatactatgttgaaagtaaaaaacaaaatgcaatctttattattttagctaaagtaattgtcaatttattaaataaaaacaaaacagcccacaccatcattagctgaaaaatcgttttgaaccattgtaagttggggactgtctaaagaattgtgaattggctcaagtaatgacagaagctgattagtatggaaatttgaagtcagcaagctggagacccagcagaggtaaggtatagtccaaaagcttgcagccttgaggctcaagaagagccaatgttttcgttcatttaagaaggtaggaaaagaccaatgtcccagttcacacagtcaggcaaaaggagctccccagtactcatgggagggtcagctgtttcgttctattcaggcctcccaccaagaggatgaggtccatccatactggggagtgcagtgggcttcactcagctagagattcaaatgttaatctcattcagaaaacaccctcacagacacacagaataatgtttgaccaaatatctgagccaccctgtggcccagtcaaactgatagtttttccttaggttatctccagtgtcatttaaatattaatatttatagtatattatatattgatgtaaatattaacatttattacccaggggttgtgttctcttgataatgttctatttttttaatctctgtgaaaaaatgttttatgaagtgtggaatttatctactacactgacatattctgcattaatctttctctattttgtggttgtcaatcactggtacagtttcagagagcaggaaataaagattcagcctttaactcctacacaatccacagtgtttttttcccctcagaactgtcataaaactgttgtattttatttagatttttaaattaacaactaaagccatattctagtaatactttaataatctagatttcctatttttggagtagaaggctgtatcatatttaaaatcactgcagagactttgaggttttcaaattaatatcatattaaaaatttttgcactctgaaggctttcatttattgctttaaaaaaatgttgaaactcagagttcaaatgattttaaaaactctacatctagatacagttaatgtaaactttgtatatctctgtaatgactttcactgcccctcattatcaatcaagagcattgagataaggactggaaaatattaaatatatatgttaatatttatataaacatattaaatgtgtgtgtgtgtcacacatacacacacagagcaagagaaagagcaagagagggacagtaactgtcttcagaatatcaaaagttctgctaatcggctcttttgcagaagcttgtcctcactctccgcataggggaaagagaatgagctttaagacagaacttcctgctgaattaattaaatatatccattactactgacagaatcagtgaggttaagcccctctgaagaggacaagataaattgtcactattatggcactagaaatgagatactgggatacgatttcattaccgtattatcataggtttacttaattggcaaagtttcacttaagaaggatgcagaaattctgaacacaagttagcatttctagcacgatggtacaagatgtgttattgaataagtcaaagatgccataaacgcaaatttcaaggaatggcataaggccggggtggtggctcacacctgtaaccctagcactttgggaagctgaggcaggtggatcacctaaggtcagaagttcgagaccagcctgactaacgtggtgaaaccccgtctctactaaaaatacaaaattagctgggcctggtggtgggtgcctgtagtcccagctacaagggaggctgaggcaggagaatcgcttaaacccgggaggcagaggttacagtgagccaagatcgcaccactgcactccagcctgagcaacaagagtgagactctgtctaaataaataaataagtataaaaggatggcacgaatgcaaaactcggtgcacagtgcgctgcagtgccgcctgctgtctgatggaaacatcacaaagacacaagcacagactaagaaaaaaagttttaaaagtcaaagggataggtaagtaaaaaattgaatgcaatatgtaggaaatgctgctttcttatttttatttttattttttatttatttatttatttatttttgagacagagtctctctctgtcgcccaggccagagtgcagtggtgcgatctcggctcactgcaagctctgcctcccgggttcacaccattctcctccctcagcctcccagaaatgctgctttttaaaagtggccactcttatgctaataaagtcatccatgagacaagaacgtgcttaaaatataatagcgcatactgaaagcaatactgctttgtccaagtcagtcccattagtcctggcatgatttctgtagcactcctttcaaataaagaatgtcccaatttgaatgaagaaaactatataatcatcctaatcatgatagcaagattaagtcatcatttgtagtaaaatcttacaacagattgtgactggctgtgtagtgacaaaataattggaaagtggcaaataaaactggtcatagagggtcttagactatatttgttgccttgaagacatgatgggagaattaaacttaataaatgacctcatcctagatgaaatatccttcttagaccaaatatttctgcaaggtatggattgaatcttcataccaagtccaacgaatttttgtcctgctggaaactaattgagaaggaaattaacaggaattaaggtgagatgaacaaggtgagttgcaaaagtgcaggctcagatcctgctaaattttaatatttgctcatggtgacttttttgcattaattttaatatttttaaataatgtattaaaacattatttattttgattgctaagttttgtgcttacccatttaattgtgttcctaaggggagtacctcacttacctcaccttgtaacagattctatacaaggtatacctgggattagatataaagaacaatgaagtcagaactgtgatatgggggtttccactccagctacctgaaactgaggttgccctatcttagtgagttcaaagctggagattctgtaaatagacacggggactgtgaggtccctgcacaaacaggtcatatctgtaaattaaactttgtgattataataattttttttttgagatagagtcttgctctgtcacccaggctggagtgcagtggtgcaatctcagctcacagcaacctccacctgctgggttcaagcaattctcctgcctcagcctccagagtagctgcgattacaggtgcacaccaccacacccggctaattttttaatttttactagagatggggttttgccatgttggccaagctggtcttgaactcctgacctcaggtgatctgcccgccttggctttgagaacaagaacaccatgtctgctggtgtgttagtcgattttgtgttgctataaagaaatatgtgaggctggataatttataaagaaaagaggtttatttggttcacagttctgcaggctgtacaaaaagtgtaatgacagtatcagcttttgctgaggccacaggaagcttacaatcattgcagaaggcaaagtgggagctggtgtatgacatggtaagagagggaacaagagagatgccagactcatttatttatttatttatttatttatttatttatttatttgagacagagtctcactctgtagccccagctggagtgcagtggtgcgatcttggctcactgcaacctctgcctccaaggctcaagcaattcttgtgcctcagcctcccgtgtagctgggactacaggtgcactccaccaggcctggctacttttttgtattttagtagaggtgagctttcaccatgttgcccagggtggtctcgaactcctaagatcaatcaatccgccggcctcagcctctcaaagtgctgggattacagccgtgagccactgtacccggcctagactcctttaaacaaccagcttttgcatgaactaatgcagggaggacttattcgttactatgaggaaggcatcaaaccattcatgaggtctccacccccatgacccaaacacctcccaccagggcctacctccaacatgggaatcacatcttaacatgagatttggaaagaacaaacatccaaactatatatatatatatatatatatttttttttttttttttttttttttttgagatggagtcttgcactctcgcccaggctggagggcagtggcacgatctcggctcactgcaagctccgcctcccgggtttacgccattctcctgcctcagcctcccgagtagctgggactacaggcgccagccaccatgcccggctaatttttgtatttttagtagagatggggtttcaccatgttagccaggatggtctcgatcttctgaccttgtgatcagcccgcctcggcctcccaaagtgctgggaattacaggcgtgagccaccgcgcctggccatctaaactatatcagctggtggtttgccctaagcttttctcccctaagtttcttttttcagaaataaagtttgtctttatctgacgtcagcagattggtgtttgttttgcctgctgtattcctttagtttctaaaatagtccaaattcctcacccttccctgaaaatgttgctcttacgttgacataatgtctagtttcattcagcagttaatattataatatagtactcagattagagtttgcagctgttgtcgttaaatttaggtcattctaaatttacaagttagttgggaagaaaacaaccgcaaattctcaaccctcatcaccatttctgcctctcagtgctcatataaagtcactacagaaaaagaaggaatgcagcaattaaacaagctcatctgtaacacgattaatttttaactctttaattcacttgtttctcataggaaactacattaacatgacaggttgttttttttttgttttttttttttgagacggagtctctctcttctcccaggctggagtgcagtggcgccatctcggctcactgcaagctccgcctcccaggttcacgccattctcttgcctcagcctcctgaatagctgtaattacaggctcctgccaccacgcctggctaattttttgtatttttagtagagacggggtttcaccatgttagccaggatggtcttgatctcctgacctcgtgatccgcccgccttggcctcccaaagtgctgggattacaggcgtgagccaccgcatccagccatgacagtaatttttgaaaatgcattggcacagcaattcaagaagaggaaattggacccatggtctctaaaggacttcccagcaataatgtgctgggctgttcagaattatcactgagaaaaggctatgcccatgtgcacaactgacctgacctcatgtgcacatcagttcacctcaaccaccatcccgtctgctaaaataagtcacattggttgcctcccaaagttctctattcaaaccagtaaactcagttaaataggttgtgaataggaaaatccaaaagtcactgggaaaagatgttataaactaaaatattcatagaaactttttttatgaaagccaaaaaaggaaaaataaacaactaagatgcctaaaaaccaaaaaatggatgaataaaatgtggcagatgcattcagtggaatatcatatagcagtgaaaattaaggacattaattacatgtatcagcatgcctgaatctcaaaaactcaagttgaacaataatagcttttaaaaaatcacagagttaatatgtatgttccaagtctatgaagtcttcaaaaagaggaaaaacaggccaggcacagtggctcatgcctgtaatcccagcactttgggaggccgagatgggcggatcacgaggtcaggagatcaagaccatcctggctaacacggtgaaaccctgtttctactaaaaaaccaaaaaaattagccagacgtggtggcgggcgcctgtagtcccagctactcgggaggctgaggcaggagaatggcatgaactcgggaggtggagcttgcagtgagctgagattgcgccactgcactcccgcctaggcgacaaagcaagactccatctcaaaaaaaaaaaagggaaaaacaaaagagtatattcaaagaatcacaaacaaaaagtaaaggaatgataaacaaaatttaggatagcgtttaccttggggactaataaatatgggtaatgtttaatttattaagctaggagatgggcacatatattttcattcatagaactttttttcctaaatgtatgtgtatgatatatgtcacatgcatgacatatatgtgcatgacatgtgatatatatgtgaactacatatagttcacaaaaactaaatgtagatatggtatacaatcacacaaaagcacttaatgtatcaatgtgtctatatatacatttatgcctaacttatgacaataaatatactctcaaatacctggtcgtcattaaatctaatatgtagaatattaaaatatgaaagaggatgctgtatttgttattagtcatttttctccagtctattttcttttgcatcatttaataaattagtagagaactttcctcccattccttttagtgttttaaaatcttttaatttaaaaattatagctcttagataattgccttatatattgtttttaaattttgtttcctatgggttgctgtaaatctatcctaagtggcaaagttttaaaaacaatatgggtcaaaagtgcacaaagctctgaaaatgagaaaagaaaatgaccaaacctttaagattcctagcattattctgcctatcaccataatgtttgcttggagggaggcaggctatgaactgaacaacctaatttatggctgatgtgctctctggccattatgggcagaatgtgggcttcttcacagcagtggctctcagcatttctcttcatgttctatgggctacagcaagtcacatgaccaatcccaactccattgtgtcagggatgtataatcctcttacttggaggacagcaagtaattgggaacagtaatacaatttggcacacaaaacaaatcttcagagagtgtcagggtcaagagaagcatttgtccgagaaaaagttactctaaacttgcaaaaagataaaaatcataatgcttgattaaaaaaatactgaattattttctaattatttacttgaccctaacctgacaacatttataggagtgatatcaagtcagactatttacagactgtgagtctagaggtcagcagcaaaatttagaaattatcatgactctgtagcccagtggtttactgtcataaaagatatattttataatgaaatagaccaccaagtagaacaacagaccactgaaataaaccatcaaatgacatcctataatttaaaggtatgatgaaaaatggaaagagttgtaaatgtttcttctagagttgtcatttggtgcttctgttagaagggctatggaggaggccgggcgcagcggctgacgcctgtaatcacagcactttgggaggctgaggctggcggatcacgaggtcaggagatagaaaccatcctggctaacacggtgaaaccctgccactactaaaaatacaaaaaaatcagccgggtgtggtggcaggcgcctgtagtcccagccactcgggaggctgaggcaggagaaaggcgtgaacccgggaggtggagcttgcagtgagccaagatcgcgccactgcactctagcctgggcgacagagcgagactccatctcaaaaaaaaaaaagaaaaaaaaaaaagtttgacacagtttgatctttttctaacacctggtggcatttttacagcataacctttaaaaagtcattctagaatatcctaatagatgtatacatccctctacctaaatttttgtagatgttatttgcctacatagtgaatgatattgtatttcagcggaatttattattcaacttttaaaaacaaatctcctgcatttacatccattttccatatatctatgtcataaagataatgaatttaattggacaattttctttcaaatgtgtgcagcctccttccacttccaggtctgaaagaggacagtatattttatagaccacacgattgccagagtggaaactggagtgagtggaagattccacatagttttacttgtgatactctagagactagtggtgaggtgtcttggagatggcataataatacaaataactaaatattactgagttgttactgtatatggcactatgttaaaggtttcataggcatcactcctcatcacaacaataatagcccacctcggcctcccaaagtgtctgtcccttctttattcaccagccacaatgacacacagaacatagtaggaagaaaatagtttatatttattcctaagaatataaacttctgttaccattctaaatttccagaaaaacttattgtgagtgctaaactaatatcatcctgacctaagacaaattgtcagttcctaagggtgagatttataggagaaaaccatgtctacgcttgaggcagagttcttagtagagatacaatagccagttgctattatttcaaagtttgtctgtccctaaatattgcctgcttaggtctgactatgctaggattagtgatcatctgctctgaattaaaggtttagatgcgctcttcccaggataaaattaagtttggggactttctcttttcctgggagcaaaaacctcaggaactaagtgccatatgctggaagatggaaacattccaacagccagaagtagagggaagataaaaatggcttccctaaagcaaggcaaatcagcgacagccagtcctgtggccaccactaatcacttgtaaatgaatgctgcgatgtgtttcaaaagccctcattctgactctgcctgatctgctactgaaatgttaattatatgcctaatcttctcttgcaagcaaaggcagcagagttgctaaagatcatagcaggtaaaagccttcaaggagaggtaaggagtaaatggagctgggagagaatgctgtctctcaggacagagcctggctcattgaaagggcatagtcctaccctataagggatgcctcccagtgtgaccaggtcttctatgatttctttttatgagaaaccagaaatctgattatgttcatgagaaattggagttttacaaattagcaaaactgtgctgtgctgagaaaatagaataaacctgaaggccagaggtgtgctgggagagtcacttacagaaccagagcaaatacttagatagagcaatgatgtgttttaataaaaacagggactactgtgctttgtaaatgtctttatgccttctaaacgtcctttctcctgaagtctataacgtgacatgggatagcaaagtattttttggcatgaaccattgcattgaatatcttaacccatttgtgttgctattaaaaaaactcctgagactaaaaaatgtatttaaaaaagaggtttatttggctcatgattctgcagcccatacaggaagaatggcagcagcatctgctcagcttctggtgaatttctcatgttgcttccacacatggcggaaggcaaagggaagccagcatgtagtgagatcacatagtgagaaaagaggaaagaggggggagggggtgctaggctctttgtaacaactagctttcttgggaactaacagagagctcattcatcccctctccccagggagggcaagaatcttttcatgagggatctgctcccaagaccctaacacctcccattaggccccacctccaacacaggggttcaaatttcaacatgaggtttaggagacaaacatccaggctatgtcattggatccctaataggctgaagtaatgtgttaaaaataagttgtaaataattatatgcaaaaacacatagcattttggaaactttgcaagataatgaaaatatttatctggattttaacttaattcactccatattctacacaaacatatttttaaaagataatacaatatttgagacattaatatatgttaaccaatttacatcctcaagagctaagaaagtgttaagttgccctttcttaataaaaacaaaatttatgatgttaactgttttttgtttgtttgtttgttttattgagacagagtcttgccctgttgcccaggctgtagtgatcatggctcactgcagccttgacctcctgggctcaagtgattcttccacctcagtctttggagtagctgggattacaggcgcatgccaacatatctggttattttttgtagaagctttgtttcaccatgttgcccaggctggtctcaaactcctgggttaaagcaatctgcctgccttgaccttccaaagtgctgggattttaggtgtgagccactgtgcctggcctatgacgataacttttttaaaagacaaaattagaacaaatttagttatagatgtaattggcttctatttgtaagtcatgaatcagggcagcctgcattctacaaaataggatgagagcttccacagacaatggaagaacagtagcttctgtaaaatgagaacaattaaacaaaacaatagacaaaaagctgattggttaagatcagggttaatccaggttaatttgttgtaagggttaaagcagagaaaagttcctttttgcactgactcaggtagaccggaatttcctgtcttgaggaaaaactgctctgttctgggacctgtgtactttcttaaagtttcagtttgattatgtggtttaacatagcacatgaataacaatgcgattattttaaaagagttattataataaattttgataaatttgctcaaagtcattatctctaataatcaaattatctcaaatttaattaattgcagtatgtgtcatttatttcaaaagtgaaataaaaacctgttccacaaatcacagtttagtttattttcaaattcaaactttacttgcttcactgaatctagcaaaagtaaatgtttcaaaataatgcaaaaaaaaaagaggtttgtaaagttggtaagaaaatatttgctgagcaagtaatcagatgtttattgtcttacctatgtcatttcttatatatttacattcacattgatttgtattagctatcaagttaatcatgttaaaaaaagtggtaccataatgaattgtgtttgatgttgaaattaatatttaaagatttaaaaattatgagagagtattctgtgttatctcagaatactggtaatgtcttaaagatttctggctacaaagtagttttacaagacattagttttatgggcactgcatgcattgcattgatcaaagcagcattgcattggtatttaacactaggccatgactgaaagggcttcagaagacatcatgatgaactacatacagagtaatggcaagtttactataaaattaacattctcagttgtcacaagaaatctgacaatcactaaaatggcaagcactgtgttctatttgtgtccttttcagacatgattgataagaatttgttaccttattagcatgtcataagtagacagcaaagtatgttttaaattcgaaaattattattttctgctcacgttctactttcagcaatgtacacagtgatagtaatgaaagcagccatcagaatagtctattttcttcatagttagctgccaaatacttctttttttctatccagatcatacttgtattgcttttgtgcctttgagcatagtcataaattagtacacagaggaagcagggcagtgacagctatacatttttctatagaagatcagctattaaatcaagaaccaagagaaccatctcagcctggacactgagaaccgaagccacaccttcccactgatattaacatgactttgttattctattgttccattagtattacttttcgaggactgtcctacctaaagaatggtttgatttttcattataggaacttcccaaatgctttatcaaccttcaggggaagtcatagaccgagtttacagcttgagtctttgaatccttccccacaaatcctcacctcactattttctctaagcccagactgttgtatcatgattctcacacaattctaatcaaatcctctccttcagagacccatcttaaaccaaacttgcaattctcaataaattctgatctccccttctctcctctgagatgctgatagaaatttacaaaggctgtactctctcccttgccagtgtattagttttctattgctgctgtaacaaattaccacaaacagtgttgtaaacaatccagacttgttatcctacagtcctcttggtcagacattcaatgtgggtctcactgacctaaaatccaggcatcagcagggtagaggttcctcatgcaggctctgggctcctgtgtctgacttttccagcatctagaggctgcctgctgtcctcagcccctggccccttcctccatcttcacagtcagcaatgataggctgggaggccttctcacgctgccatctctttggttctttctcttctgcccccctcttccacttttaagaacttgtgattagccccatctggataatccaggataatctccctatttcaaagtgagttaacaactttaattccaaatgtggtcttaatttccatttttcatgtaagttcacatgttcacatattccagagatgagtgtgtggacatctttgggaggtcaattattttcctgccacataggtaagcaataaacttcgcaataagccgggtgctgcggctcatgcctataatcccagcactttgggaggctgaggcaggtggatcacctgaggtcaggagttcaagactagcctggccaacatggtgaaaccccacctctactaaaactacaaaaaattagttcggcatgatgtcacatgcctgtaatcccagctactcaggaggctgagacaggagaatcgcttgaacctgggaggcagaggttgcagtgagccaagactgcgccactgcgctccagcctaggcgacaagagcgaaacttcatctcaaaaaaacaaaaaaactttgcaataaataagcaatcaactttgtctcatcaacatgttatgttggtgataattggggatacagctttgacaagcaattagcacaaacatgacctacttgcagaaacttgtcatagctattattctaaatatggtaatagatgactgtaataatccaagccaagaattatgacattttaaatccacacacactcttactcctggaatatcctcaaatggacattaacatacaaatattttaattagattcttttaaattcttaagattatgtgatataacccaaaagtggggctgaaatgtcaggtgacaataacacccaaatggaggttccactcagcacctccagggacaccccccccaacatatatacactctttacagaaacatatttggaaatgaattcattattcataagtagttgtgaatagttagaaaatagattttacatttcacattcaataaaactcccacagaatgtcaattctgattattcgtggattttgtattttcaaatccaccttcttgctaaaatgtatttgtatttgcaaattcacccacctgctaaaatttattactaaccccaaaattcacactcacagcacctttgttgtcatacacagactggccaaaaatttcattctcccagcttgcacattcccagctgatgttgaacaaaaccgtgttctgccttcttgtttcaactctcatactaaaatcaagtgtccttttcacaatctgtttagtgtcgtggttttcatatttttgtgcttttttggtgattttgatgtttacaatggcccccaaacatagtgctaaagtgctctcaaagcacaaaaagaccgtgatgtgcattatggaggcacatgtgacataaactttgttcagatatgacctatagtatagtgccattggctataatctcaatgctgatgaataaattttatatgttaaataaggagtctttaaacagaaacacatataaaacaagattatgtcttgatcatttgatgaaaatgttgcagccagaggctcacagaaacttccccttacattttcccaagaagcaacaatttaatacttgctaatgttggagctctgaaaaccatatcctcaaaaatggcactttgacatgttgagtgctttgaattaaataaaattgaaaggcctcagaaataagcctcaggaccaacactctgtctaacaccatcagcccccccaaccccaccctactgtattagtctgttctcatgctgctgataaagacatacccaagactgagtaattgataaagaaaaagaggtttaatggactcacagttccacatggccggcgaggcctcacaatcacagtggaaggcaaaaggcacaccttacatggcagcaaacaagaaagaatgagaaccaagtgaaagaggtttccccttataaaaacatcagctctcataagacttattctgttccaggagaacaatatggggatatggggggaacagcctccatgactcaattatttcctactgggtccttcccacaacatgtgggaattatgggagctacaattcaagatgagatttgtgtggggacgtagccaaaccatatcacctaccatcctctttctttcctgaagcaaggaagcaagaaaggagaggcttttgctgaagtttccttatctgattaagtctgaccaagggaggtttctccagaagaaatgcagtgtttttgtttgtttgtttgttttaatttagcccagtcaaattgacatatacaaatgcagggtttttttgtttgtttgtttttgttttttgagacggaatctctctctgtcacccaggctggaatgcagtggcgtgatcttagctcactgcaacctttgcctcctggattcaagcaattctcctgcctcagcctcccaagtagctgggattacaggcatgtaccaccatgcccggctaatttttttgtatttttagtagagacaaggtttcaccatattggccaggctggcctcgaactcctgaccttgtgatccacccacctcgacctcccaaagtgctgggattacaggcatgagccactgtgcccggcctgtttttttttttttttttttgagacggagtctcgctctgtcacccaggctggagtgcagtggcgcaatctcagctcactgcaagctccacctcccagattcacaccattctcctgcctcagcctcccgagtagctaggattacaggtgcccgtcaccacgcccggctaattttttggtattttttaggggagacagggttttaccgtgttagccaggatggtctcgatctcctgacctcgtgatccaccctcctcggccttcccagagtgctgggattacaggcgtgagccactgcaccgggccagaagtgcagatgttttaaaactccctctctacagatcttatcatataaccaggaaagagtaaccaccagagaggagaaaataagtcattaccatgtccagacagacttttcatctatccttctgagggcagctcagagagattatgggaaagattttatctgcataatgacaacctttgtttacaatgaagttctggtctcacctttccataatttgcttgtacctcccccagagctcagacgaactttgtaccaggccaattgtcttttttttgagctcattcattttccctaaaataatttactttccctctagatgtgcccacagtcccccttttccctgtcccctgtgaataggatatttaagaattaaccaactagagggcatttaaggcttaaccaaagctcttctttgagtctcatatttttaggactcccatctccatgtgcatattaataaattgcatgcatttttcccttgttaatctgtctattgtcagctcatttcagcagtgaactatcagagggcagaggggaagatttctctctgcccccacagtaatttgatatttacagaaactttatagaacataactactgtgaataatgagaatcaactgtatatgtcacctttgaatacctctcttctctcttcactgcattcctttggcacagagatggagccaaactctagtggctagggaagtgaataaaagactgggtctgagtcacctgtttccctaaaggtagcatcaccctctgaaggtgccccttacaggcctctctgggaagggtttcacaatctccttccacactttacaggtggcaaattatggagccaagggccaaatccagtgcccatttgggcaacaagctaagaatgttttttacattaatgacaggctggggaaaaaaaaaaaaacagcaaagaaaataatatgacctaaaactgtatgtgacacataaagcctaaatatttactatctgggcctttacagaaaaagcttgctgaccccttctttgcagcctcaagtatagcaaatatctagtgtttgggaaataatttaaaacaaaacctgttcaggaaacctctccacaaaagtagaatagatgttgttgaataagcactaaagctcacttcaatgtgcatcacaagaaatctgccaaagagattgaaaaacagacagaaatctcaccctttcatgtggccaagtaggtaaaaccctcacatacacgttctcaagatcgatgataagtagtttgcaagtaagtaaaaggacttgacagcaccacttgccacatagagttcatcccagattcactgggtaattgaaattggccatgggtgcttgctaattacctttatcgaaaggaaaaacaaattctcatatctttataccaggaggtagttttgcaatgtggagcccgacgcctaggtaacattaggttcctaccctcccatgaaaatgtcaataaaaagagtccaactttgtaacacatttgtagaaatttattctgagccaaatatgagtgaccatggcccatgacacagccctcaggagatcccgagaacatgtgtccaaggtggttgcagcacagcctagttttatacatttcagggagacatgagacatcaatcaaatacatttaagatataagttggttcagtccagaaaagtgggacaactcaaagcaagggggtgtctgggttataggtagaatgaaaaatttcagattggcaattgcttgaaagagttattatcatagaaaacaatgtctgggttatgataagaggttgcagagaccaaagttttatcatgaagatgaagcctccatttcgcaggcttcagagaaaatagattgtacaggtttcttctcagacctaaggcttgtgttgatgttaaatggtgattggcttttcctgaattccaagaggaaagagggcataatgaggcatatctgaccctccctccccattgttgtgggacttttccttagttcagctaaagatgcagtctttgtcccatggccacgaaaatttaggcttgcagacgagttgaagggtgagtaaagcagggttttattgggtgaaaaggaaaaaaaagggggaacagggaccctctgcaaagtcagagtctctgctggtgtgcttcctgccttgcagattgaatcccagtttccacacaggaagaggtgggaccaggctcctccctctgcaaacagtgcaaacttctgtggctccaccccaaggtgcattccttccagtgtgggctggttgcagtttcactggggaccctctcccacctggctgtctcaccatcatggcctaaaccagtctttcaggttaaatttagggtgccctggcagaggaggggtccattcagatgtttgtgaggggtggagggggtggctatgagttttatttttggtttataaagatgaggggatgaggtacaatcctccttggtgattctatctcagagatagttccagacccttgagaaacacattcctacattgtaaaacctgcaagagacttatcttttttctttaaaaaattgctatatccctaagaagcagagaaagaatttatgtttctgaaagaaaatattctgaggaaatggtggtggtggtggtggagatctctttccctttttccatcagggagaattattatttttttcctatgttccatttgtatttactgttacactagttaactaagtatctagccaaaaggaactataatttgagaaggtggttcccatgacttctcctctttcttttctttcagacttctgcttcctcagaaatgccctcattttgtcccaaggtactcagatctgtcactctacttgaatccaatcagcaaaacaacagctctgcagttagctgacttgcttctaacctccatcatctaaagtagaatattaacctcttatatcgttattcaaaattgtcacctggggtttcagctcctattctaacaggtcaatagaagcatttcctgaagagaaacaggagtgtgtgtgttttgggagtacggaagatatttctactaagaaaaggagtttttctccacagtgttaacattagaaatctagcacctatcatttcacaaattgaatacctgaggcttagggaggtgaagtgacttccttgaaggaaacaagtagcaaatgtggaggttcatgtctgcagcctatagaacccaggaaccctctttccactatgccagactaacctgggaacccaattagctgccatcaaaagtataagaattctttttatttgcctattatctctcatgataagtgaatcaattacttactgagcacaattcctacaaagtgcaaaatgaccaaagtccccagagtagcttcctctacatcgtgagctgcaactccagtaaaagaggctggcaactctcaaagacaaaatgcactggactgtggagcatatgatttcattaggactatttgtaatagagagaacatggccagatctcagcaggttgtgactgtttaactggtggtataatttactatcaaaattattctgcaatcgggggggtcttagtcaactcaacaggaaatgtttatcttaggattttgttagttcggagggacaaacagttctaatcttagctgattaataatgagacaaagaatgggtggttggaggatctgtgttttgccttgtcagcagacttaggccaaaggggaaaggtctgtgtttgatcttgtcaacagcaatgtgctaattgtgactcctaatggggatggagcttggtgtgtgcttggacatggcattccatatgtgcccaggacatgctgtctttttaagagaaaataagaatctgaccaggcacggtggctcatgcctgtaatcccagcactttgggaggccgaggtgagcagatcacgaagtcaggagattgagaccatcctggctaacgtggtgaaaccctgtctctactaaaaatacaaaaaaattagccaggcgtggtggcgggtgcctgtagtcccagctactcgggaggctgaggcagaagaatggcgtgaacccaggaggcagagcttgcagtgagccaagatcgcgccactgcactccagcctgggcaacagagtgagactccatctcaaaaaaaaaaaaaaaaagagaaaataagaatttaatttcttcagggatcctgagtatctctcattacctaaagtgttcatttattaccaaatgattaactttctatttatgtgtgaggtttgtgggagaccatagagaagttttgtttaaaacatctacgtatttctttacataattcatttattatatcccttgttgaatgttctggctgagaaagatttaatttaagctttccatcaatgagaacaaagatgaggcttgctgaaatatgttgatgttcactggacagcaaatatcctgctctgttctatattcaaagttgaaaagtgatggaaacctcatcctcatcctcagggctcagaaaagtcacaaggtctttgactttgaagagtggaacaagagggcaacatgttttctagtaagtaaagtaagtgaggctatggagtaggtttcagagtggcactttcaatcttactcggacatgtcaaagtctttacaaaggcttcttctagacctgtaagcctagaattaatataaacgctcacctaggtcaaattcaatgatatttatcttaaaggactttcaaatctaagtgggtttcaataaggcaaacccttctgagtcttttatttccctaagcataaaattctatcttctctaccttctgtacttctcagcattagcaaaggaatctcatgataattgaattcaatagtagtttatctgatgccaactattttcccgtctctatgctgggccctgggtacacaacaatgaaaacaatgtcctcctctccactacccaggctgccttctcctctaaattgaacaattgtctgtgattcaccaacaacaagaacttttctttacttacctacctaaaatatataaacacaattgacaactttaggcatgttctttcaattggaggacaattacaaatagttgtcctttgtattgatgaaaaggctagtggcaaggttggttgtggcctgggcagcaggctagatgggcctctcaggaggacttgctaggttgcagtgccccagagcaatttatgacataaaatctgtaatatttgagagataattgtcacatcttataatcaagatcaaataactgggttctccttttgtctgcaaatgatgattgtgcttgcccacagtgaagccgacctgcgtgtcaaggagctcgatgaggatggaatcccagtgctggctgccagggtgagggtcattttggttgcaggcgagggtgatagaatgttaccaaaaagagaggaaaaacaaactttcaattatgacaagtgcaaaaaaactttttattttgaggtttagcatttctcaaaataattacagttacatgcttccatactacatacttctctctcaaagattagttggttggatttatctagggcttgaacacaatatcctatcaaccttgtaatcctttacatatcatttatattgcttttactcatttagctcagtttccattgaaatgttacctttgctcattattgttacctctgaatgtcctgtccttgtttttatgagaacggtgtctagctatgttgttacattagaactatataaagagcattaaaagatgtacttatttcacaaattgtcaaaatataaacaaaatataaagcaaaagacaatagagatatataaacatagcccttaagagctgtagatacactctttttttgccaaagatttctattttttattgtagatttggagcgggggtacatgtgcaggtttgctacaaggatgtattgcgttatgctgaggtttgggtttcaactgaacccatcacccaaatagtgaacatagtacccgataggtagtttttcaccctttgccccttccctcttttctgtccttcagattctccagaatctattgttctcatctttgtgtacatgtgtacctaatgtttagcttccacttgtaggtaagaacatgtgatataaatatactcttaaattgttcaaagataacgaatgcatcaaaaatatttccaaatgccttgcctgagagttttatctgagtgaaaagagttttccttttattaatcccaggttgatatgagctccactttgttctctgtggagtaaaatcctatctctctgaggtttttgtttttaacaattctcattgatttttattgtgcatataaaaatgaaatcatttaagaagattcataatgacaagatatctgtagggtaaacccagaaagggttcaagctttatgacagcaaaggaaacaattaatagattgaaaaggcaacctataaaataggagaaaatatttgcaaactatttatctaataaggtgttaatatccaacatatataaggaaaccctacaactgaatagccagaaacaaatacccagatttttaaaagatgtacagtacttggattgacatttctctaaaagaatatctgagtagccaacacacatatgaaaaatgctcaatgtcactaatcagagaaatgtcaatcaaaaccataatgagatatcactccccactggttgtcaaaacaacaacaaaaagataacaagtgttagcaaagatgtggagaaattggaatccttgtactctattgggagtgtaaaatggtgcagccactatagaaaacagtatggaggctcctcaaaaacattaaaaatagaactatcgtatgatccagcaatcccacacttggtatttattcaaaaaattaagatcttgaagacatattcgaactctcatgttcattgcagcagtactcacgatagccaggatgtagaagccgcataaagacccaccgacatatgaatagataaggaaaatgtggcatctacttacaacaaaatattattgtctgaaatgaaatccttccatatgtggcaacatggatgaaccttgatgacgttatgctaagcgaaataagccaaaaggaaaatacagtgtgagtccgttattatatgtccaatataaaataaccccattcacagaagcacaaagtgcagtgggttaccaggggctgggagaagtggaaaatagggagttactgtttaacaggtataaagcttcaggtatgcaagatgaataagtcctagagatctgctatgtacaacattgtgcctgtagttaagaacactgtgttgtattcctaaaaatttaagagggtagctctcatgctgtttttatcccaatttttaaaaattagattgcatggaaaagaagatccttgcacatggacttttcctctttccataatttcaaattgcaagcaaattaatctgggatgatgacttatatttctcctcaactataattttacttctgcctcaggaggatctcctatgaatttctgataacctagttttcctgtgcttctccactcacaggttgtcctaaaatcctagttaatttacatgcttgaaattgcttgcatggttttttttttctttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgcttgcatggtttttaaatttcaaataaataatacctttgattggactcatgggcttctgatcaaacccacagactttctttcatcaaaactaaacacttcagtagatcctagaaaaacagtgaaaactctccaagtataaatatgatgctgaataaggtgtttaaaatatatgaagctttacacatacacatacatttttagtatgagggtatctctggcctattcacttaaggaaaaacataccaccagaaatggaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattcttgtggcaacactctatagcccagggacaggaacgggaaaagtcatggttgttttgatccagtttgaaagttggagttttatgggttgaagcatgtggagagtgctgatgaacacgatcagaaccaaagagaacaaattgaagctttgagggggaaacttgaaagggagtggagggactggcaggacaagtgagatgaaagtggacacagtttagagtttagaatttagaagggaattagttctcagtactggtaccacctagtgtggagtgggtaaagagaccagtgagggaaactgaatataatagggtttccagttacaatcctgtcagaatcagtttagaagtcaccttctagactccagtagccaagagacttcacatccgaggcaggaaaatctctgaaagtatgagttccagttttcttgtttcttatcacctgcctttgagtgagtcatgtcactcaaaggcaggtgatgaggacttggagacacttggagttcaatgggcctgacccactgagttgcagataaaaattcacttctttatttaattcttaaccaattaaatatgcagtgagtatgtagggtactcaaaaatgtatttcaacagtcatcagagctgctataaagaccactgaaatataggtcttaattatcacagtttgtctaagaagacaaggctaacagatttgaaatatgtacaagagactacataattacgggtaattgccaattataaatattgactatgggacaggtgcagtggctcacacctgtaatcccagcactttgggaggctgagacgtgcagatcacgaggtcaggagatcgagaccatgctggctaacatggtgaaaccccgtctctactaaaaataccaaaaaaagttagccaggcgtggtggcatgcacctgtagtcccagctacttgggaggctgaggcaggagaatggcatgaacccaggaggcagagcttgcagtgagccgagatcacgccactgcactccagcctggtgacaaagagagactccatctcaaaaaaataaataaataaataaataaataaatattgactatgcaagttataggaggttataggagttcatgtgactaagtaaatcaaggggaggagtgtaatcaaggcatctgtccccctgataggtagactttgaatgggtagaggaaataagaatgggcaagcatctaagacaggccaaatgccccaaggcataaatgaacatggtacgtttgtgtggaagaaaagggatgggccaaatagatctgaggtgctgagttgaagtgtgtcaaatgatggttctgtaaggtgtgataaggtcagattatagaaggctgtgctaacctaatggagagaaaagctcacagataataaaatgagggagtcactaggtctaagcggagatgaagaaatacaaactttcacagattataagcaatagaagatattctttaaaaaattaaatgcatacaaatgaaaatacctgcataagaagactagagctatataaggaacacaacgaagttgggaaatattgcgaagaatactaccatcatgaagacaactctctatattaagtaagttatttcaaaaaataggaggaaattcaagagcagtaaaaaacaaaaggaaaaaactctattgtcaagatcatatatgagataatgtaaatagtttaaaaagtgggaaaattttatctatctaataaccatagacatgcaagttacagtagttcaaagcaccattttatgtctaattactaataaaatctctctgaaaagataagcctttcctggcagtcctgtggagaacgggatgcaccatgtgctacttctgctacttgtgcaccttgtaacttaatggatgcattcagaaagtaacatacagatgctatataatttataaaaatttcatcctcctttaaccaatatctcactaccaggaatttatcctaagacaagttttttttttcttttttttgagacagagtctcgctctgtcacccaggctggagtgcagtggcgcaatctccactcaccacaacctctgcctcctgggttcacacggttttccagccttggccgcctgagtagctgtgattacaggcgcccgccaccacacccggctaatttttttgtgtttttagtagagatggggtttcactgtgttagccagaatgttctcgatcgacctcctgaccttgtgacctctgcctcccaaagtgctgggattacaggcgtgagccacagcgcccgggcattttcgctggttcaagtgattctcctgcctcagcctcctgagtagctgggattacaggcacgtgccaccatgcctggctaatttttgtattttagtagtaacggagtttcactatgttggtcaggattttctcgatctcctgacctcgtgatccacccgactcagcctcccaaagtgctgggattacaggcgtgagccaccgtgcccgccggccatttttttttaattatgtttacaagacgttcaatgttacatcgaaaaagtgaaaacagtctaaatatccaagagtaagaaaatagttaagaaaattttaacacccaacatgaggcgataagcttctgttgttattaaatgtaataaatatgaacatttgtcaaacatggacatgacataatacatagaaaaagcaagatataaatctatatgttcaatattattggacatgggtagcgtacgtctaaacatagagaatcaagcactacaataggaatgggaaatgcaagcttcctttcttaatgtcagatgcctgagaagagaacaccacgggaggatcacggcgtctgaagagattactctggcatactaccaggaccgtccctccattttcttctcttctttattttggtctgaaaagctcttttcctacctattttatttttcttctgtatagcatcagaagtatcttcttatctatgttgaattttacataggattttattttaggatgtattttcaatctgtttgttttcctagctcaacatgttttgtttgtttttgaaaattcattttacttattttttgtaactctgattttgagtcactattgaggatgccatagtatttttttttttttttttttgagatggagtctcattctgtcacccaggctgcagtgcagtggcacgatctcagctcactgcaagctccacctcccgggttcacaccattctcctgcctcagcctcccgagtagctgggactacaggcacccaccaccacgcctggctaattttttgtatttttagtagagacggggtttcaccgtgttagccaggatggtctcgatcacccgacctcatgatctgccggcctcggcctcccaaagtgctgggattacaggcgtgagccccctcgcctggcccatagtatgttttataagtgttctgaaatcaagtaataagagttttttttaatgaaggtgagataagtttctggcaaatatagaacttgagaattaatgaagtgtatacttctcattttctactctaaccttttgaaattaatacaattttaacatgaaatatttccatgaaattacaggagaactttgatgtttgtttctgcattctgggctcccagaaacatggtgtagtgtggtctgacatgcatatctttggaaatttataataggtttcattgtctgatcttaaccaaaacccagtccttaataaaatagcccagtatatatatggttgttttcctctactaaatgaattacaattctttgctacctaccagcacagggcaaattaaagagaaaacttttctttccttatagtgcatgaatcctaccagtgtggaagagtgaaaagaacccaagcttcggagttttacagccacaggatcagattttagtctattccactacccaaaactaggcaagttttctggggtcatctagcctctatgacctcatcggtaacaacaggcttcactgtggcttaagtgagataatgagtagaaatggaatggtttgggccaggcacagtgtttcacacctgtaatcccagcactttgggaggctgaggtgggcagatcacctgaggtcgagagttcgagaccagcctgaccaacatggagaaaccccatctctactaaaaacagaaaattagccgggcatggtggcatatgcctgtaatcccagctactcaggaggctgaggcaggagaatcgtttgaacccaggagatggaggttgtggtgagctgagatcgtgccattccactccagcctgtgcaagaggagcaaaactccatcaagaaagaaaggaaggaaggaaggaaggaaggaaggaaggaaggaaggaaggaaggaaggaaggagaaggagggagggagagagggagggagagagggagagagggaggaaggaaggaaggaaggaaagaaggaaggaaggaaggaagaaaaaaaaaaaagaaatggaatagtctggtagggtgattcccaaactgctgcacattagaatgaagtgggaagcttttagaaacccagcgtccacgttgcatgcaacatccatgaagtcaaaatattaggcatgggaaccaggcatcaacagtttttaaagatccaagatgattccattgtgcagcaaaatttggaaaccagtgcctagcacaaagcaggtattcagcaaaagtcaactttctttatctttcaatgtgtggttatttgccagctttcgagtagcacttccttatcttcattccttaaaactctgcagcagagtggcactgcataggtaaatgctacactgacatcttgctgcatgccgcactttactgcagtggaaaataatgaggagctagccgatacccattattaaagtgtcacacaagtgtttcatcccatccagtcacatttttcagaggcttccaattcacactttcgtaaacgcggccgtttcctcttcctgtgacttagataagatggaaacagacatgctctcaagtatcatattagctttttttcagaacttctttagttttctagtgaggcatctgtgcctcctagaaatgcactttagaccctgctatacagaaaaatcaattttcttacaactggtctgaagcatacatattattcttttagatctgatgtatcaaatgcccacggccctaggtatgcctgtgtttctttaatctataatgatcattttatacaatgtgctggcaccttgcccagcacactcctttacctatagcaggtttagcaggctgggtaattgccccttttaaagttgtctgcactcaacactgccctgtctggtaaatgcaattagaagccaatccttgggtgtatcagcccagacttttattaagctcatatggcattctcattgccactatttctcaccaggttgctcattagccaagggcagccaaaggactggatcatatcagacagtgactttccaacccatgagactcccttgttcaccttaaatacaaaccacatagagaagaaactggggatttgtatgcctgaaagctgacagtggccataacaaaagcaataaacagaaatcctagagatagtgatgacagaagaaatgtgtgtttgccaaggagttagagggagcactttgtgttggcactgaaagcagccagaagaagactcagagtgagacagaagttgactcatgcaacaaaccttcaccactgacaagtcaaagaaaatgactgaggagcgtctcaatcatgttagaggtttattttgacaaggttaagcacgcacccgggaaaaaggaacacaaaacaacaagaacaatctgtgatccatgctttttccaaagagggcctggtaattttagtatttaatgggaaagagcaggcagtaggagaaagaggaagaaaagaaaaaaggggagggtagataaaaggggcaggcagttgcattctgttgagtctttgatcagtgtgcactgaatccacatttcacatgtcaaaggaaggggtagagaaatagtcaattatgcattcatctcacactcagtgaatctgcatttttacataagataaaataaacataaagtagaggaagtaatcagatatgcatttgtgaacccagaaaatctgagacaggtctcagttaatttagaaagtttattttgccaaggttgaggacgcatccatgacacagcctcaggaggtcctgatagcatgtgcccaaggcagttggggcacagcttgatttttacatttagggagacatgagacttcaatcaatagatataagaagtacattggttgggtctggaaagtcagaacaactggaagcaaaggcaggaagactcaaagctgggagggagctcccaggtcacagataggtgagacacaaacagttacattcttttcagtttctgattagcctttccaaaggaagtaaccagatatgactcctttggtgcagggcggcgggtggggggtgcttttagttctatcctttgtcctttgttccaggatctgtgaagatagctgttcccttgcattttctgggtgaaattcagaactgttttagggtaaagatcttgggacctacgaagaatttcgttttaagcaaattgtgagagaggcatgtatccttttagatctgtagctgtcttatttaggaacaaaatgggaggctgattggcatgacccagttctcagcttgactgttcccttcagcttagtgagtttggggtccagagattttatgttccttttacagcacccaggaggaactgagcataagcctatttctcacagctttgaggagcactaactgaagtgctcagttagcagcatttgaattaattatttcacagctcatccttaaccaaattatttttaatatgattctaaaactggggttttaccttaagtttagtattttgaggtaatcttagcatcaggtggaccttagctcactaagagcatgagagctcttagttacctcactcatcagcggcttggctcctctttcggaaggcataaagaacctcatccatcagtgcccacatactcctgtaagcgcaggcccctgttctttgcttctgggaagcatccatctggtcctgtattgctttcgttcctcttctgtctgttttcctatgcaaaccaatctatcattctattttgttgccccatttccaagtcacttgaccagatagataaccacataaaaatggctaagtaatttaagcttaaaaattaggagcaggaaatagtgtaaactggaatagtaagaaaatgctgaaggtgagacttgtggagggctggcattgtggacgtctttaagatataagactttattataacagtcaaagcaaaggggacatgtaattaatacaagactttttatcaaagaggaaaagctgtcattttctcaggaatctaatactattctaagacttaggtttaaaatgtatcaggagtgccttctaagtgactgtggaaggagggaaatagtaaccatatattttggatgagtgattgtatatcgtggcttctattttatgcctactcttctccccttgtctcttgtaaactcacttacaaccagatcataataataaaactagaacgcagagtggccacacagtacagtgactaagcacgccagctctgaagccagaccttttggttgggatctcaatactgttaatttcctcatttgaaagaccagggtaatataatccttcaagagagggttgttattagggtggacctgataaatagggtggaccatataatttatcatgcagatggatgctttagaaagtgcgatgatgtttacttgtcaaattattatcatgctattttgactatattttcttatatgctttacttgaaatatttaaattagcccatatgtaactagagtctaaaatccatagttcagggaaattgtggttgtattttgtccctttaaaaaacacaggggcattggtgcctaaatcattgacccctgcaaaatgcaacaggttgcgtggaagtgaaacataatgcctccaacctgctagttatttacacatgttgacctaaggaacacacaagccagatattctttaggttgtctctttttattgtaagaccactgaatggcaaagtacttggtctgcattagatttatttactgttaaaagattttcaagaaactacaatttaataacatgtccttgaatttttttcacgagttgaaataataaatatacagtatctattcatctatcctggaaagcccctgataaaagcactgcgttttcttaatcagtttccttttctatagaataaatttctgttatgcttcttaatcagcaaaatgacaaccaaattaagaaataacctcaaacttaacaaaacagaacaaagtcttccctgaaggtcttggagaaccacgtaagatcagatcacaacccaaggtctgccctgagaaatggggaaagccagggacctgccacaccttctttcctcttgtctaactggagatgagaaactaacttaattttcatgatcttactatgttagcctcatacgtaatcatcttctcttttgtctaaatggttccctattttcaccttatacttaactatcatatatagggcatatgaatacatttatctcagatcccattcagaagttgtaaaggaatacattattaataaatcaaatatttctacattacatggaagaaagtgtggaacagttaagaggatggttactggtcccaaagagtccagagtttaaacccttactctatattatctacatgatctgcgcatgtagcttatttttaatgagttttagtttcctcatttgcaaacagcgtgacacttgtcccaaaggattgaactgaggatttagtaagataacaggtgtagagggtgtcttcacagtgctgggctcgtgtcaggccctcgataaatattaattcaattccccttctcctgccctactaccatcctgcggctcagagcagccaaaagctggaaaaataggctccacccagaaactataacaagataacgataaagcacagttggatggatcaggggtaatctactgagttatccctgttttaaaccattgtgtttgcttctgtgcataggagaatctccccatgctgaagggcaagtggaacatttgcacagttgcccttgggaacatgaacaacaatagtttccttagccaagcctagggcagtgtggagatgaggggcacatgggacgcaggtccctctgctacaagcctgactgccatcggaagctgggagacaccaaagggtggccccaggggctctctgtcatcttatggtgactcaaaaaatgcacattcctgcattgataacaatgggtatttttattacatgaaaatctatgtacttactatttgtgttcttcccaacattcaactgacttttctacctgatgcaaaatgcaggagggctgttcacgacttcttcctctcttcctcttctcctcctattcttcctctttcttctccttccttcctccttcccctcctactgatgtttttatttctatcaacaaaaatgagaaaaatcgctttcagttacaaagtaagtctgaaactatatcaaaataatttagatctttagtagattgagaaaaaacacacaaactttttcaacttgcaggaataaaaatgtcaagattattaactctgttctttatttttagtgaactataaaaaggtttattgataatttctgttgagcaagatgacttcagagtttatatcatctaggccttaagatttactagaattttaatgtatcattctaaagatgtgctcacagaatacccctcagtgttgcttgaccgataagggtacacgctacaaacacgtggagaaaaacgtgcagagctgttcgtgccagaaattagtggccatttaaattcctcacttaccaacaaattaatagattccttcatcttaaagagtgcaagtgtattttaggtccatgccataaatatttaaaactatctcatcttagtgaaaatttatataacacatgacctttgcaaaattgcaacctttattcttcaagcaaaaattggtttctgctggtcaccacaatgtgcttcttttggacaccatgtataactgagattgaattgtaactgttagcagtggagaaagcctgcggaaaatcaactcaattgaattttgtgttcacagatgctttgagttttacagagtcttatattccattttcaagtgcatcattcaggacacaggcccattttccatatcctagatcacccaaccagtccagggctatttcagaaactttcctgagcatataatatagaccaacgctaggttgtaaactaagtataaaattctaagccccccaaccaactgaacagaaacttcttggccaagaggaccccagagaaaactgaaaagctgtttctggccctgaaagaaagggaggtcagacacacctcatcatacctcctctgttttggagtttggactcaacaagtaaccagcagcggtgttaaaatagagatcctaagactgacagaacagaccctgtgtggccataagataacaaattatgaacaagccctaaggccatgcaaagcaggtgtaagtcaggcctgcaggccatcaggcttgctaaccagggcattttattgtggctgactctgacagagcattcttaccttcctttctgtcaactctaagcagtagacagggccttactcctttaaccaatcacaaaccagagaatccccaagtccacctacaacctataagacctctcctgaagataatccccctttttgaaccgaaccagtgtataccttccatgtgttgatgtctttgcctgtaactcctgcctccctgaaatgtataaaaccaaaccaacccggccacctcggaaccacttactcaagccttcttggttgcgtgttttctccaggcctcagtcactcatattggttcagaataaacctctttaaaatatattacagtttgttttatccattaacaaagtcaagcaattagttcttagatctgcaaatataactattactgcactaaaatagattaatgaaagaggatatactagataaaggaagatgaatagcacaaaatgtggcacatttgtggaacacagaaaagggattctatgagttagccagttaaaataactaaggccatggccatttcacatcccaggtccagaatttgaaagatcaaagtatctccataaaaaaatatatattttccccttcatgcttgaaaatgcaataggcaatgttatagtaaagtcaggaaacatgagtctgtcttatttcgtttcggaccctgagttggctgtttcacatctttcaaccaattcacaggtgtgactttaactatcactcataccctgtacttttttttttttttttgagatggagtcttcctttgttgccaggctggagtgcagtggcgatcttgactcactgcaacctccaactcccagattccagcgattctcctgcctcagcctcgcaagtagctgggattacaggtgcatgccaccatgcccagctaatttttgtatttttaatagagacaggctttcagcatattggccaggatggtctcgatctcctgacctcgtgatctgcccacctcagcctcccaaagtgctggaaataaaggaatgagccactgcaactggctgccctatttacttttaaatatatatttccagtccagacttttcttccacgcccatacttgaatattcatgcatcttctgaattgtttccacttggatttttctcagacacctaaaattcagcctgtcatcaattctatccatcattcttccaaatcctcttcctgcccctgagctccgcctccaaatgcctagcagcatcattccctcctgacacttccttcttaccacccccccacctatgccctcctgccacaattaagcctcttacaccagatgagctcttttcctttagtgacaccactggcttctagggtctggtcagctgtccggcaggatgcagcataacccggactggcccagcatgaaattcgggtgtggtgttttgtgcagcaacactcacaggagacgctgtcctctgcccgtcacagcagggtacatgtcagctgtccctcccaggtgatgctacatccagtcatgggggaagaactgtcgccagctgctcctgcgtaagtccccctcccctttgtaactggtggtcctaggagcgtgaatatcctgttccccaacagcccttaactcaatggctttggcacccgagttagttgcctgtggctgctgtaacagattaccacaaacaacacaggtgtattctctcccagctctgtagaccggaagtccaaaatgggtcacaccgggccgagatcggtgtcggcagggctgcattccttctaccagtgttcctgggtacatgtgtggccctttcctccgtttccaaaccccatccctccaagctccgcgtccatcactgcatcccctcctcaggctctgaccctcctgcctccctcttaaaaggaccctgaagatcaccagggcccacctggataatccagggtggcctccccatctccaggtccctcacttagccacatttgcaaagcccctcttgccatgcaaggggacctgtgattacaggttctggggcttaggacaggcacttgccttggggatgctattcagccgacttcaacatccgctgctgatcttcacctgaatgtgttcattccagggggagtgcacaaatggggactttcaaacccatcgcctctcccatgttggctggattgttctaggaggaagtgctccctccttctagggccgccatggactatactgttcatccaatgctcttcatcctgtctcaaatttggcctccagagccccttccacctggcctttttggcctgttgaggcatccccgtctgtcctcaagtgcatccgctctcctggcgcgacgcgatccatactctagctcatcctgtgcccacctccacccagatctggacttaggccccatcgtgccgcacaacttcggaaaccacccatgtgcctgtgtgcttgggtagcaccaatgttagctcctttcagtggttagagacagaaaatggattttttttgaattatgagttattgctgccgcttccggtccaagcacaagcccccaggaaccctctttgtttcccgttccacatccctatctcccgcctcccagcgagagaaagagtcctggttccaaggaggaccaccaagctgctgggggtgaccagcccttaatccacagacagtggtttcagacgaccacagcagcgctgctgctgcgacaaaaccggcctgcgacgcggagctgcgggtccccacagccagaggccccttcgaaagccacttccattcttgtttccatctggtgttgctgtcaattgttttaggttcattgattcctgtttgaattcaatgttcaatttttttgtgcttgtcaatttaattctatttctgaacgtgtaaacatttacgtgtttcaaaagtcaacacatatgtaaaggattctctgacttctcactccacccagtcctcccacctggtggttatttatgtgtgtgtgtagtttctgtatgtagtttacatgtgtgtgtagctcatgtgtatggtttatattgtgtgtacagtttgtgtgtgtggtttatgtgcatgtgtatactttgcatatgtagtttatatgtgtgtagtctgtgtgtttagtttatgtgtgtatagtttgcatgtgtagtttatatgtgtgtagtttatgtgtgtatactttgtgtgtgtggtttatatgtgtgtgtgtagtttgtgtgtgtatgatttatatgaatgggtagtttgtgtgtgaagtttatgtgagtatagtttgtgtgtgtggtttatatgggtgtgtatagtttgcatagtttgtatgtgtgtgtatagtttctgtgtgcagtttatgtgtgtgtggtttgtgtgtgtggtttatatatgtgtgtagtttgtgtgtgtatcgtttatatgaatgtgtagtttctgaagtttatgtatgtgtagtttgtgtgtgtagtttatatgtgtgtgtagagtttgtgtgtgtagtttgtgtgtggtttatatgtgtgtgtagagtttgtgtgtgtagtttgtgtgtgatttatgtgtgtgtagtttatgtatgtgtagtttgtgtgtgtggtttatatgtgtgtgtatagtttctgtgtgtagtttatgtatgtgtagtttgtgtgtgtggtttatatgtgtatcatttctgtgtgtagtttacatgtgtgtactttgtgtgtggggtttatatgtgtgtgtatagtttgcatgtgtagtttatgtgtgtgtactttgtgtgtgtgatttatatgtgtgtgtatagtttgtgtgtgcagtttacatgtgtgtactttgtgtgtgtggtttatatgtgtgtatagtttgtgtgtgtagtttatgaaagtgtactttgtgtgtgtggtttacatgtgcatgtagtttgtgtgtgtagtttatgtgtttgtgtatagtttgtgtatgtggtttatatgtgtgtgtgtggttcgtgtgtactttatgtgtgtgtactttgtgtgtgtggtttatttgtgtgtgtatagtttctgtgtgcagtttacatgtgtatactttgtgtgtgatttatatgtgtgtgtatagtttgtgtgtgcagtttacatgtgtgtactttgtgtgtgtggtttatatgtgtgtatagtttttgtgtgtagtttatgaatgtgtactttgcgtggtttatatgtgcatgtagtttgtgtgtgtagtttatgtgtttgtgtataatttgtgtatgtggtttttatgtgtgtgtggtttgtgtgtagtttatgtgtgtatagtttgtgtgtgcagtttacatgtgtgtactttgcgtgtgtggtttatatgtgtatgtagtttgtgtgtgtagtttatgtgtttgtgtatagtttgtgtatgtggtttatatctgtgtgtagtttgtgtgtgtattttatgtatgtgtgtagttcacaggtgtaggtgtagtatgtgctgtgtgtgtgcatgtgggtgatttgtgtgtgtatagtgtgtagtttatatgtgcatgtatagtgcatgtatgatttgtgtgtataggttgtgtgtgtagtttatgagtgtgtaatttacatatgcatgtgtagtgtgtctgcctgtgtgatttctgtgtgtagtttatatatgcctgtgtagtgaaggaatgtgtgatttttgtgtgtatagttgacgtgtgtggtgtgtgtgcatgtatatgatttgtgtgtgtgtggtttacatgtgcgtgtatggtgtgtgccgtgatttgtgtgtgtgtggattatgtgtgtgtatgatgtgtgtgatatgtgtgtgtgtggtttatgtgtgtatgtggtgtgtgtgatttgtgtgtgtcgtctccatgtgcatgtgtggtgtgtctgatgtgtgtggtttgtgtgtgcggtttaagtgtgtgtgtagtgtgtgtgatttgtatgtggtttacatgtgcgtgtatggtgcatgtggtgtgtgattgtgtgtggtttacatgtgcatgtgtggtgtatctgatgtgtgtgatttgtgtgtgtggtttacatgtgcgtgtgtggtgtgtctgatgtgtgtgatttgtgtgtgtggtttgcatgtgcatgtgtggtgtgtgtgtgtgtccccttacatccccttctcacccacctgcagacgccctcggcgctgcacctgccacaatgagcagcctgtctgtcctcccgtgctccgacaccctgagttctccccagtccccccaggccccctaggctccccaggttccccacggccacatgatgccccgcgctgtggctgttcccatttgcacagccctgcctggtgaatgagcactcaggtcgttcccagtgtctcgctgtgacaaatgaggctgtgctgcatccctcaagcatgcactgttccctatttgcagaggtgtcacctcgggggaaattcctagaaatggaatcgctgggtcaaggggcaaagccagtgtaattttgttagctactgccaccttccgctccctcgggtgaaggacagtttccctcctagtgtctgagggagccagtttcccatggcctcctccaccgcagtcacgcttttgaatcgctgccagtctgatatgtgagaaactgcatctctgtgtagcttgtatttgcatttctttactacgagcctctttccctatacttcagagccatttgtaatcttgttctacacactctgtccatggattttacctacttctctgtagagtttccggggttttcccattggcttgagtgagccacgcacacagggagccagaggcaaaggggacgtgagacctgcccacgggaggatcaaggaggccccacagacggcctggggaagcccacccagctgggagacagtgggcgcgtcgccttggctctggaagcagtgggaaaagcagaaaaaggtcaccccaggaaattccagtcacaagcccacctcaggggcagtgtggccagaactcacgctcactggatgactggaaaaaccctaggccaaaaatttagtttgagggagtcctggcaacccaagcttctgggagaagcaaaggcaaaacctttccagagaaaggcgttggaaacttggacctcagagaatcctcgcagacgggggtccggggaacgcagccttgccaccttacaagttacccacacgcaggagaaaatctgccctccccaggacaggagccctccgcaacggcgtctgggaaacgtcaggtccactctgccagccacaaggcccctggaagcagcgtggcctgggtgcaaagcagccgacacctcacccgcgcccctgggcctcctgaggaaagaaagccccaggtccccagagtgcctgtgcggcccctcatctccctgcatgacagcccctttggctgtgacctgggggaaagaaattgaatcccatcatttgggactttcacttaaaactcaaagttctgagctttgtcttttaaatggtgagggcaagaaaatgcattttcactttaaagtctagcaactgtaattggcaagggcgtttgacctacagacttcttccatcaagtaatacaggaatggaagggccccccacgtttgggccactgtgtgtcacagtcttgctgtcaccacggcagtgctgcaatgtcgtgtgactgtgcagtggacaccgcttggggccgtcatgtgtcacagtcttgccgtcaccacggcggagctgcaatgccacgtgactgtgcagtggacaccgcgtggggccgctgtgtgtcacagtcttgccgtcaccacggcggagctgcaatgccacgtgactgtgcagtggacaccgcgtggggccgccgtgtgtcacagtcttgccaacgccacggcacagctgcaatgtcacgtgaccatgcagctggacagcgcatgaccgtgcagctggataccacgtggacggcgggtgggaggcatgagttccagctttggcacaaaggagctttgcgtcagtttcattaatcctggtgtaaccgcccagtgtgttcacctcgccggctgcctagacacagccgatttatcaagacaggggaattgcaaaggagaaggagtaactcacgcagagccagctgtgcaggagaacagagttttattattactcaaaagggtctccccgagcatttggggatcagagtttttaaagataatttggcaggtaggggctcagaaagtggggaatgctggttggtccgtttggagatggattcatagggggtcaaagtgagtttttcttgctgtcttctgttcctgggtgggatggcggaactggttgagccagatgactggtctaggtggtgtcagctgatccatgagtgtggggtctgcagaatatccccagcactgatctcaggttttacaatagtgaggtgatccccagaagcaatctggggaggttcagactctcacagccggaggccacaagacccctaaaccataatttctaatcttgcagctaatttgttagtcctacaaaggcagactggtcctcaggcaagaagggggtctattcgggaaagggctgttaccaattttgtttcagagtcaaaccatgaactgaattccttcccaaagttagttcggcctacgcccaggattgaataaggacagcttaaaggttagaaggaatatggagtcggttaggtctgatttctttcactgtcatcatttcctcagttataatttttgcaaaggcagtttcatggggggtaaacccaaacggccccctgcagtcctgggagtggcttcatgaaggggaccacgacagttctcctctccctaggggcggccccccagctcaccacaagtgtgaccacgaggcccttgggtagggcaacaaaaggccggggaaggtgggggtgtcctccccaactcccaagcctccttccacgtggagaaaactgacttctccgacccctgcctctctcccaccatttgtcacccacccccacgcagggaggggttggcaaatccaggcggggtctgcagggcaggctgagctcactctccgctgccacctgcaggggtggcctgctctgctgaacaggtgggggctccctggaggctggcctgggctgttcctttgggcaggtgacccctccactctggggttcagggaaggcccccttggccttcactctgagccgtgtcctccgaccagcctccattgggaataacgggcagcctggcattacagcctctgtgggcccctcctctgggctaaagtattacaaatgatgtttcataactgcgttggtagaaagatgactatagcccaggctgcactgtgtttattctgattttagaaggcattaaaccagtttcctgatgcctaaaagtctcctgggccctggcactaagcctgctacaccctgtgaaaggaaaatccatctcagtccccaaaattaccaagccaagggaagagtcaagctgggtactgctcaggcaaacctgcctcccagtccactcctgaataagatggctacagagactaaaaagccactacctccctcaaaatttgcccacaaggaaattcctcatagacaaatgacagacaggacccaacaccatccctctgctcccctgagacaaatccatatctgatggcttcctctgccctattgttgatataaaaatacagattccctgagccagactaaattgtgtttcagtgggaggccgatcacggtctcaaaagaatgcaagtttgtctcttacctacttatgacctggaagtcccccacccccgcaagttgtcaagctgccccgccttacctgacccaacaaacgtacatcttacacatattgattgatgtctcatgtccccctaaaatgtataaaagaaagcatggtggctcatgcctgtaatcccagcactttgggagaccgaggtgggtggatgacgaggtcaggagctcgagaccagcctggccaagatggtgaaaccccgtctctactaaaaatacaaaaacttacccatgcatggtaccatgcgcctataatcccaggtactggggaggctggggcagagaattgcttgaacccgggagacggaggttgcagtgagccgagatcgcaccactgcactccagcctgagcaacagagtgagactctatctcaataaaataaaataaaataaaaataaaagcaaactgtaccctgaccaccttgggcacatgtcgtcaaaacctcctgaggctgtgtcacaggcccttacttcaccttggcaaaataagtgttttaaatttattgagacctgtctcagataccctttggtttacaacctgatggaggggttggcattgatagaagggttttgggtttccagcacctgccttcatgccttacttctcggtgggctcaggactcagaatggaaaagagtcccaggagaccccagtaactcttcaactcttttactctcactgttttctctcctttacagcagacaccactatctgcaaagggtcctgttcgctgctcctgcctgccagtaagcacagcctagatggcagtgtccatgactgtcctgagtaaccactgggtccccagcatctcagcttcacagctgttctgtaaagaccttcagacggagggatgaggcaggtgggtgggtggatggatggatggatgcatggatgtgtgggtgggtggattgatggatggatgcatggatgggtggatgggtggataggtgagtgggtgggtggatggatgagtgggtgcttgggcaggtatgtggatagatggaagtatgggtagatggatgggtggatggatgggtcaataggtggatgggtgggtgggtgaatggatggatggatggatggatgagtggatggatgcatgaatggatggatggatggtggatggatgggtgagtaggtggatggagagatgggggaatggatggatagatgaacaaataagtgatggatgggtgggtgtatgtatggatgggtgggtggatgggtgggtgggtggatagatggatatgtagatgggtggatggataagtggatggatgggtgaatgggtggataagtagatgaatgggtgggtggagaaatacatgagtatgtggatgaataggttacagagtaaaatgccaccaccagagcagtgcaacagtgtgctttgcactcagctctgccatggaaaaagtggttccttcccaggctctcaccaggctcacatgggctccagacccctgcacccccaaccagactggggacacagggaccatctgctcagctctgcatccatgcacctggtcaacaccaagtgagtcacagggaaccaggtggcctgagagaaggacccatgacagatggcctcagccatgtcgctaggaggcttgggtcccagtcctgtggccccaccagccaagagcttgtggacattcagaatcaggcttgctggtttaagcccgggcatgcagcaccaacactgtctgcccatgggctctctgggtcgggccctgcctgactcagtccctgcatcaccagtgccaggccaggcacagacaggctcagtggggtgggctaagtagtgcttgggagccaaaccaggcatcagagggattgagatgcccccaggctgactcccactcaagcgggtccccacacctccccccgagcccatcccctctgtccacctgctgccactctgacagctacaacccacccaggcttggggctgcctggactctgcctataacttcacaggctcactcccatgctgtccttcacacctggagaagtgccaaggttaccagtgccacagaacaaacagccgcatgcactctgcaccctgctcagccattgagacagcagattctgtagctttgggcagttcccacatccttccagtcctgatctttcccctggaagccaaggagtgttcagtgccttctctacgtgctcttggcccctgtccacaacaaaggccacaggtcccttgttgtggaactatgagtgaacccagcgttctccccagggaccccagcacaaaacgagctctcaacacacatgagtgaataaaactgtcccagaaagcgggagactttacacagtggctacaatgtccctagtacactgctacagtccagaagggagagaaggggctgtgcacaccaggaagccagaagcccacatgcacctgcccagggtctgtgcatggagctccggcaggtcctatctcttggccttcagaataatgatgtaaatacagggacaaagatggagcaggtgtcactcaatgtgcaaactctcccccttcttctggtgaggccagaagtacctaggtaggagcagaccctacctccgaccacctccctccctgcaatgggaatagcagcccaatccccaggctgtagggatccacaggctatgcaagtgtggctctacccccagcatgccctggtgcgaagctgtgcccagggagatgttatctgcaccccagactgcctgtggtgctgcagagtggtgctgaggagagagcagggcacacctggagtctatatcacctgccttccctagggagtcttgggccctctccacattcaaggcgaggggagcagaggatctccacgaagaccccctgagcacatcccttctctttttgctgatagacaacccaaggcttaaggggttttggaaccaagacatggtcactgacattagaggaatggctcgctctccctcctgcatccctacctggtaagggggggcaattgaccctttccaaagcaccctggttgctgtaggaaggagaatggagacatcaggctgagcccactggcctccttcagcgctcgggctctcccctgcagacagccttcctcagcagccgcacagctcagggcttctcctccctgggtgccagtaagcccaggtaagcctctggctgcccagcaattccaatacccagagggaggagccaacagtgcaggccacgttctcaccaagccatctgcagaggggtcaggtccaccctgagtcctcccttctcagtaacaagctgctgctgtgttttccattgtcctacagctgatttgccagtcggtgcaatcacagcgaggacaaacactaatgcccctcctgagacctctcttctggctgatggtgtggaccttgactccacagcaggtgtctgcaggccctccagctggccctcggtagcctggagtggctcgtcctggacagactcacctctatgacgcagggggaactgccaggagtccctgagcgaggtgatctgagaaatgccatggcagtgttctaagccagcagcctggcttacccacaacctctccgctgtgtgaccttgagcaagtgccttaacctctctgagcctcagcttgcccctctgttaaagaatgatcatatatgacacctagcaaggttatgtggagtatcagcaacaaggaatccactgcagccagtggtgcaggtgcaactggctggggctggtgtcacgggtggtaaaagaatttaccgagacagtcatgggtaaagaaagtctgaagacaccttgcaagagaacagcaggcagcatggcagagagaaggccacctccccaggggcagaggccagggggaagtttgatagggtcacactggagaggcgacatgcagacagggtcatgctggagaggccacatgaaaacagagtcacgctggagaggccacatctggatacggtcatgctggagaggcgacatgcagacagggtcactctggagaggccacatgcagacagggtcattctggagaggccacatgcagacagggtcactctggagaggccacatgcagacggggtcatgctggagaggccacatacagacagggtcactctggagaggccgcatgcagacagagtcatgctggagaggctacatgtggaaacggtcacactggagaggtgacatgcaaacagggtcacgctggagaggccacatgcaaacagtgtcacgctggagaggcaacaggcagacagggtcacgctggagaggccccatgcagacagggtcacgctggagaggccccatgcagacagggtcacgctggagaggccccatgcagacagggtcacgctggagaggccccatgcagacagggtcatgctggagaggccccatgcagacagggtcatgctgctggagctaacgtgcagagctaggtatttggtaacaggaggttgtacaagcgggctgcttgtggttatccatttcttagaacaacggctctcccccaccctagttcatgttcttgccagctagggcctgtggtgccatggagttgtgcagaggagggaaccccttcctcatttctatcagctgatcgggactccacagtttggtttcgctgcatatgacaatcccagcaaaagaagcataaacaagaaagaagctgatttctttctgaagggagaatctggggatgactgattgagggtgaggtggcagctcctcgatgtcctcagggacccagatcctggctgtcctgctcctcatcctccacgcatggtgtctagcctcaaagccactccatggtccaaggtagctgctggtgctccagccatcaagaccacaggacaggtggaaggaagctggaaacgtacagagcagaaaagggcccctcccagaagtcccagctgagtcagcttgtttttagccatcttcctggaagtctcctatagcacttctgcctttaacccactggccacgacttagcagctcagctccacttagcgtcagggaggaagctgggagatgcaggttttcattccggccagctacatgccccgccacgcatcagggttctgcttccacggaggaagggaagaggaccatgtctgtacaagaggagctagacccacgataaacatgagccacgctaatgttgtcagcatccccagaacagccggcaacacagccttgcaccgcagcctagagagggagccagggtgcaaaagggacagaaagggagagaaccagaggccaggctgacctgagcagccagggacagaggacagacccaggaggcagatgggagttcagggcaaggaaagtcttgggggctgcctggggcagggggagggagatgtggggggcagaggtaggggtgagctgcacctgggagggaacatgcaccctcttcctaaggagaccctgagaggcttaggggagacggtagcatgcaacagcacctgctgctcccctctgcaggaggccgactccacggaggaccatgctctggcagaggaacccaaatacacatttctcccacacctcagcctctcctggccccaaggcaggtacaggctcagagctcgggaaccggctggagactttcctctttttgctgactctgccctggcatattctgaggtacaggggtcaagacttcaacacatgaatttgggagtcacagttcaacccagcatgctatacagatctcaagggtgtcactcagggagttgacaaaggcagactccaccaagataagaacctgaccacccccgagatatgtgctcatcagtccccactgcaccccctccagaggcgacttttcatcgcagatcagcatgacctgttctagagcttcctacaggcagagtcaggccacactggcccgccccagctctcagaggcccgccatcactgtgcacccacacaccaccagctgtaacccatgcacaggacctcaaggtgggccggctcagctgccaacaggagccagtggtgcttagctatccagcagggcagcacatggtcctcccaggagccgtggcccagcacctcctggccggaacagccatcctattcaaataaacgagtaacaaaaatgggcatgctctccacttccaaaagcaatgctagccaggcacagtggctcatgcctgaaatcccaatgccagagacgttggaaccagagcaactccatcttgaacaggagctgggtaaaatgaggctgagacctgccggcctgcattcccaggagtttaggcattctaagtcacaggatgagataggaggtcggcacaagatacaggtcatgaagaccttgctgataaagcaggttgcagtaaagaagccagccaaagcccaccaaaaccaaggcggccacgagagtgacctctgattgtcctcacggctcattatatgccaattagaatgcatttgctgccaaaagacacccccaccagcaccatgacagtttacagatgccatggcaatgtctggaggttaccttataaggtctcaaaagggaggggaggagacctcagttcctcttcatccctttactttcctgataaacttgctctcactttactctgtgaactcgctccaaattctttctcgcatgagatcaaagagacctctctcggggtctggatcagagcccccccttttccagtaacaccagcactttgtgggaaagacagaggtgggaggattgagtgaggccagaagttcaagatcagcctggccaacataaggagacctaagtgcctaacttaaaaaaaaaaaaaaggccaggcatggtggcttacgcctatagtcccaatactttgggagaccgaggtgggcaggtcacttgagcccagcagttcaagactagcctggacaacatcgtgaaaccttgtctctacaaaaaacaaacaaacaaacaaacagaaacgaagaaattccagggcacaatagtgtgcacctgtagtcccagctattcagaaggctgagatgggagaatcgcttgagcccaggaggtagaaattgcagtgagctgagattgcgccactgcactccagcctgggtgacagagggagaccctctctcaaaaaaataaaaaaagaagcccaggcaggcatggtggcacgcacctgtagtccccagctgctcaggaggcagaggcagcagaattgctcgagtgcaggctgtaggtcaaggctctagtgagttacgattgtgccactgcactccagcctgggtcacagagcaagctgcagtcttaaaaaataaaaaataaaaaaaataaaagcagtgctattttcctacaaatgaagaaatctcatcagacaaatactgccacaaaccagatgaaaatcatgatctaatattccaacaagaacttcagctccgaagggatactatagcacagaataagaacagaggagaataagcacagaataagaatgcagggaagaggtggccaaatggcagcggagtctgtggtaggaaatgacagaattcaagaaggaaactgaagaaaaagacaaaaccatttcagaaatgaagaaatgaagttacaggtaatatgagagcacagacaccacgaaaatcacgtaaaaaaggaaaaagtgagcaaatggaaagaaagaggaaagagattaaaaaggaggcctcctgagtagctgggagcacaggtgtgcaccacagcacctgctgaacaaggattgaaactatcattcaagatctctttattgaaatgcaggcagacttgcgcctgcctgtaaaagtgcatgctgtatacttgtgtgtgttggcccagaacagtcaacacaaaacatgcctttgtaaagtcactggactttaaagataaagaaataatcctttaggcagccagacagaaagaccaagtatcttataaagcaaagaaaaccaacttggcatcagacttctccaaagtgacattcaataccagaagaaaaaagaagcaatgcctccttatctagaatttgtgggtagaattctgtcccccaaaaaggtatgttacactttgggaaattgaggtaagtggatcacttgagatcaggagttcgagaccagcctggccaacatggtgaaaccctagctctaataaaaatacaaaaattagccaggcatggtggggtgggtgggggcgcctgtaattctagctactcgggaggctgaggcaagagaatttcttgaacccaggaggtggaggttgcagtgagccgagatcgcgccactgcactccagcctgcgcgacagagcaagactctgtctcaaaaaaataataaaaattttaaaagatatgttaaagcctcaacccctggtacctatgaatgcaacctttttggaaatagggcctttgcagatataatcaagtgaagacgcagtcacacctgattggagtgggccctgattcaatacaacttacctccttataagaagacaaaaaaggccgggtgtggtggctcatgcctgtaatcccagcactttgggaagccaaggtgggtggagcacttgaggtcaggagttcgagaccagcctggccaacatggtgaaatcccgtctctactaaaaacacaaaaattagccagtcgttgtggcaggcacttgtaatcccagctctttgggaggctgaggcaggagaatggcgtgaaccagggaggcagagcttgcagtgagcagagatcatgccactgcactccagcctgggcgacggggcaagactctgtctcaaaaaaaataaaaaataaaaaatagaagatgattcggctcatgactctggaggctgggaagtccaagtttcaggggctgcatctggcgagggccttcctgctgtgtcatcacatggcagaaggcatcacacggcaagagagtgtgagagagtgagagaacacatgcccagcctcgaggccttttgttacctgcatggatcatccatggatcatcctaaacacctccccttaggccctacctcccaacactgttgcattgaggactgagtttccaacacgtgtttttagagggacacattcaaatcacagcttcccccctccaccacccattttaatcctgggctttgcctggctccaattcctctcttatgtaaagcaatggatcagacacacagccttgggggatctgtgagaactgaagggactgaggcttctctcacacagaaccccaaaaccctcccatgcctccaggaccctcagcagggaagaaccccacctaactcagggcccaatcagaggcagggccaagggttatccctgccctcagactggttttcccaggctagggtctgagaaccccgagcagccagtccttcttcccatgagatgcgactgggcagggccagtgaaggaacccagaggcatgttagtcaaagcaggtttcaggctctgggtgaggggtcctgcatggtgagaagctgggcccacctcccacagagcccacagaacagactcaaactcagacaccaacaagaagatgccaaggctggggagggcaggcccagcccacagagtttctgcaagaactcttccctggctgtggtcggagcagctactcaggaaatccctggcagcagagtgggtgccccctccgggcaccaggaggagaggtgtgcaggggggattccgggtcagccattgggatttgagactcgcctggacacccacttccacttctcccccaccaggcgtttctcccatcagggaagaggaatgctcagatgggcccagaggccatgcagaaagaaggaggcctcccccggggctgagaaggcagtgatgggaggccggccccaggcttggggtgtgggtggtttcaattggaaaattttataataaaaaattggaagaaagaatgtaattccctctacaaaaatatgtcctcatgatgccacgtacccacctacacccacctgaccccagtggcctccttccacagccagccactgcaaaggaggccagggaatgtgtcttcctggtgcccacaaaagagacagagctggagggcatggggacccaaggttccaggcttcagaagggaaagcatccacagcgatcccacagtaaggacagcctctgatggcagcccccactggccaaactacatccccctgggcagagtgcaccgggcctggcttccctccatgctggttccaactcacagccggggtgaggccagggcgaggccaggtccgcccttcacggggaaggctccctgggtgcttccctggtcagggctgtgcattcttgtcaccagtccctccctgaccccagtgactctggctgggcctccacccctgcccagacccaccccaccacagaagaccctgacctaccattcactcttttttaaatattttattttttcagagacagggtctcactgtgtttcccaggatagaatatagcggctgttcacaggcatgatcatagctcactgcagcctggaatctctggcctaaagcaatcctcctgactcagcctcctgagtagctacagagccacaggccacgcccgtctctcagcattccctcttttactttatttatttatttatttatttatttatttatttattttgaggtggagtttcactcttgtcacccaggctggagtgcaatggtgggatctcagctcactgcaaccttcgtctcccggattcaagtgattctcctgcctcagcctccccagtagctggggttaaaggcacctgccaccacgtccagctaatttttttatttttattttatttttttagtagagatggggttttgccatttaggccaggctggtcttgaactcctgacctcaagtgatctgcccacctcagcctcccaaagtgatgggattacaggcatgagccaccatgcctggctggctttccctcttgagcacatgcaggtaggcaggaatcccagccccctttgcagatgagcaaactgagacacagagaggttcagccacctgcgaaggttgcacagccaggatccaccgccttctcgcagcacccaccctcttcccaaggagtgcccagttcagcaaggcagatgacaccaatcccaactgggcagccaggttttatgaggccaggacaaacagcactgatttgaagcctcgtagaggggttcaaatcacaggccctgccacaggctggcctcagggtcctgggggagctgtgggcatgcttctgagccgtagctcctctatccacccaagggagctggtagcactggccttaagagtgtgctgtgagcccggggggttgcagctgggcattgaatgattcctaccaccccacaaataccactctgcccctccaatgggggcaacccctcatggcctgtctcggcagcgtggaagttacactctattgcgtcacccccaggaagatggagagaggcccccaggacctcatgagggtggttttctgcataatgagatgccttggatattcctaaaggtccgagcctaggcctctgtcagcacatcagtgaatgcagccctgctggacaagctcaggaggactccaggatcccgagtgacacattccacatccacacaggcagactggggcctgcaattacagatgggaggtcccaaggtccagtcgggggctcccacatgttcccaggaaagcaccaggcagggagggtggtgggtagcagttctgggctttgctcctcgccaggccccatttcttcatctgtaaaatggggagaaaatattttcccttcctaactgcattggaaagacgagataagcagctgactggggaaggtggaacttcccactctagcaatattgggcgaaataagtgggttcagagactgagcagtggtgctggccccagacactggtgtggatgcaacacgtcgcaggactcagcccgtcgaacccctgcctgccgctgcactgatgcccccttccccctcacagaggcctgatgcccggccatcctgatggcgggagctcccctaggcctccacagccgtggtccaaacgaaccctgcactccacaccagagctcctcaccactggggcaccctgggctgccctcggggctggcactctcggtggtgggggccgtcccacacctggtaggatgctgagcggcacccccagcctccacccactagacgttggtagcattcgttgtgacaaccaatttatacctaaacattgccaatactgcccccattggagaaccaatgacgggtagtctagactgtccatgtcaccttctcttagtccttccccagactgggacgtctcacaaccaagtccttgtcccaccccactctctatatcccggcatccagcactgccccctgctgagggctcggccaatgtttcctgaatgaatgagtggtccctggatgtgagcatgggtcacacacctcatggtgattgggtgggggtttctcatgagtagagggacccccacatgccagggctgcattgagcagggacgtcagtgactccctctgtgaaggcggccacttgaggcaggattctaggagcctttgtcacacctggcagtgcacaggatgattcagagagaggctgtcccaaggcctcccggctcactggtcgcagtcttccccgtcctcccgccaccctccacacagcaccactgccacccacatccctgctgggcaggagaggtggtcgggagggcagacacagggcagtgggcgagtctgatccaggttttgtgaggcctccctataaagaaagaatacaaacttacaaaaacaaaattaggtatgacagtgaatatttctttaggatgaggaaaaaaaaaaagcaaacatacaaaatccagaaaaccaacatcgtgtttttacgaagggcctgctccatctccataacacttcttcttgaactttttggctgcgtactttttatctatctcattgtttgagaattttacatcacctacgatagaaggaatagaaacataattgctcttcctccagcatggctgattgaaatttgttttttcttatttataattagaacacatagaacagatgacttaacacatgtgcacacagctttgcagtacagctagaggtctgtgtacgttaaacaacaagttctgatcaattctatttacaagattcctgtttgcaaaaggaagcaggccaggcatagtggctcccacctgtaatgccagtactttgggagcccaaggtgggcggatcacttgagcccaggagtttaagaccagcctagccaacatggtgagatcctgtgtctacaagaaaaaaaaaaatagctggatgtgtagttccagctaattaggaggctgaggcggaaggattgcttgagcctgggaggttgaggctgcagtgagctgtgactgccctactgcactgcagcctgggcgacagagcaagtccctatatcaaaaaaaaagaggaagcagcaatgctgggtgcacatttgtaattgtatacgatgcatttatcaacagaccatttctgctctggcgaggccctgatgagagctgaatactctgcttacaaaggcacatgcccgaggaccgtcagagggtccaccgggcgcttgggctccgtgtgtttcagaccagcctggccaacatggtgaaatccgcatccatgtgcggtgcagagcatggcagggtgcattctcctcctcaccgtctctcccaagcaccttcaggtcgtgatgccgaagaaaccatctatgcccaggtcttaatccataaaggtgcctaacagaggtcaacgctattgaaaggaaagtctaacatcgctcttgaaacattcgctagaaatgagagacgtggcaggccccgcagggcggcagggggaagccgcaggcagagcaggaggcagaaaggagctagggaaaggccaagccacagcctgtgttggcttccctgtgaaagccgggcagagcaggggagacagcttgggacgggctgatttgtctgattctgggttccggggctgtcccttgtggtctggttctgggcctgggttgacactgggcagggaaatattggctgggggtacagaagatgaaggaagtggtttggagcaggggctctgggcaacaggggaggtgctaacagccctggtcaggaggttggccctgtcatcatgactgcaagtactcaaacacagcatctaaggaggcacagatcaaggacgaagccagcaggaaggtcagtggggatgagggggacttgggggtctttcttcctctgcctccttccccttcccacaccggaaggtaaattgtgttcttctgtgaaagtcacaagaactctcagacacccagagagttcacacacaaacacaggaaaagacacaagtcgtatgaccatctcaacagatgcagcctagtgtttgatgacactcactgtctgttcttaaggaaaagctcagccctctgggaagaaaagacccattgttaagctgatgaaggccatctatggaaaaagtcagagctgccaacagagctaacaggaaaatgttgaaagctttctttacaagattggcaaggggacaaagaatcctattagtgccactgctattcaatatcagcctggatgtggcagactgcacagtgagtcgggtagtttgtgaagaagaaagcaaaactgtctttattcacaaatgatatggttgtgtatgcagaagagcctacataatccacaaggaaattctgaggattcagaggagtttagcaaagttgttgggttcaaaatccataggcaagattccattttcttactatatattagcaacaatgttggaaaaataaaatttataaaaagacataatagcacaaaatatcaagaatctaagaataatgtgcaaggtcactatacagaaatgttattagtaggcattaaagatggtctaaacaaatggagataccatgttcatggattagaagactcaaaatgaattcttcccaaattaattaattttttccaaattgatttgtagaactaaagaaattgctatccaaatcctaaccaggtttttgtggaacttaaaatacttaccctaaaatttgtgttgttttcgtttttgatttttttttttctttttcttcttcttcttatattgagacggggtttctctatgttttccatgctggtctcaaactcctgggctcaagccatccacccgcctcagcctctcaaagtgcttggattacaggcatgaagcacttcatccagactaaaatttgtatggaaatacaaattcaatttgacaaatatttggccaggcatggtggctaatgtctataatcccagcatgttgggaggctgaggcggatggatcacatgaggtcaggagtttgtgaccagcctggccaacatggtgaaaccccgtctctactaaaaatacaaaaattagccggaaatcacttgaacccaggaggcgaaggctgcagtgagccaagattgtgccactgtactccagcctggtcaagagagcgagactccatctcaaaaagaaaaaataataaataaaaaatatttattgagccccttagtccagggactgcttctggtacttgggacgcctctaagaaccccacccacaaagacccttcttcgtagaccttagcaggagagacacacagtaaagagtaaacacaatacataagcaaagtacccagtatggcaggaggtcataactgttttgcaaaaaacaaagactacagaggggagggtcaccaggacatctaggggcagaggtggggtgagaatccaaccttccacacgggccatctctgcgacccatctctgtgaccccaaccagaggccccttgccggtcatcctgttccagcttctgatgtcctgatgtagaagcggctcctccgcagctctgaggtgagaggccaagccctccatgaccccaaaaggccagggctccccaagtgttatccacaaacacacctgtggggactgcaggctcctacaaggcgcccttgcacaggtctcttgcagagcttctccacccactctctgggccctgacactgtgggagggtgcctgtccttaccccagccggatgtcccaccacactcctgcctggggacttctggcatgcaggagaggctggacacgcaggtgcagagaggcttgccccaacgccgttgcccgttttaccttgaagttcgtggttctttaattcttgctccaaactgtgagtcaacctttaaaatatatgatattgaagttctccttcagcctccagtctttcatcagagttaaatccagagatttcatgagcagtagatagatctgcagtagagaaaagtgctccaaaggtgggcgcacctggctcccatttggaggtgtttataaatgcttttatgtagacccctcctagatgacgaggaatggcctcagagcaaccctgggaaggatgaggaggggtctggggactccagacgaaattgcacagccacctaccgtgtgagtggaaacccatgctgcttctgcctggcctctaggatccgcattcaggggaagccgcgtccctgcggtcatgagacgtgattgttcagaccaatggatgcggctaagcagaatcatttcatttcccccgcacttgccaaaggcagggactttcctgtttgtccctgcctgatatgcaggaagggctcagaactacttaagaacaaatcaatgaacctatggctttatggcaaataccacagaaacaaccttataaatgggctgaggaggctgtctggcctctaagaaatgacctcatctctctgaaccttaatttcctcatcagtaaagtggcagtgcagcccctccatcacaggacgctccctggcagagtgcagccctgccatgcagcagccggtatgacctcgtccttgtgatcaggagggccctgctgaactgtttccgccccgcaggcgcctacgaaacccaggaaatgatgtggccttcctggagccatgcaatggctttgttgtcaccaggaaaagggcctgtggcacccgcctggccactcatgtcctaaatgagacaggccctcttcatcggcctcagtggctcattgagatgaggacttgggaattttgctgtttaacagagcaactgagcacccaggtggctgccccagcagactctggagacgtttcaggagacctggcagggacccaagcctctgccactgcaccagaccctggccagagggctgggctcagagccctttattgttttatttttattttttattttttagagacagagtattgccctgtctcccaggctggagcacagcagttgaaaccatacctcactgcagcctcgatctcccaggcttaaatgattctcctgcctcagcctccaagtagctgggaccacaggcatatgccaccatgccagccttattgttaaatgttttgggtagatcccatctccctatgttgctcaggctggtcttgaactcctgggctcaagcgttcctcacatctcagcctcttgagtagctgagaccacaagtgtgtgccaccacacctggccccagagccccttttaaactgcaactcacagtctccaagttagactcacacagagaagatctaaatatgtgtctccttgagggaggctgaggagtggaggaggatgaactcttacaaaacgtcaacctttttaaaaatatgttttcagtaattgctgttctgcgccaagttttatcctagtgggagtttcatgtcagaattactaagtaggagttcataacagagaagttaatcgcccttgtgtaggggcgaggcaccaagcgatgatctctgtgcccaggtaggtgttttctggatccacacaagcacaggagatggcaggtggggagtgggtggggggttatgaagggcagccgaggaggggcaggcggcagggggaagcaggatctctgacagtagaagggagtggtcactacgtccccaacacacccccttcacgtccccgctatagccacacactacggtggaaaggctccaggccagcccccatcccctcaggaccatgatgcgggcatctgcagaaacgggtgggggctgtctggcctgagaggcctagagccaggaagaggtggtttagagctgccctcctcctccaacttcagccccaacccccttcctcagcagcagatcccacctgagtctctcctaggcctgttctggatccgaagtgggtatgagacattcaccatctattcctttgctccaccatcaccagaggctttgtggtaccttatttttgagaataggcaacatattctaggactaggctgggaacaagggagaaattcatcatgcatccctccatttatccatccatccatccatccatccatcatccattctcccacctacccactcattccccatccagctacccactcatccatccatccatttgtccattcacctaccaatccatttatctatccatccatccccatccatccatccatcaatcattatcgatccatctatccactcatccacctatccacctaccaatccattcattatccattcatccctgtccatccatccatgtatctacctatcaatccattcattatccatccacctaccaatccattcattatccatctaccccatccatccattcacctaccaattcttatattatccatccatccccatccatccatccatccacccactcatccacctatcaattcattcattatcaatccctccccatcaatccacccacccactcatccattcatcatccatctatccccatctacccatccacctacccatccatccatccacctatccatccatccacccacccacccacctatcaattcattcattatcaatccatccccatccatctacccatccacccactcatccattcatcatctattcccatccatccatccacttacccatccatccattcaccccatctacccatccatctatccaccccaactacccatccgtccatccacccatccacctaccaatgcattcattatccatctatccacccacccacccatccattcatcatccatctatccccatccatccatcaacccacccacccattcagcatccatctattcccatccatccatccacccactcatccacccatccgcccatccatccatccacccacccatccacttaccaattcattcattatccatccatccccatccatctatccccccactcatccatccatccattcatcatccatctatctccatccatccatcagtccccacccatccacctacccatctacccactcatcatccatctgcctacccatccagccacccatccattcttcatctggatggacaaatcttcattgagcaacaattctgcgctgggcaacaggagacagagatgcaggaaacacaatctctgctctcagagaacatgctttccagggacaagaagacatggacagatggacagaagcaccaggtgaagacgttaggacatggctgatcggtggtccatatcctgtttggggaaaactgggggcctggggacgttggtctaatgaagagaagacttggaggaactggcatatgctgctgagaatgtttggtgcccaccataatacctgggaggggggagggaggacagaggggtgaccacagtgaaaatgtggagggatcagtggagagtaagcccagccattgaaggaatgtttaggtgaggcactgcagaagtcagctggacacaatcaggagtgtaagtgttaaagaaagaggaaagaaacacaaaacgcagctttggggctgacatatctgtggccggaggggaggttatctcggggctggcatgcctctggtgagggaggggtttggaatgtttctggtctgagatgttatttgtggtttttggtcatgctgaccttagccattaggctgatgccgtttggatttaggcggtttttgatcagggtgaacttaaaatggcagtgcttgtccaagatggcaatactcctgctgctggttggccactcggaattgtcttcgtggagagagaagactttatggttatgggccacaatatctagggtgtggccatgggagaggagggctggggtagttttgaggtcaagaccatgaaaggagagcaggccagggttttgcagggatcaccccctggaaacggaaatcaccaaaagttataagaagaggaggagtgctgcagagcgatgtggtccttgaggggcgagcgggtgtccatctccagttacagcacagtcaaggggatgctcaaagtgttgacaaaaaagagtcaaactctgtaaaatatttgaagagagttattctgaaccaaacctgagtgatcatggcccatgatgcagcccctgggaggtcctgagaacatatgtccaaggtggtcagggtgcaacttcattttacacattttagggagacgtgagacctcaatctaatacatttaagaaataaattggttcagaaaagcaagagaactagaaggcggggggtgggtgaggggggacttccaggctataggcagatttaaaaattttctgggtgacaattggttgagttgatttaaagacctgggatcaatagaaagaaaatgtttgggttaagataaaggattgtggaaaccaaagttcttatttgcagaggaagccttcaggtggcaggcttcagagagaatagactgtaaaatatttcttatcagactaaagtgtgttgatgttaatgctggagcgataatcatgcaagtccgatccccacttcccatcatggcctgaaccagtctttcagattacattataagaattccctggcagaggaggaggtccattcagatggctggggggccctcagaattttatttttggtttacaaaaagtttaggttatgggggacgttgctcatggctggtcaggagattgagagtggaagggtttgagggaactggggatgggggaaagggtctgagaaggggatatacagagctgtctggggcaaggggtggcctggggggactcaaactttccatacagagggagaagcagcataatgagcttaatcctggggtctacagtggcagacagtggggaaagcagtgacagagagtttgccagcagaggaggcagctgagggtggtcttactcaaagaccctccctgaatgctgggagctgggaaggggttggttttgcccaagcacatggggtctcacttgtcttcaggcaatggtggctacctgaggatagcggaggctcattgccctaggccaagtgggaaaactgcctcacccagaaggtcacaccctcccccacaacccagtgcctgattgatgaggggagggagaggagacacaaaatggtcctggcctcaaggcagggacagccgtgaggtgcagtgctcctgaactccccttcatccaaccaggctgaagcagtcacagccttgctcagctctctgcactggctctctacccccactctcctttcctaggagcaccccctccataatcacctccacaggaattccatctcagctctgcttccaggaaacctgacccaagacagaggttgttgcaagggcagaggccacaggcatccacgccagcctctgtgtgttcagtctgtgagcagcccaatgctccccatgcactcctccttaaagcctactcaaccctggggtctgcaggcaaattcctcccgggtgccttcccttgtcctggctgccgctctgcttcctttgcaagctccttctctcacccttgcgctggctccctccagagggctccatcccctgcccactgtgccttcgtgggtggtgcccagatctctgtctcctctgccctggacccctctgcccctgactggaagatctatagagttcaatgcccctggagggctccacgtccatcccacagggacccggactctcatcttcctcctgagtgtgctctccccggagacctggcattggaattcgccctgccaccttctggtctccccaagtagaaacctgggcgtcagtctggacgcttgtcaccaaattctgtcccttccaccttcacatggcctctccatcttcaccgcctcggtgtctctatctcgtcccgatcaccgtcgcctctcctctggcggagagcaccagcattcccactggtctctgcttttcctcaaatgcatctctgtgtaaatctcctctcaggatcactctgtgacccccactgctctgggtggaaccttctttccagtggcgtttcagtcccctgggtctgcctcactcctcaccaccgtcttgtgcttctgcactgagctccagccagaccacctgcctgcagccacctggcgctacctgttcctgtgtgcttcctgcctttgcctggagagaataacaatctatagtccaaactcaaggacaaaaacaaactgctttttggctgtggtggcatgaaaccccaaaaagtcaatgacagtgctgcatgcttctgaaagctggccagtcagggacagccccactctacagaacaggcccaggcagcaagaaccttgtgcccctgaagtcaggctgaacactctcacttctgaaagctggacaatcctcaatgccaggcttcccaagagactcaatttgttttgctctgagagatggtcctataagcacagttcccctttgctctagtaagcaagatactcagcttcagcgctgaccagcctcacgatccgtcctcaccaagtggagggccctccctccgggttcctccacggccgtatgtgtctctgttcatacaccttcccctcagcacttagagacatgggctggcatggggggtgctggcggcaggggtgagaaataaactttcagccctagatgaggagcccaagaggagagcatgccgtcacctggagtctctggtatgtgcctggcacctgtactgattgcattaaccactgtgattttttaaaagatgtgctattttgaaatgtataatacatatggagaagtgtatgaaatatgtacaatttaaagataaggaaaaatgcatgcctgtgtgcccaccacctagtgaagaaatacaacctggacaccgctttggaagcctgtctgtgttcacccgtcgcattctccctcctcccccagcccaggtatcctccatcctttagccatcccctgactttctttagtttcattgcctgaagtctgagctactagggaggctgaggcaggataatttcttgaacccaggagcagaggttgcagtgagccgagattgccccattgcactccaccctgggtgacagtgcgagaccccctcaaaaaaaaaagtttgtgggaccaattccaatcgagtcaaggggtctcaattggccaaggcagtctcaaacttctgacccaaagtgatctgcctggttcggcctcccaaagtgctgggattgtaggcgtgagccaccatgcccggcctcccctccttttcattcagggattttaaatgttttatttgctccatctgttatgtatgattgccttgatgatttcagcttgaattaaaagtacatatttttgcctgtgtttattaatatttaaacatattaaaataatacatgttcataatgaaaatgaaacattacaaataaatacacaggaaaggcagtattccccttccagttccactcttgaaataaccagttaacaagatgatgaacatctttccatgatgttctccaagattcatataattatttgcaatcatacaatggcatatacagctcaggtgcggtggctcacgcaagtaatcccagtactttgggagacagaactgggtggatcatttgaggtcaggagttcaagactagcctggccaacatagtgaatccccatcactacaaaaaacacaaaaattatctgggcgtggtggcagacacttgtattcccagctacttgggaggtggaggcatgagaatcacttgaacctgggagatgaaggttacagggagccaatatcgcattacttcactcccacctgggtgacagagtgagattccatctcaataaataaataaataaacagaaagaaagaaagaaaaaaagatgaaagaaacaaagaaaaaaggaagagagaaaaaaagacagagaaaggaagcaagcaagcaagcaagcaagcaagcaaccaagaaagaaagaaagaaaaaaaatagaaagaaaaagaagtcatgtgctcaggttgctaggatcgatggtaagaacaaatcctctagcggtgaaaatgtaagaaggaaaaagaaatttctgttagtcttgtttgttggaccccaagctctaaaaatacagccacatgtgtgataagtacttagttaagatgaaaaaggcattaaatttgtgcatggaaatcataaacagaaatgtgttctgattgacagcaattgggtcaatgctatccaaggttcaggcatccactgcgggtcttagaacacatcttctgcagataagggagggctactatataacgtttctttctttttttcttcaattataaagcattctcctttttcatgtaacaatttgccattgatatcactttaggtataaagatattaggatatctttatagtagataaaaagctaactcattatttgtaagagttaaagtatcttccattatatcagcatataaaatgctaaagtacttttgccaccaaaaatagtgcttctgtaaatattcttttacttatacctttattaatttttacttctgctgaaacaaatagcatgaggaaacaaatgtatgtgtataaaatgtaatatatgtatatatatttaatatgtgtatatacacatacatacaataacatacccaaatttttggttgttttttgaggtggagttttgctccgtcacccaggttggagtgcagtagtgtgatttcagctcactgcaacctccacatcttggattcaagtgattctcctgcctcagcctcctgagtagctgggaatacaggcatctgccaccaagtccagctatctttgtctttttggtggagatgggttttcaccatgttggccaggctgctctcgaactcctgacctcaagtggtccactgaccttgccctcccaaggtgctggaagtacacttgtgagccaccgtgcctggcctaacatatacaatttaatgtatatacaaatataggttgggtgcactggctcactcctgtaatcctagcactttggggagctgaggtaggggattctttgaacccaggagtttgaaaccagcatgggcatcatggtgaaaccctgtctgtgcaaaaaacacacaaattagttgggtgtggtggcacgtgcctgtgctctcagctactcaggagactgaggtgggaggatagctggagcccaggtggtcgaggctgcagtgagttgtgatcatgccactgcactccagcatgggtgacagagtgagaccctgtcttagacaaaaacaaatcaaaccaaatataatgtttatgcactacacacttgatttctttccaaagggttatataacactaatttcaccagcaatatatgcgactactcatttcctacatactcactatcatttgtgtgcagtcaaggaaacttagtaggcctgaattgcccaaacctggcatactccaaagaatggtgtgactctagcctggctcctgggaaataacctctaagtccttggaatatcctgcctatctgaagttaacaatgtgatttattgtggggaccttggaccatgcagtgtcagcttgaccttgggaagggtggagacaggaaactaaggtcatccaaatgggtgctcttgtccatgagaccaacctccagtaaaaccctcaaccccaaggctcaggtaagcttcttgttggggagtattttctgtactttctgccacatatctttgggtgaattaagcactgttcacatgataccactggcagaggacaactggaagcttgtgcttggtttctcctggactctgccatatgcacctttttctgctgctgattttaatctgtatccttttgttgtaataaactataactatgagtataacagcttgactcagttttgtgagtccttctaatcaatcactgaacttttgggaccccaaaacacaatgttgtttcttaattgaattttccatgttatgtaagaaacctatgtgcataattgaaaatcccacactaagaaagagctctccatgcagtctactccccaccctgtttctccaatagtcccaagtctactttctgaataatcaaatatttaaattttctaaactatttataatccatatatctgagtgcttatctctgttatataataggtagatcctcctccttctgttttgtttgcttgtttgtttgtttttctgagacagagtcttgctacgtcactcaggctggagtgcagtggcacaatcttggctcactgcaagctccacctcccgggttcactccattctgctgcctcagcctccccagcagctgggactacgggcacccaccgccaggcctggctaatttttttttttttttttagtagagacggggtttcaccgtgttagccaggatggtcttgatctcctgacctcgtgatccacctgccttggcctcccaaagtgctgggattacaggcatgagccaccgtgcccggcccctccttcttaatgtatcaacttgatatattacctgatggcttcgtgttctgatagctgatgacttggctgacactcaccccttaccacagtgcctgaaccactttccttatatggtgctctcactattttctttttcttttcttttcttctctttttttttttttttttttttttttgagacagagtcttgctctgtcgcccaggctagagtgcagtggtgcaatctcagctcactgcaacctccacctcccaggttcaagtgattctgctgcctcagcctcatgagtagctgggattacaggcatgagccaccatgcccagctaatttttgtatttttagtagcagcagggttttgccatcttggccaggctggtctcaaactcctgatcttgttatcctacaaccttggcctccaaaagtgttgggattacaggtgtgagccaccgacccagccactctcactattttcaatggctgtgttggttactattcacaacattcaacaattagacttatacctcatttatttatttatttttaattttttctgtttttaggtttaagagatacatgtgcaggcttgttacacgggtaaattgcatgtcactggggtttggtgtacaaatgatattgtcacccaggtagtaaccagagtacccaatagttttttgacccatagcctcatgccatcctccccactcaagcagaccctggtgtctattgatcccatctgtgtgtccatgtgtactcaatgtttagctcccatttataagtgagaccatgggtatttggttacctgatgctgcattaatttgtttaggataatggactccagctgcatccatgttgcttcaagggacatggtttctttctctacggctatgtagtattccatggtgtataattaccacattttccttatccaatccactgctgatgggcatcatatatgccacttcaaactatactactaggctacagtaaccaaaatagcatagtagtggtacaaatacagcacatagaccaatggaataggttagaaaacccagaaataaattcacacacctataaccatgtgatctttgacatagtcaacaaaagtgagcaatgaagaaaggactccctattcaacaaatgattctgggataactggctacccacatgcagaagactgagtctgggccccctacctttcaccatatacaaaaattaactccaaatggattaaagatttaaatataagacctcaaactataaaaatcctggaagacaaactaggaaactcttctcaacatcggccttggcaaataatttttggctaagattccaaaaaagcaattgcagcaaaaacaaaagtagacaagtggtacctaattaagccagaagctgggaggccaggttgggcagatcacaaggtcaggagtttgagaccagcctgaccaacatggtgaaaccctgtctctaataaaaatacaaaaattaggtggtggtggcacacacctgtaatcccagctattcaggaggctgaggcaggagaattgcttgaacctaggagtcagaggttgcagtgagctgagatcgcaccactgcactccagcctgggtgacagagcaagactgcctcaaaaaaaaaaaaaattaaagtaaaataaaagcataaacacaacaagacaaactatcaacagagtaaacaaactacagaatgggagaagatactcacaaacgatgtatccaacaaaggcctaataatatccagaatctatagacaacataaacaaatggatcccttactctgtagtaagttctgtatgcataagcctctctttgttcttattttggtggcctctgtttatttacacaaagagaaataactgctattcccataaatcatggctttcaaaatggtcacagttcactgggcatgcttgctcatgcctgtaaatctaccactttgagagaccgaggcgggcagatcacgaggtcaggagatcgaggccatcctggccaacccagtgaaaccccatctctaccaaaaatacaaaaaaaaaaaaagccatgattggtggcatgcgcctataatcccagctactcaggaggctgaggcaggagaatcacctgaatccaggaggcagaggttgcagtgagctgagatcatgccactgcactccagcctggatgacagagtaagaccgtctcaaaaaacccaaactggttaggctcggtggctcacgcctgtaatcccagcacttttggaggctgaggcaggtggatcacaaggtcaagaattcaacaccagcctggccaagatggctaatccccaactctactaaaaaatacaaaaattatccaggcactgtggcaggcacctgtgatcctagctacttgggaggctgaggcaggagaattgcttcaacccaggaggcagaggttgcagtgagctgagatctcaccactgcactccagcctgggcaatagagtgagaatctgtctcaaaaaaaaaaaaaaaaaaaaaaacatggggaaactccatctctactaaaaatacaaaattagccaggcatggtggcacatgcctgtaatcccagctacttgggaggctgaggcaagagaatcacttgaacctgggaggcagaggttttggggaggtggaggttgaggtgagccaagatcgtggcattgcactgcagcctgggcaacaacagtaaaactctctttaaaaaacaaacaaacaaacaaaacaaaacaaagaaaaatacacacaacttatttccttgtttgtgataatctgtgaaatatattttgaaatgaattggaattcaatacagtattattcacaccccaaatactcctaatatttcctttcccagatgatgacctggtactcttcctagggcttgacttctccctacaggtccccagtacaagtatttgtgattctgagtcaattcattgtctacatgtgtgacaatgcaatgctcttgttgtagagtaccaagatgaggcaggtccaaactgcacatttgtagagaacatagtatatgtgcaattgaacatgtatgtggttgtgatactgaaaacaatacgaacttatgccaggtgcaatggctgatgcctgtaatcttagcaatttgggaggctgaggcatggagatcacctgaggtcaggagtttgagagcagcctggccaacctgctgaaaccctgtctctactaaaagtacaaaaaattagctgggcgtggtggcaggcacctgtaattccacctactcaggaggctgaggcgggagaatcgcttgaacccaggagatggaggttgcagtgagccaagatcacaccactgcattccagcctgggtgacaagagtgaaactgggtcaagaaaaaaaaaaattggccttgggcgtttctttaggttggctcctgtgttctatttatagcatgcctttatcagggggttggggtgtgggactaattaccaactttctggcacataaagcgttttgattcatctggtattttccctgacccagacgtggaataaaccatttatttaaagatccttggcttctttcattgaaaagtattatttacaaagcaccaaaatcttgggctgggtgaggtggctcaggtctgtaatctcaacactttgggaggctgaagcaggaggatcccttgaggccaagagtttgagacaagcttgggcaatgcagtgagacccccatctctatttttaaaaaccaaacaaaaacaaaatcgccaagatcggggtgacacgtgtgctcattgctatgggtgtgtcattgcttctaggccctcttagtgggcagaactaggaaatatattgtatgtatactaacacacatgccacatgcctaatttgtatatttatttagccttactggaagcattcttttttttttgagacagggtctcactctgtcacctaggctggagagcagtggcataatctcagctcaatgcaacctccacctcccaggttcaagtgattctcctgcctcaacctcctgagtagttgggactacaggtgggtgccaccatgcctggttaatttttgtatttttagtagagacggggtttcaccatgttggccaggcttgtctggaactcctgacctcagtggatctgccccccttggcctcccaaagtgctggaattacaggcatgagcctctgtgcctggccaagcatttttaatgggagtgatattgcccctaagagggtgaacattggttattgaaggtaaaatgaattatagttgttgcaatggtttgtggccttccacaattttttttttttcggagagggagcctcactctgtcacccaagctggagtgcagtggtgcaatctctgctcactgcaacctctgcctcctgggttcaagtgattctcctgcctcagtctcccaagtagctgggattactggcacacactaccacgttcagctaatttttgtattttttgtagagacggagtttcaccatgttggccaggctggtctagaactactgatctcaagtgatctgcctgcctcggcctcccaaagtgctggaattacaagtataagccaccatgcctggcctattgcacaaaattttacaccttggtatttaatttctctcaaatatgatgggcagcattaatcattttatggaagataaaaaatccaagcaagatcaggccatgcacggtggctcacacctgtaatctcagcactttgagaggccaaggaaggtggatcactgaaattcaggagttcaaaccagcctggccaacatagtaaaaccctgtgtcaactaaaaatacaaaacaattacccagaagtggtggcacctgcctgtaatcccagctacatgggaggctgaagcaggaaaatcgcttcaacccaggaggcagaggttgcagtgagtggatcgtgccaccacccttcatcctgcgtgacagagcgagcctcctccacctcaaaaaaaaaaaatctttgcaagatcagtgctacaaaatgatggcaaattgatggctatacctggaagactttttcttgattgaatgctctatcccaaagttatatgagaggtggtctgtgtgtgtctattggctgccttgtggatagtatttatgattgatcctcagtgctttgggaattatgtaaaatagtttatattatgaaagtaattcaacctagcattaattgtgttaagtgttgaaaatgaaaagtgttgactacatcggaatgaatgaatatctggccaactggttttgtttttttgtttgtttgtttttgtttttagagatggagactcactctgttgcccaggctggaatgcagacatgatcttggctcactgcaacctccacctcctgggttctagcaagtctcctgtctcagcctcccgtgtagcagggactacaggtacttgcccccacacccaggtaattttttgtattttagtaaagacggggtttcaccctgttgcccaggctggtcttgaaatcctgagttcaggcaatccacccacctcagcttcccaaagtgctaggattacaggtgtgagccaccgtgcccagcctagcttacagttttattgaaaaccccatttaactcaaaacagcttttttcttataaataattgtttttgtttgttttttgtttgtttttacaaacggctatgaaatcaagatttgtggatcatcaataaaagaaacatcctgatcaagtcgagaaacagaatatttaaaaagtttaaaatagaattttgaactgtaacactgttacttcttatttaagaaggacaagccgtggggtgaggtggctcacacctgtaatcccaacactttgggaggccgaggtgggtgtatcacgtgagcccaggagttggagaccagtctgggtaatatggtgaaatcttgtctccactaaaaacacaaaaactagcctggcatggtgtgtgcacctgtaattccaggtactcgggaggctgaggcaggagactcgcttcaacctgagaggcggaggatgcagtgagccgagattgcagcaccatgttccagcctggactatagagcaacactcggtttcaaaaaaaaaaaaaaaaaaaaaaaaaggataagcaaacaaattatgatgaaataattgctttataaaattgcagaaataggccaggcgtggtgactcacgcctgtaatcccagcaatttgggaggccgaggcaggcgcatcacctgaggtcgggagtttgagaccggtctggccaacatggtgaaaccccgtctctactaaaaatacaaagttagccgggcgtggtggcacacgcctgtaatcccagctactcgggaggctgaggcaggagaatcacttgagtcccggagacggagcttgcagtgagctgagatcatgccactgcactccagcctggctaacacagcgagactctgtctcaaaaaaaaaaaaaaaagaaaaagaaaaaaagaaaagattacagaaatcattgtaaaactccatagtgctttatacttgctgaaactgtcacaggactcacatgagagacggtaacttcaacagtgatgtaacacattgccactatttcacaatcactcctattgagcaataattcaattcaaagatgcattaatgagatgtcaggtaataccaaagagtagctgattaatcaagtaagtttcctattcagatcaatgaaatcagttactgagagtaaggcctgacaataggacatgtttgttatttaaataatgactgcaaactaaaagaagagatattgtttgtaaaatctttagacgctgactgtacgagagcatctattcttgctgctataaaaacttggtttggggctgggtgcagtggctcacgcctgtaatctcagcactgtcattttctcatatgaatcggaaaatgctgacgtctgcatcctaaatctaaactaatttcccactcacttgctaagcttcagtcacaccaggctgctttctgtttccggaatgctccaagcgctctctgatttttcagggtcttcagtgtaactgtgcctctgcttggaatacccttccacactgctggctcctcaccaccaaagctcgagggttatctcagacacccgtcctatcaatgctatgggaagtatccctcaagttactgcttataccacctactgatatatttcattgtatttatcacaatataaaattacttcatcttccccttttaatttaaaatctttttttttctccagactagaatgtaaacctcatgtgggcagcagaaatgtctgcttactttttttttgagactgagtctcgctctgccacccagcctggagtgcaacggcgcgatcctgactcactgcaacctccacctcccgggttcaagcgattctgctgccccagccttccaagaagctgagattacaggtgcccaccaggcccggctaatttttgtagttttagtaggggagcagtcgggctctggactacatttcccggaggattctgcaggccaataccacatctcgcgagatttcggcttcctcttagccaagtggtaggatctttcgctgtgcgcaattagctgctgcagtgccttggagcccggagtaacttggccaggctggccccgagaggaactagaaaaagctgaggatgaggaatccagctccggtccttttgtgtgtggagggctgaggagaggagtttgcatgtgtgattgcgatggttgccgtgggtcttcgtggtctgtgactgtggctgtgtggtgttgactctgggtgatcaggtgggcgcttatgactgtgcgtgctcggagtggatgtgtgtgtcctggacgagccgcgttgtgtgtgcggatgtggacaaccagttactgtgtagttggggctgcgtgacccagggtgggtgtgtgactttgcgtgtgtgtgcagtactgtgtgtgcgtgagttgcaggtctgtggctgtgcaggtgcaacttgtgtggccccgtggtctgtgtgagagaggagagtgtgattggctgtgaggcagagggtaagtggatatagggaggcatgtgtgcgattggaactttgtgtgtccccttgagagaaaaatccctttagggagttagagcgggtccttggtaaaactcctttcaacagagaaacagcctaaaaaatcaggctgcaggcacagagaaggaaaactagcaaagggggttgtcctaaagacattcctcagctgcattgataagggaccgaggcccaacatagaaatgcctttgtcctttgtgtgatcagcgggcttccaggaaatagtcgcttttttgtgggcatgtatacggtgggctctgttagattttgaagggaaggtgaaggttaaagaaagagagagacttggcggctctatggaggggaccaactaaatgccagagcccactgccgcttataggctggagtaattataggcctgggcaggagggatctgggcagtatagcttgttgcctgggagaatgttgataaggatgtttcttgggcctttccccagcaggatgtgataaggaagtcaggcggttggggaggaagtttccctcagcccaaaccccagtggaatgtttccctctgaccagagtctgtgaaatggtgggggcttacaaatcggtgcggcttgaactaacaggctctggtggccaatttccttttctggacatgctttggactgtgagccaagcctccatgaatcatcatttcagcccctgtttggtcctgggccaaactttcacttcagcccctgattggtcttgggccaaaatttcacttcagcctctggttggtcccaagctaaggtcctgggccaagtgaagttgtgctttctccaagacagctcacagactagtgagcattcttccccttcccagttcacaaaacccccagattcagcctcctagttggcaaccctctctcgggtcccctctccgctggggagagctttcttcttttgcttattaaacttgtgttccaacctcatcctttgtgtccacgttccttaatattcttggctgtgagagaaagaaggcaaagacaagagcctttatcctaacaactcaattgctggagagaagattcatgcatattctatgtggcatcacatgccatagccctgggattgaaagccatgcagtttaagggatggtgttatctcagtccaaataggtaataagatctttccctttgctatattttaggggtaggaatgagattgggggtttgatcaatagtttgtacccataggaccagtgatttgcccagtcatctgtgagtaaatgcttgggccagtttccatgtctgtattgaattaaaaactcatacggttctgtgatttttgtcaaatacagatttggtctttgtccctatttcctggtatacaactcctaaaatccttggaatgtcctaagggcttgcttttttttttttttttgaaatggagtcttgctctgtaacccaggctgcagtgcagtggcacaatctccactcactgcaacctctgcctcccgggttcaagcaattcttctgcctcagcctcccaagtagactacaggcatgtgccaccatggtcggctaatttttgtctttgtgttcttttttagtagagacggggtttcatcatattggccagtctggtctcgaactcctgacctcaagggatctgcctgcctcaggctcccaaagtgttgggattacaggcatgagccactgcacccaggctttggctttttatatgttagggattaactgatagcttcaggatgtgggctggtcatcagaaagaccaaggcagaattagagggctgggactttcagcccctactctcccacccctggggagtggaggggactgaggattaagttgatggcaagtggctaatggtttaatcaatcatgcctatgtaatgaggccaccttacaaacccaaaaggagtggattcggagagcttccagagagctgaacacatggaggttcctggagggtcgtgcccagggaggggatggaagctctgtgccccttcccccatacctcacgctaggcatctcttcatctatatcctttggaatatccttgtaatcaaacagtaaatgtgtttccctgaggtttgtgagccattttagtctagcaaattaatcaaacccaaagagggggttgtaggaaccccaaattaaatctgtcagtcagaagttccagaggctgggacttgtggctggtgtctgaaaggggggcagttttgggggctgagccctcaatctgtggggtgacactatctcatggtagatagtgtcagaatcgaattggtggatacccagctggtgtctgctgcagaactgattccttgcttgctgatagggagaaatctcctcatattttgaggccacagaagtcttctgggtagattgttgtggttttggtgtgaagcagagggagaacacaggttgagttttttccaaatggattcacattgggggtcctcaacctcaaatccatcaactccatcgctgaatttttatttatgtatttatttttatttttgaggtagagtctcactctctctcccaggctggagtgcagtggtaccatctcagctcattgcagccttcatctccgatgctcaagtgatccttctacctcagcctgccaaataagctgaaaccagaggcacacactagcactgtggcgtaattaaaaataattttcagtagataagaagactcactatgttgtctgggctgaacttgaactcctgagttcaaatgatcctcccacctctgcctccaaaattctatgattacaggcatgagctgtctcacctatcactgattttctttttctttctttctttttctttctttctttctttcttttttttttttttttgacagagtctcactctgccttgcccaggctgaactgcagtggtgcaatctcggctcactgcagcctccgcctcctgggttcaagtgattctcctgtctcagcctcctgaatagttgggattagaggtgcccaccaccacacctgaccaatttttgtatttttagtagagacagggtttcaccatattggccatgctggtcaccaactcctgatctcaggtgatccacctgccttggcctccaaaagtgcagtggcaggatcagggcatactgcagccttgacctccggggctgaagggatcctccctcctcagcctcccaagtagctggattataggcatatggcaccatgccaggctaattgtaatttttgcacagatggggttttgccatgttgcccagtctggtcttgaactcctgagctccaacaatcttcccacctgagcctcccaaagtgcccagattacagggaagagccactgcacccagcctatcactgcatttttaaagggaaggaggactatagtgagattcactaaggcttacagaaaaggtagaaccctagatagatttaaagacagagattataatatccttgagataatatccaaatttagctttcatagatagggaaatttgaagtacatcagactataaggtggcattttgtgcaactaattaaaactatgtttgaaagagagcaattgcattttcattactgagtaatattaagcaacaatgaaaataaatagaaataaccaagaaattgttatatttaaatcctccctccttttttggaaagagaagtattgatatttttagattctaatcaaaacttctctttttaaaaaaattgatgattctatggagatagggagggaataacctgtgtttattgaacacctaatattccacttacccaaatgtcatttattctatattctagtttttttgttgagacagggtctttcttgctctgttacccatcctagagtgcagtggggttgtcacagctcacagatgtataccaccatgcctggctttttattttattttattttattttattttattttattttattttattttattttattttattttattttattttattttattttatttttgcagagacgatgtctccctatatttcccaggcttgacttgaacttctgggttcaagcgatcctcctgccttggcatcccaaagtgctgggattataggcataagccactgtgctcaggcaatattaaagtcttgataatagaagtgtctcagtgtactggaatggtttgtctaaattttgaaaaaatattaaaaaacatgttggttttatttggccaatactgatttctttgctccatcattatttattggcattattagcctgttgactttcaatttctttacatccctttcactccttttattttgtcccccaaatagaaattctttttttttttttagatggattctcgctcttggctcttgtgacccaggctggagtgcagtggtgcagtctcatcactgtaatcttcaccttccaggttcaggcaattctcctgcctcagcctccagagtagcctagattacaggcatgcgccactacaccccgctaattttttgtattctttctttttttttttttttctttgagatgcagtttcgctcttgttgcccaggctggagtgcaatggcatgaactctgctcattgcaacttctgcctcccaggttcaagcgattctcctgcttcagcctcccaagtagctgggattagagagtgagtcaccacacccgactaatttttgtatttttagtagagacagggttttgccatgttggacaggctggtctggaacacctgatctcaagtcatctgcctgtcttggcctcccaaagtgctgggattacaggcatgagccactgggcccggcttttttgtatttttatatttatttatattttgatagagagtctcgctctgttgcccaggctggagtgcagtggcacagtcttggctcactgcaacctctgcctcccaggctgaagcgattcgattctcctgcctctgcctcctgagtagctggtattacaggcacctgccaccacgcccggctaccttttgtattttaattagagacagggtttcaccatgttggccaggctggtcttgaactcctgacctcaggtgatctgcccaccttggcctcccaaagtggctttgcttgaggccaggagtttgagaccagcctggccaacatggtgaaacctgctctctaccaaaaaaaccaaaaaaaattagccgggtatggtggtgtgtgcctgtattccaagctactttgatggctgagtcacaaaaatcacttgaacccaggaggcagaggttgcagtgagctgtgatcacctcactgcactgtagcctgggtaacagattgagacttgtctcaaaaaaaaaaaaaaaattcttggcaggatgtggtggctcacacctgtaatcccagcactttgggaggccaaggtgggttgatcccctgaggtcaggagtttgagaccagcctgactaacatggagaaactccgcctctcctaaaaatacaaaattagctgggcatggtggtgtgtgcctttaatcccagctactcgggagtatgaggcaggagaatcgcatgaacccaggaggcagaggttgcagtgagctgagatcacaccactgcactccagcctgggcaacaagagcgaaactccatctcaaaaaaagaagaaacatctttactttggataaatacttagaaatggaatttccaggtcggcctttagatattattaatggatttaatatgaaaaacctttacttgaggatgtataaagctttaaaagacagagtccctactcttaagttataaataaagcagcatttgtaaggtaatattcagaaacatcagataatattgtataaagtcctcctgttcatgctgatgacattagatggccagttaaggatgacacttcattctgtcccctgcaaccacggtcctgacatgtctaaatgatactggccctatgagaacactgtggatgtgaaagcatttcctaaagttatcgttttggcctgctggttttaatctaagaatgggatatccaaagtgaatctaacagagtgacatgattgtgcatctgttgtggggaatcagagacagctagagcaagggcagacacgtgctaaactcatctgtcttaagagctaaagcaagcagcagagctactgcacatctgtacacgtggctccaatggctctgacctgtttttttcctagtatgaacctaatacacgagacaagttagaaaatcagagttggccaggcatggtggctcatgcctgtaatcctagtactttgggagccaatgtgggtggatcacttgacgccacgatttcgagaccagcctcggcaacacagtgaaaccccatctctactaaaaatacaaaaattaggtgggtgtggtggcaggcagctgtaatcccagctatgggaggctgaggttgcagtgagccaaaatcaggtcactgcacttcagcctggttgacagagcaaggctgtctcaacaaaaaaaaaaagggaaaggaaaggaaagaaaatcacagcttgttagccacttgcagctaaacacatatgcacaaaaattactcagtaaaagcaaaacagttttggtgtatcttgagattttgttttttatccaaaggaagactatatcttttatctttgaactactctttggaaaatgccttctatataacaaatgttatagttttcttctaattgggtcttgaggtctctcaggagaatggctataaactctacctcactctaatggggctctaggggaggggcctgtgggtctttagagtagtctttcaccagaaatttcttttttctggaccacagcctaatgctcaagtatctgacccatgaccaggtgtctcacaggaaacttgtttatactagcagatgcccttgtaacttttgtctgacctgtgtgcagtttattcctaccatgatacccactcttttttttttttttttttttttgagatgcagtctcgatctgttaccaggctggaatgcagtggcacgaccttggctcactgcaatctccaccacctgggttcaagcaattcccctgcctcagcctctcaagcagctgggactacaggcgtgcaccaccatgcccagctaatttttatatttttagtagagtcagagtttcaccatgtagtccagtatggttttgatcccttgacctcatgatctgccctactcggcctcccaaagttctgggattacaggcatgagccaccacacctggcctttatttatttatttttttatttttttttgagacaggatcttgctctggtgcctaggttggagtgcagtggcaggatcacagctctctgcagccttgacctcctaggctcaagcaatcctcccacctcagcctcccaagtagctgggaatagaggcatgtccccctacatttggctaatttgtatatgacatatatttttgtagagatagggttttgccatgttgcccaggttgatcttgaactcctgagctgaagcaattcacctgccttggcctcccacagtactttgattacaggtgtgggttaccacacccagccaatgtacatttaattatcaaagtactatctatactattttatggaagtactaattatcaaagtgcaatagaggttttgttgttgttgttgtttttcttttgagacagagtttcactcttattgcccaggctggagtgcagtggtgcaatctcggctcactgcaacctccacctcccaggttcaagtgattctcctgcctcagcctcccaagtagctgggattacagacatgtgccaccacacccagctaattatatatttttagtagagactaaaatggtctctccatattggtcagtctggtctcgaactcctgacctcaggcgatccatctgccttggcctcccaaagtgctgggtttacaggtgtgagccactgtgcccagccaatagaggtttttaaactttttgtagatatttttgaaagatacagtcttcctttaagaaaagagacaaggctgggtgtggtggctcatccctgtaatcccagcactttgggaggccaaagcaggtggattgcttgagctcaggagtttgagagtagcctgcccaaatggcaaaaacctcgtttctgttaaaaatacaaaaaaaaattagctgggcacggtggcacatgcctatagtcaaagctaatacagaggctgaggtgggaggaacacctgagcctgggaggttgaggctgcagtgagctgtgattgtgccactgcactccagtctaggcaacagaacgagaacctgtctcaaagtgaaaacaaaaaaatgaaagaagagaaaaaaaaaacaagaaagaaaatggtaagggggaagtgcctatttattaagcttttgttgtaaatagtaacttgcatatcagatgtttactctaatattcttgaagccttgccaggcctacagcttgctgtgtgcttttcaactttatttcatttatttgggaaatcatatatcaatgtactttattcattcccagctctaaccatggaatactgggaatgtccctttctttgaaggagctttgctggccacaacaggaatattcatgaacatggaggtactttgttgaagttacactaatttttttactcttccccactctcaacctagctggtctgctcactatattctctccatccttcagcacccttccatctctttcttcatcttaaaaacctttcctttaacttcaacagtgctgcctgggtttgtcatttcagggattgggcatgttccaggatctgtctatagacttctctcaggaggaatgggagtgcctggacgctgctcagaaggactgatacagagatgtaatgatggagaattatagcagcctggtctcactaggtaaggatgtctgttcccaaataactcatgagttttgggtgtagctttcacttgtctgggtgacttttcacctgctgcttagggaattgttttgtgttttgtagattaatagatggacagctctttggggtccctccatcttctccatgcttcagacctttacaccttcctctagtccttcgtgagtactaagggactaactttgaattcaggaacagcacgagtatgtcttacttcttttctttctctttctttctttctttctttctttctttctttctttctttctttctttctttctttcttctttctttctttctttttttgagatgaagtcttactctatcgcccaggctggagtgcaatggcgtgatctcggttcactccaaccttcctctcgggttcaagcaatgctcatgtctcagcctcctgagtagctgggattacaggcacccgccaccacacctggccaatttgtgtgtttttagtagagacggggtttcaccatgttaggctggtcttgaactcctgacttcaagcaatccacctgttttggcctcccaaagtgctgggattacaggagtgagccactatgcctgcctgtccatcttacttcttttcttataaacaggtctctctatcccaaagcctgatgtgatttccttaatggagcaagggaaagagccctggatggtttcaagggacgtaccgggaggatggtgcccaggtgagtaaggactgagcagatggggaaggcactgctgtttagaacccagcccatcagggaggcagcgccttaaaggtattggttggggaatctcttctgcaaggtcccatgtaagagttgtggcctaagacacatggagaaaagtcaagatacccacccccccccccacacacactcttttttttaaaaaaaaattaatttgagagagagtcttgctcagtcacccaggctggagaacagtgttgtgatttcagctcactgcaacctctgtccccgggttgaagcgattctcctgcctcagcctctaaaggaactggcattataggcgcctgccaccatacccagctaatttttgtatttttagtagagacggcatttcaccatgttggctaggctggcctcgaactcctgacctcaggtgatccacctgccttggcctccgaaagtgctggtattacaggtgtgagccactgtgtctggccaagaacacccttttacctccacctcttcagtctgtgctaccctcttgtcataatttctttccatttcaaagaataacattcccttcttcagaagccatcctgtttcctctatcttggagctacttctttcactttaaaatttaaatccgtgttgttgctttaaaaacaaatcttttaaaatatatttatttttcatactgatccttgacttttttttgccttgtcttttcttggctagttttcctttaatgcagccatttcatgcatcaatagatattcattcactggttttttttttttttttttttttttttttttttttttggatacagagtctcactctgtagcccgggctggagtgcagtggcgtgatctcgtctcactgcaagccaataagaagagcttggggataacctccctacaagcacagcaaaacatttcctgcgcatttctgcgctggaacgcctacccgcctcgccaaaccaaaactttactatcacccttagtgccgtttcctgcgctttcttggagagttgtaccaggcactggagaccctcccacctggtccatgcccgcctcccggtgagcaccgagacccaaccttgtgcaccgccagtcttgttatcaacaaacaggctagtaaattataaaaaaataaaataaaggaaatgtagctggtcttggtgtcatgcacctgtaatcccagctactctggaggctgatgcaggagaatcgcttgaacccaggaggtgaaggttgcagtgagccgagatcgcaccactgcactccagcctggatggcaagagcaaaactccttctcgaaataataaataaaataaaggaaatggggccgggcatggtggctcacgcctgtaattccagcaattttggtggctgaggcgggcagatcacttgaggtcagaggttcgagaccagtctggccaacatggtgaaaccctgtctctactaaaaataaacaattaaccaggcatggtggctggcgcctgtaatcccagctatttgtgaggcggaggcacaagaatcgcttgaatcccgaaggcagaggttgcagtgagccgagctcgcgccactgccctccagcctgggcgacagagcgagactccatcttaaaataaaataggccagctgagggtgctcatgcctgtaatcacagcactttggaagctgaggcgggtggattgcctgagctcaggatttcaaggacatcctggcctacatggtgaaaccctatctctactaaaaatgcaaaaattagccgggcatggtggcgcatgcctgtaatcctagctacttgggaggctgaggcatgagaaccgtttcaacacaggaggcggaagttgcagtgagccacgaccgccacattgcactccagcttgggcaagaggattgaaactctgtctcaaaaaaaaaaaaaaataaatgaataattaaataaataaataaataaataaataaataaataaataaataaatataaaagaaatagacaaagcaaaccttaatgtgtgaactcaaacaaatgctttcactgccaggctccatctttgcaaaactgaacctaggacaatgtgcacgtttctaactagcaattctggaggacagatcagggaggcaacgtgagcttgcttttctgcagtttaattgactggtcagtaaagtcagtgtttgcaggcattttcaatgttctgtagtgggcttcagttcctatggcagtgtggcaggccaggtttccaatagcaaccagaacagtttctactaaccctttactataattttgatgattgcataagttaacgttaaagaaatggagaaacttgtgcctgagtatcagggatggaatgtgaaaacaaacccattgagaccccacctgggctttctcagaccctaaagtctgatcgaataatgatagcattggtacacattcacctcggcctgtcttaagattcagaaactttccaagactctagagaaatctttccagatgctagacctgagttaaagattagatgttgattgaatgaaacactcctgcttgtaggtgcaatcccacgtggagcttaagatgtatataagcactagaaaaaaaaaaaaaaacttgtaactttgaattgatctggtgaattacttggcacttctccctgtaagtggctgcggaaataaacttccttcttgcccagtctgtctgtgtcttgttattgaacaattgcaatggacctgcccagcaaagtcctcttttgtgtggttatctgggactccttttggagggaacatttaaaattttccatttcaaagcattctgttggcactcttacactgtttttctctgcctaccctgggacctgagttctcctggacgtgaatctccagccacagagcctagaagcccattcctccacattctgtgactgttccccaaacacagggagaattttcagaaaataagcctaaaaatcttgccattctttgcaataaaaccccacattacaaactgctgaaaacaggattttagcctgaataggtttttcctctatttgaaaccctttacaattttggagggaagtttccaaatcaatcagtaagtaccccccaccccaggtttatccttatgtaaagtgacccctttgcacatgcaagattgaataaaccttgaaaatattatgctaagtgaaagaagccagtcacaaaggaccacatgttatgtaattccatttaaataaaatgtccaaaatagaccaatacatagaagcagaaagtagatttgtggtggcccagggttaggggagttggggggaaatggagggatatggtatttacttcagggtaatgaaaatgatctaaaatttattgtggtgatgtttgcataacagtgcaaatatactgaaaaccactgaattttacactttaaatcagtggcttctgtggtatgttatcaatatttctcaataaaacttcaaaaaaaagtgcctatgtgtctttttgtttattattcctccagagtccagtccatagtttttacatttgatgaagaaattaagattttgtttcttcttcttctatttttttttttttttgagacagaatctccctctgttgcccagactggagtgcattggcacaatcatggctcagtgcaacctccaggataatttttgtatttttagtagagacagcgtttcaccatggtggctagactggtctcaaacttctgatctcaagtgagtcccacaccttggtttccaaaattgctgggattacaggcgtgagccaccgcacccagcccaagatttagtttccgttgttttgatgccctagggccatcttattctaccttaatttctgacacatcatctcagtggaaattttaccttaggccccaaagtattttcctctttttaagattttatcagctgagtacagtggctcacaccttaatctcaacactttgggaggccaaggttggaggatcagttaagcccaggagttcaagaccagtctctgcaacatagtgagacacacattatctacaaaaaaaattttaattaggtgggcatattggtgcatgcctgtggtctcagcttactacataggctgagggaggatcacttgagcccaggaggttgaggctacagtggccatgattataccactgcactccagcctgggtgacagagcgatagtctgtcttaaaaaaaaaactgattggaattttttttttttagaaaacaaagtatagacttagtgagttgatacaaatgaatgaatttgataatctacagaaacaaaaacaaataaataaataaaaacccaaagccattcttcttatgtgaatctctggtgtctctgaattataagaattgtgaattatgattaataacaaatatgcatgacaaggactcaataagggataggcattaataaactgcaatgcacatttactggagtaaggcctttaaagatgtacaagagaaagaaagaaaaggcattgaaaaattgcattgcctaccaaaatgctaaagtttacctaagtccattaatcagcacacacaggcaatgggtgtgtaaaatggtcaacacagtctcctatgaatgtatccttttattaataggtctgtgggggtaagagatgaggttctatagatcctggaatcagggatggggaatctgtgagttccctggggtgagagatgacgatctgtagattagtgatgggtggtctttgggatagtgatgaagtccatggaatcaatgattgtgggtatgtagggtcagtgatgagggaatctggtgtcagtgatgggatgtgtgtttaatcaatctgtgaaagccagatttgtggagtcatctctcaggctgacacatcctgatctgtgggtcagtcgtggaaattctatggggtcagagtgtgactgtcaggtccctgacactgtgtgttctgggtctggccaagtgcacagattcccttgccttgtcctggctggggaggcccttctcaaggactcctcacataaaaggtgggttggcggtgggttttgtttttgttttcgttttgcggtggaggtgggggtgggttagctttttctttagggtttagttttgcctcttagagaccacagacacatgcagcttttaggaagaaatttctgtctgggtggtcgctaggtcctttgggccaagccatctaatgggagtaaaactgaccattccctcagcgaggttcagaactagatggtcattttaaggtgtcctcaaggtggcgtgcaagtgggttgtggcttcgagtggcaggtgtgcgggaagaaacaactaagaagacccaggagcgctccaaggctggatctgtcacagctggaagaacagcctccctaacccatcaggcgccaatgggaggtacctctgggctgtgagaggctggtggagttggaacctccagacctagagattctgggcacagaagcctattaccgccagacgctgaggcgttgccatgggatccaagggcgtttcgggtcagctcagagcctttctcagataattgtttcggtaactggggagctgctgtccagcgcacgcacttatgaaggcttaatgtgccgtctcccgcagagtcttctttggtctgagagccacttgtttcttacatccttgtgctaatctcaccatctgctcctacatatcccaggcatttgccacatgctggtcctctctttcctgacaggcgggccatctctccagcttctgtgaggacagttcaaattatggaggagggggcaggtgcagggcagcagtgctgaggggagtaccatgcagttgggggagcagggactcatttttctttgtagctcagattcctaagcctgtgactttgagtatcggtgtcttccttgcaatgtttcaatctgaggttcttggggagagtgcagaattggagcccgatggaagaccggtggggagaggggtgggtggagggaacatggagaatgtgtcaggtggtgtctattcctggcaccttactttgcctgctggagtttcccagtctgttccagatgcattctctcgaccctgaagggacctgaggggggatgttggtctccagtgtgtgctcccctggactcaattggaattggtcccacaaagtgtttttatttatttatttatttatttatttatttatttatttattcatttatttatttatttatttggaaggagtcttgctctgtcacccaggctggagtgcagtggggcaatctcagctcactgcaacctctgattcccaggttcaagtgattctccagtttcagcctccctagtagctgggactacaggtttccgccaccacaccttgctaaattttttatttttggtagaggcagggtttcacaatattggtcaggctggtctcgagctcctgaccaggtgatcgacccaccttggcctctcaaagtgctgggattacaggtgggagccatcacaccccgccaatcctacaaatttaggcattatggtgcattgctacttttgaatcacttattttttacttgtgttttcccccctccttttattgattgattgacacagagtctcgctgtgtcacccaggctgaaccacagtgtcacaatcttggttcattgcaacctctgcctcccgggttcaagcgattctcccgcctcaaccttccaagtagctgggattacaggcgcatgccatcatgcctggctaatttttgtattttcagtagagacagggtttcaccatgttggctaaactggtctcgaacttctgaccccaagtaatccccctgctttggcctcccaaaatgctgacataggcatgagcctccttgcccggacttccctccttttccttcagggattttaaatgttttctttcctccatctatttaattatatgtgattgccttgaggatttcagcttgaattaaaattacatatatttacctgtctttattaatatttaaacatattaaaataatacatgttcataatgaaaatgaaacattacaaataaatacacaggaaaggccgtattccccctccagttccactcttgaaataaccagttaacaagatgatgagcatctttccatgatgttctccaagactcaagtaagtattggccagcacaaaacagaatatacagaccaggcgtggtggctcatgcctgtaatcccagcactttgggagactgaagcgggtggatcttttgaggttaggagttcgagactaacctggtcaacatggtgaaaccccatcgctacaaaaaaatacaaaaattatttgggcacggtggtgagggccttaatcccagctacttgggaggaggaggaatgagaatctcttgaacccaggaggagaagtttgcagtgagccaatatcacattactgccctccaacctggatgacagactgagattccatctcaataaataagtaaatacataaaataaagagaaaaaaagaaagatgaaggaaagaaaaagcaagaaagaagaaagaaagaaagagaaagaaaggaagaaagaaagaaaaagagagaagtcgtgtgctcaggttgctaagatggatggtaagaacaaatcctctagcagtgaaaatgtaagaagggaaagaaatttcgcttagtcttgtttgttgcaccccaagctctaaaaagtacagtcacatgtgtgataaatgcttagttaagatgaaaaagtcattaaatttgtgagtggaaatcaaacagaaatatgttctgattgaaagcaattgggtcaatgctacccaagtttcaggcatccactgcgggtcttaaaacacatctcctgcagataagggagggctattatataacgtttctttcttttttctttaattataaagcattctcctttttaaatataacaattggccacatatatcactttaggtataaagatattaggatacctttatagtagataaaatgctaactcattctttgtaagagttaaagtatctttcattatatgagcatttaagatattaaagtacttttgccaccaaaatagtgcttctgtaaatattcttttacttataactttgttagtttttacttctgctgaaacaaattgcatgaggaaacaagtgtatgtgtgtaaagtgtaatatatgtatatatatttaatatgggtatatacaacttactatatacacatacatacaataacatatacaatttttgttttgttttttgagatggagttttgctctctcatccaggctggagtgcggtgacatgatctcggctcactgcaacttgcactgcttggttctcctgcctcagcctcctgagtagcacaggcatctgccaccatgtccagctaactttgtttttttagtggagatgggtttttaccatgttggtcaggctgctctcgaactcctgacctcaagtgatccgcccaccttggcctcccaaaatgctggaattacaggcatgagccatcgtgtctggcctaacatatacaatttaatgtatatacaaatataggttgggtgcagtggctctcactcctgtcatcctagcactttggggagctgaggtaggggattgtttgaacccaggagtttgaaatcagcctgggcaacatggtgaaaccctatctgtacaaaaaacacaaaaattagctgggtgtacttgcaggtgcctgtggtcccagctactcaggagactgagctgggaggatagctggagcctgggaggtcgaggctgcagtgagttgcgatcatgccactgcaccccagtgtgggtgacagagtgagaccctgtctcagacaaaaacaaaaacaaaccaaatataatgtttatgtgctacacacttgatttctttccaaaggtttatataacactgtactttcaccagcaatatatgcgactactcatttcctacatactatcacttgtgtgcagtcaaggaaacttagtaggcctgaattgcccaaacctggcatactccaaagaatggtgtgactctatcctagttcctgggaaataacctctaagtccttggactctcctgcctatctgggagttaacaacgtgatttattatggggaccttggaccatgcagtgtcagcttgaccttgggaagggtggagacagagaaactaatgtcatccaaatgggtgctcttgtccatgtgaccaacctccagtaaaatgctcaacaccaaggctcaggtaagctttttgttggggagtatattctatactgtttgccacatatcgctgggtgaattaagcactgtccacatgatgtcacttggagaggacaactggaagcttgtgctttgtctctcctggactctgacctgtgcacctttttctgctgctgattttaatctgtatctttttgttgtaataaactatgagtaaaacagcttcactcggttttgtgagtctttctaattaatcactaaacctttgggacctcagaacacaatgttgtttcttcttcagttgaattttccatgttatgtaagaaacctatgtgcataaatgaaaaatcacaaactaagaaagagctttccatgcagtctactcccccaccctgtttctccaatcctcccaggtctgcttcctgaataatcaaatgtctaaattttctaaactatttctaatctatatatctgagtgcttatctctatattatataataggtagaaccagctccttctcaatatatcaacttgatatattacctgatggcttcctgtcctgatagctgatgacttggctgacactcaccccttaccctagtgcctggaccacttttcaaacacggtgctctcaccattttcttcctcttttcttttcttttcttttctttttttttttttgagacagaatattgctctgtcacccaggctagagtgcagtggcatgatctgggctcactgcaacctccacctcccagattcaagtgattctcctgtctcagcctccggagtagctgggattacagaggcatgccaccatgcctggctaatttttgtatttttagtagagacggggtttcaccctctcagccaggttggtctcgaacgcctgacctcatgatccacccatctcagcctcctaaagtgctgggactgcacccggccaatctcactattttcaatggctctcttggtcacctttcacttgggagagtagctgaggcaggagaatcacttgaacccgggaggtgggggttgcaatgagctgagatgctgccatagcactgcagcctgggcaacaagagtgaaactctgtctaaaaaataaataaataaataaaacagaaaaggaaaggaaagaaaagaagctctctctccatatacctgtaaggatcattgtgttaattttcttcatgtcttaacatgattcttgccttgtcagagatcatcctatctgaaattgaaactatttaccacttccctttttttccatagcacttaaaatatttttttttttttttgagatggagtctcgctctgtcacccaggctggagtgcattggtgtgatctcggctcactgcaacctccaccccccaggttcaagtgattctcctgcctcagcctcccaagtagctgggattacaggcatctgccaccatgcctggctaacatttttttttttttgtattttagtagacatggggtttcaccatgttggccaggctggtcttgaactccttacctgaggtgatccaaaccacctcggactcccaaagtgttgggattacaggggtgagccaccacacccagccctggctaatttttgtatgtttagtggaggcaggttttcaccatattggccaggttgatatcgaacccctgacctcaagtgatctccctgcctcggccttccaaagtgttggtattacaggcatgagccactgtgcccggactgctttttgacaaatcatttctgttcttacattatgtccactagaatgtaaacttgatgagagcaggagatattgtcaattttgttcaatgttatttatccctagagcctagaactgtaccatgcacatggtaaggagacaaatatttgttgaatgaatatattgagcagctgttctcagactgtttggtttcagaaattctttactctctgtttctttactcccgacctcaggtgatctgcccaccttggcctctcaaagtgctaggattataggagtgagccaaaacacccaccacccaactaatttttgtatggtagtaggcaccgggttttgccatgttggccaggctgatcttgaacccctgaactcaagtgatcccccacctcagcctccaaaagtgctgagattacaagcgtgagccactgcacctgactaaataaaccaaaaactttagataagtgaatttggaggaaatacttataacagataaaatggacaaacagataattctaatttactgtctctctggcttaataaaatattagtcaataccctaagaagaaaggaacaaaatctaaaaattcaccattcacaaacacaaatagttggaaaacaaagtcaaaacctaagaacttgttgacttatctctcctctgaaatcagctcttgaatgtgttgaactaggattgacctcggattaggaaattttttaaatattttttaaagtttcactttttggaatttaaaattaatccaaattatgtaatatataacatttggaatttaccagtcaatactctatcattttatttttcactcttcaaataatttcttgttcaagaatttaaaatgcttttaaaattaatagattcggcaggctatggtctgtagagactgtctctacaaaaaataaaactacatatattttaaaatatatataaaatatatatttatttaaatgtatatgtttcaagtatataaaatattttttttaaaatttcatttttttgccagaacttatggtaagcatatgtttagtctggcaggaacttgaaaaactgccttccacagtggctgtcccactttgcattctcagcggaaatagagatgaattcctgttactccatatcttcaccagcatttggtgttggtgtttgcattcaagccagtctaagagatgtgtaatggtatcacatcgttgttttaatttgaatcccctagtgacatatggtgttgagcatcttttcagaggtctaagaaatgtgctgggcatggtggcacatgcctgtggtcccagctactcaggaggctgaagtgggagggttacttgagccctggaggttggggctgcattgagccatgattgcaccactgcactccagcctgagtgacagagctaaaccctgtcttaaaaagataaataaggccaggcgcggtggctcatgcctgtaatccaagcactttggaaggacaaggcaggaggatcatgaggtcagcagatcaagaccatcctggttgacacagtgaatctccgtctcaactaaaaataaaaaaattagccaagcatggtggctggtgcctgtaatcccaactactcaggaggctgaggcaggagaatcgcttgaacctgggaggcagaggttgccgtgagccgagattgggccattgcactccagcctgggtgacagagtgagactccatctcaataaataaaaataaataaataaataaataactgacttaatttttagaacagttgtaggtatacacaaaaatagagcagaaggcatattgagctctaatatccacctcacaccatagtacacacacttcctctattatcatcttgttagtgtggtaatttgttatgcttgatgagccaatattgctattattaagttcacggccaatattaagattcactctctatgttctaccattcatgggctttgacaaatgcttaaggacatatatccaccattatagggtcacacagaaaagtttcactgccctaaaaatcttctgtgctccatctattcttccttccctctgctcaagcccctggcaaccactgaactttttataataccatctgcctagttttgccttttctagtattccatataattggaactctatactatgtggcctttttgtattggcttctttcacttagaaatacatgtttaagattcctccatgtcttttcatgccttggtagttcatctctttttatttctgaagaatattccattgtatgaatgtttcagagttagtttatccatttctatattgcaggatatcttggttacttccaatctttgtcagttgtgtataagctgctgtaacattcatgtgcaggatttgagtggatataagttttcaaatatttgggtatataccaaagaatgcaactgccagatcgtatttaaacatacaaggatgcagatgccatacacacaaatatgtatgtatatgtcatgcttgtatacaattttaaatgcatatatgtgttctatggatatgtaagcatttctctattttcacagaaatgtcactctaaatcagtacctagggagggtcatcattttctttatctacaaatcaagacacagtatgagtggctgcacccaatttggtaagtcctctattattgaggatgttttcctgtttcctttgtcattgttgttgttgttttgttttgagacagagtttcactcttttgagtcaagtggtgtgatttcagctcactgtagcctcccgagtagctgagattataggtgcccaccaccacgcccagctaatttttgtatttttagtagagatgaggttttaccatgttggccaggctggtcttagctcctgaccgcaggtgatccatccgcctcagcctcccaaaatgctgagattacaggcgtgagccaccatgcttggctgctttcatcatttcagactgagcttggagaagaacctgagggaaaacatgactttaaaattttgatgaatggagaaatctctttccattcaccttcctttcctctatttcattcttattttaaaatatgcagacaaagatatggatacatcagttattaaataaacgtctgtgtgatacctatccaggtgaagaaatagagcactatcaccaccgagaagtcctccttatgcccctaaccgatcctaaagtctttcttccccttattagtaacagatataacagatatccacattacctgtggatatctgccatcctctccttggttctctttataattttattatgtattttatatatttttttcgttttggagatggagcctcgctctgtcacccaggctggagtgtagtggcatgatcttgactcactgcaacctccgcctcccagattcaagcgattctcatgactcaacctcccaagtggctgggattacaggcatgggccatgtgccaccatgcctggataatttttgtatttgtagtagagatggggttttgcatgttggtcaggctggtttagaactcctgacctcaatgcctggccttattatgcattttttatattcctaaggtaaagtctgattttgcctggtttttctcttacataattggagtaaaagtctgtatcctggtgcatctggtgccttttactcaatattaagtatttaagattcacacttagcattgtttctgcattctattgaaacagtacaccagccaggcatgatggctcacgcctataatcccagcactttgggaggtcgaggcaggcagatcacttgaggtcaggagttccagaccaccctagccaacatggtgaaactccatctctattaaaactacaaaaattagggcacgtggtggctaatgcctgtaatctcagcactttgggaggccaaggcaggtgggtcacgaggtcaggagatggagacaatcctggcgaacacggtgaaaccacatctctactaaaaacagaaaaattagccaagtgtagtggcacatgcctgtagtctcagctactcaggaggctgaggctggaaaatcacttgaatctgggaggcagaggttgcagtgagccaagtttgcaccactgcactccagcctgggtgacagaattagactctgttaaaaaaaaaaaatttagccaggtgtggtgttgtgtgcccgtaatcccaattatttgagaggctaaggcaggagaatcagttgaacctgggaggtgatagaggttgcagtgagccaagatcacgccctgtactccaacctgggcaatagagtgatagtctcaaaaaaaaaaaaaaagcccaagcgcagtgcctgccacctgtaatcccagcactttgggagtccgagataggtggatcacctcaggacaggagtttgagaccagccttaccaacaaggtgaaaccccatctctactagaaatacaacaatttaccgggagtggtggcacatacctgtaatcccaactactggggaggctgagacaggataattgcttgaacccagggggcagaggttgcagtgagccgagatcgcaccactgcactccaacctgggcaactaagcaagactctgtctcaaaaaatatatataaatttatatttatatacataaaataaatataaaaaataaaaataaataaaactacagtacaccagtgtgtatcccttcattgttggtggacatgtgggttgtgttcatttttgtcagttacaaatgatgctgttgtgaacatgtttgtatttctatttggttaccattagtgtgtatttatgtacagtataaaccaagaggtgaaatcacaggttacagggtaaacatatcttcagttttaccaggtattattggtttcatcccaatgttaacacaccaactgacagtcttacaatgtctgataattcccaaatcttcgcattcttcttgacacttaattttgtcaaaattttaattcgagtcttttggtgagtatgtggcaatgattgtgatattaatttactgggccttttcttctctataacaggccctgtcaagatatatgtgtggtgtggcaggggtaggagcccctagaggtagcatgggctctggaatccttaatcattctatgtgaaaaagttggtgcggcagtgatttttttgtttttttgagacagaatttcgctcttgttgcccaggctggagtgcaatggcactatctcagctcactgcaacctccatctcccaagttcaagtgattctcttgcctcagcctcccaagtagctgggattagaagcatgtgccaccacacccagctaattttttgtatttagtagagatggggtttcaccacgtttgtcaggctggtcttgaactcctgacctcaggtgatccacctgcctcagcctcctaaagtgctgggattacaggcatgcacccctgcaccctaatatttcctatgtgcaatggtgtagccagggtgcaaagccggttcttaatgattctgtcatccaaatattatatattctcgattccccttgagatatgctcattcctccatacaattaaacaatcccaattactcttgcaggagcataaaatcctccctgtctaatcatgggtccttccaaattatttgttggcttgtgtttaaaatataaaaaagagaatgtagattttgttttcttcttcctgcttaacctgaacaaaatgtcatagttacctcctagcctgttgctaaaccaaggagagtcacttgaataatgaacaagactggagggaaaccacatggataatttatcattacactatcatcacatacatggaactcatcaatgaagcttacgaaaaaaattgagtcatttgtggaaaagtgtaaagagaatataagagatgcctcaagtgaagagaaaaaaatctgcagaaaataattacaaaaaaagagtgttaagatgtaaacacaaattcagagattcaggagcacaaagggttaagttaagggaaaaaagagttatcagtattttcttattcattatggagagcaggatgaattcttaaaaggtcaaataattgtgagtctgatatatctgatgataatttgtattttgtatttctaatgttgtaaatggttgttaattcacagtcattattcctatttcctttagactagtgaccatgagtttgactgacaaaaacccattgggttagtattgttatctatgtgtgttcatcatgctatgtgttaaaataagtccatcaatttttgtcttgtgtttgttttcatttcattttagtttagtttctttgggacagggtctcactctgtcacccaggctggaagtgcagtggcatgatgacagctcacttcagcctctacatctccagtctcaggtgatcctcctacctcagcctcccaagtagcagggactacaggcatgagccaccacacctggctaatttttgtattttttgtagagatggggttttgatatgttgctcaggctggtctcaaacacttggactcaagtgatctgcccaccttggcctcccaaattgctgggatgactggcatgcaccactgtcccggcctgttttcattttattaattggctgattcattcagacacataattatcaagtcaaatctcactctttccttagcatttcccttccgtttagctgagaaaatctattcctattttaaaacatatacgattattcgagtgtggtggcacatgcctgtaatctcagcttctcaggaggctgaggcaggagtatcacttcaaccctggagtgatatagtgattatatataatatataactatatagtgattatagtttataattttaactatatcatgtctcctgcctcataagtgccactggacaaggtcccttttatgaactcagctgctgtcagaggtaaatgtattttgaagtggagaacaaagttaagtgcaaaattggcatggagaactaaggtaattatgaaagctccagatacaaagagagagggctcaatatgccagcagttctcttccaatccatcctagcggccttcttttaggattgcctaaataatgcaggagatgggtgcaagacacacaagtgttccagaagcatgtaaacaaggtacagagaagaggataagataaaataagatgagataagaatattaggaatgccttgttcagaaggttgcctacagaggcaaaagggacagtttcattttgctgagggaaacagggtggtaagaaccctcctggggaagatccccacttaccctgatacagaaagaaggtgtaaaatttcataatgggagagcattaggctgagatagctcccatggccagggttcctgcatagacaaaatgaaacaagcttagcccacccacaagtggcctgctgagtattagctgcgtaatgagagacctaccaccaggatagttcaaataatgcaactgcccacatttttgccaatcaaataatttctctactctacttctatactcaccctataaaagccttccttacaaacacctccagtagatcctccaaccacttttagtttggagctgcctgatccatgaatctctgtttgcttaaataaactctttaaaattttaatatgcttaagtttatctatttttttctcattttaaaaaattgagatgggatcttcctatgttgtccaggctggtcttaaactcctggactcaagggatccccctgtctcagcctcctgagtagctggaattatagacgtgtgcctccacacccagcttacatttatctttaaacaagggtttgacctctttctgaaatatatttctgtgaagacctgtaccctcagtgatatggcaggctcattttagaccatcgagcacttttgtctctggactacaatttgccctttgtgacctgctctactaaaaaattcaagtgtaattcaagttagtttaccctctgctgatcaggggagattgctctcggtgcaagttcaaaacaggcactcacaccttcattcataccccaaatctcagcatcacacaatacacccatgtaataaacctgcaaagtaccctccgaaatctaaaatgaaagttgaaattcattaaaattttaatttcatcttattacaaaacaaagataaatttactgctttccaattttgatatatatatattatactgacatacacactgtattctatggtgaattatgttgattgaatttcacattttaaactaacactgagttactttgaaaaactctattgcgtgataatgtattatgctgttaatatattttaatacaatttgcaaatattctgttttaaaattacatctatgttccataaataaataaatatgtaaaaataataaatgtttgtattattcaagtgaagattatagcaatatttttgaatatctacttaatctcaactagttttaattcagaagtagcaactccatagaaattcagcttattactaccttattactcatacttgtctccttgaagaagcttcattgctatcatccagtttagaatgggatgtcataaatctctagactgagtagtataatatccactgtacaaataaaatcaaattattattataatgttatgacacctccaaatacaaaaagcaagcccatggatgtcaggttaaggtatagagaaaatattcctacttactatcttttagggcagacatatcccagccaagctgattgcaaaatgaaatggaaaccatatggtggaaggggacttgggactcacagattggattttcattccaacccttacatacacaagctgcatgactctgggtagcttgcatattctcttagactttcaatttcctcatctgtgcaatggcaattaatgcctatgggctatggctgatgtggggataaaagaaccaacacggatgcatgggcagggcctggtccatggagcagctggcatcaacaaatggaagccccttcccatcttgtctttgcgtgcaccacaaaatccggaatatgtgggtataaaaagtactcttaaaagatacataactggaaacttttgcaaaaagagattggaaaggtgtcacatcttgtggcatgaggagctgtgggcatacacttgaactttgtgctgtgagatatccacagaacttcagtagctgaagagaacagtttagatgtcatcttattcatctaccatagaacttcctcttcttctctgagatttctagacaataacttttacagctctaataatgcagttgtctctcaattgtttggactattctaatagatacaaagcagtatttcaccagcagatgctactgcagtttgtatgatgatttcaaactgagaatctatttaaagttatgcaatactttttttggaaatagggtgaaagtagtttaagcttaaaatcctataaaataggcttacagtaaataattacttgttgcaatatctatcatactatcttatattcacacatgtgttggtgtcctaatacatatgtatgagagtgaaagttacctgaggtcagagactgtgccatatgttccctgcaccactggtgcctatctcagcacatgatatacagtagatgctcaataaatactttcacttaaaaaatgcactgagaataaatcttattagacatcaaaatacatatgagtacaatctagggatatggtcaggagctcaaaattcaatcttatttattttttatttggagacagaatctcactctgttgcccaggctggagttcagtggcatgatctcagcttactgcaaccttcctctcctgggttcaagtgattctcctgcctcagcctccagagtagctgggattacaggtgcacaccaacacgcctggctaatttttttgtatttttagtaggcacagggtttcaccatgttggccaagttggtctcaaactcctgagctcaggcaaactgcccaccttggtctcccaaaatgctgggattacaggtgccagccacaacgcacagccacaaaatgttttaaagtagcttcaaaacccatttgcaaatagatgtattcataacaagctgcaaacaagaaaacattgagcttcatataatagaagggttctgcctggatttgcatgtggccccatcatttgtttgctgttgggccatggtcaggttacgtagctgctctctgcctccacataggctttatgcctgtgtatccctcatctacaaaatgggaataataagaatatctaacagttagaagtggagaaaatatatgtaaagacctttgaaaagggcttgtgaaagctcaataattgtcctcaataattgctgtcaataactgtcagctatcattcaatcataatcataatcatgaaaatgtaagactcaaagaaagattctgacttcatatccagcttcccaaaagaatcagacactggacctgtgaaaagaatgacattgagatgtattttcacattgctaagttggttttttctttgccattcaatttctgcagtccctactctaagcccatggtccactttttatttttcctcctaagatgtcttcccttcttgtaagatttacttttccttaaaaagggctcttttcatctacccactcttttgcccttcccagaagttggttaatgggcacaaaaatacagttagattgaaggaacagaaaaatttctagtgttcaatagcacagtagggtgatgatcattaacaataacttatatatttcaaaatgactagaggaaagatgtggaatgttctcaacacaaataaatgataaaagtttgaggtgatggatatgcaaattatcttgatttgatcactacacattgtatgcatgtatcaaaatatcacatgtaccctacaaatatgtataattgtcatgtatcaataaaaataaaaaggcctatttctctttccttccttcccgcattccctcctgtcccagatatgtgttgttcctggtgctctcctgccccccgttcagccagcactgagccagcaggaaagatctcacaggtcatatcctgagataaaccctccactacttcaggtaataatcctcctgcttttagtcatttatatcctttggttcatacatattttgagtcaagtaccttctaactactgatctacataatattccttggtttttaaagataatacaaagtggattttagtaacaatcttgagtcatcacagaagctaatgaagttggggattccacgaagccatccaagcatataaagcccatttccttgggtcccttttccttagctcaaggccacaaaaaatcagaacgtgaattccagcccacatttgcattatgtctaaataattatgagttataaatgaagctaacaaatagttaaatatgttctattctcctattttgataaatatactgccataatgacccacaaggtcaaagttgagtgtagaattctctgatttcttggtgctctgcacaggaatgtggtagtaaagggagagccgatcctcagccccaggctaaacttttttctttcatcgtaggtagccctgtcctcacttgagaagctttgcatacccttgtgtggggaactccctaggccccatgcaagctccatccacaattctcaccccttcagaaagcagatctttgggcaccatttggacaagcacagtttgcactttgaaatggacccagggaagaggccatgcaggctcaggcacatttcgccagggccctgagtgcccagcgtgtgccctagaagagagggtgaagctctgagtgggccagggtatagtcagtggagggccagagaggcaccttctcaagtacaggattcagggcaggggtcctcttgcccagatcaatggctatgattgcttagtgcaatggcgcctgcgtcatgtcttctcacctcacctttcattcagtctcagccaccgtgggaagttccatggaagcacaggcttcccttgtgctgccagcaaactcaaggtacactttctgccctagggaatctccattattgtaggattttgcctgagcacaaatacagcccagaaacacttgcaggttaacagcctcaggggaagacctcaaccagtgtgggacaggtggacaaatgctccaggctcatgtttcaggtggacagttctggataactttctggagcctctcggaaggtcctgcagaaaaaactgcatggcaggagcctcaatagcatgccattattttggcttttctttcttgcctggctcactcttcccacttctgactcttgcttcttggaatcacttcccaaataaaccacccacaccgaagtccttactccagctctgcttctagggatacaggcacaccttggagatattgcaggtttggttctaggtaacacaataaggtgaatgtcacaacagcgcaagtcacacgaaattttttgcaagtcacacgaaattttttgctttctggtgcatataaatgttatgttgctaggcatggtggctcacgcctgtaatcccagcacactgggaggccaaggcgggtgcatcacctgaggtcagaagttcaagaccagcctgtccaacatggcgaaaccctgtgtctaccggaaatacaaaaatggtggtgcgcacctgtagtcccagctactcaggaggctgaggcaggataattgtttgaacctgggaggcagagtttgcaatgagccaagattgcaccactgcactccaacctgggcaacagagccagactccatctcaaaaaaaaaaagttatgtttaagttgctgtagtcaattaagtgtgcaagagcattatgtctaaaatataatgtatataccttactttgaaaatacgtgattgccaaaaaatgctaaccatcatctgggccttcagtaagtcatcatcattttgctgctggatggtcttgtctcaatgttgatagctactgactcatcgaggtggtggttgctgagggctggagagggagtggcaatttcctaaaataagatgacaatgaagtttaccgcgttgactgactcttcctttcacaaaagatttcgctgtagcatactacgcagtttggtagcattttacctacagtagaatttatatcaaaattggaaccaattctctcaaaccctgccacccttttatcaactaagtttatgggatattctaagtcctttgttgttctttccacaatgttcacagcattttcaccaggagtagattccatcgcaagaaaccactttctttcctcattcataacaagcaacaataatatattattttatatatattatatattatatagcattatataataatatataatattatatattgtatattattatattaattatattatattatatattttatcataatataatatgtattataatattatatattatataagcagaaatgatatcccttggtttttaaagataatacaaagtggattttagtaacaatcttgagttgtcacagaagctaaagaagttggggattccatgaagccatacaagcatataaagcccatttccctgggtcccttttccttagctcaaggccacaaaaaatcagaacgtgaattccagcccacatttgcattatgtctaaataattatgagttataaatgaagctaacaaatagttaaatatgttctattctcctactttgataaatattcacagtatattatgataaatatattgccataataacccacaaggtcaaagtcgagtgtagaattctctgattccttgttgccctgcacgcgaatgtcatagtaaagggagagccgatcctgagccccagactaaacttttttccatctaattccatttatttccattaagattgcagcaatttgtccaggtgtggtggttcatgcctgtaatcccagcactttgggaggctgaggcagatggattatctgcagttgggagtttgagaccaccctaaccaacatggtgaaacaccttgtctactaaaaatacaaaattagccggatgcagtggcacatgcctataatgccagctactcaggaggctgaggcaggagaatcaattgaacccaggaggcggaggttgtggtgagccgagatcgcagcattgcactccagcctgggcaacaaagcaaaactccatctcaaaaaaaaaaaaaaaaaaaaaaaaaaaaaaaaaaaaaaaaaaaaagattgcagcaattcactcacatcttcaggctccacttgtaattctagttttcttgctatcttcaccacaactgtggttacttcctctgctaaggtcttgaacccctcaaagtcatttatgagggtcagaatcaacttcttccaaactcctattaatgctgctatttttacctcctctggtgaatcatgaatgttcttagtggcatctatcatagtgaatcctttccagaaggtttctaattgactttgcccagatccatcgaaggaatcatgacctgtggcagtaacagccttatgaaatatatttctcaaataataagacttgaaagtcaaaatgatgcctcaatccatggactacagaatagatgttgtattggcaggcatgaaaccagcctgcatttccctgtacatctccattagagctctttagtcaccaggtacactgtcaaaaagctgaagtatttgaaataaatcttttttttcggagctgtaggtctcaacagtgggattaaaatactcagtaacccatgcggtaaacagctctgatatcatccaagggttgttgttccatttatagagctcgggtagtgtagatttagcataattcttaagaggtgccctaggatttatggaatagcaaatgagcattgtcttgtaagaagaaagtcagcctgtcttttaaatctttttctttttcttaatataaggtctcactccattacccaggctggattacagtggcatgatcttggcccactccatacttgacctccttggccccacaaccctcccacctcagcctcctgagtagcggggactagtagcatgcaccaccatacgtggcttttatttatttatttatttatttatttatttatttatttattgttagagacagggtttcaccatgttgccccggctggtctgaagctcctaagctcaagccattcccccacttcagcctcacagagtgctgggattacaggcgtgatccaccctgtctggcctctaaatttgtgttatggagactcattttcatggttaaaatgtcctgaattgactgtggcctgttgggaggcaggatggaggaaactacttatggaaaatgaagaagaaagggaagcacaccagaagcaagaaagtgtcatcaatttttacatcaaggactccatgataaagagaaagtacaggtggcctgttatcaaggctgaccattggactgtggactgcacctgcatctaccaggttcttctggatagtcccagttttaaatttttgacctgacattcatgaacacagtgctactggtcagacctttgtccaggtttaagcttcagaacataatgtcttcatgcagtgggaggccttattatggttatgattctgccttggggcatctgccccttctgacctggaggtaagcttggcatctactacttacctctacacttgaacagccaaggatgggctgagcacagaggctcacatctgtaactccagcactttggggggccaaggcaggaggattgcttaaggccaggagttcaagaccagcctgggcaatatagtgagacctcatctctgtaaaaacaaacaaacaaaaccgaggatgggtgggtgacagagagcagtttaacatcggaaaccataaatctgagaggtggaaggacccttagaccagccccacattaacagatgagactctgccctgagattatagcctaaggtaatgcattgagcttttctagagatttgaaaataatcaatcgtaaaacccccaagcatactgctactgtttgctattgaataatgttttctagtctgggtgtggtggctcctgcctgtaattccaacactttggaaggtcgaggcaagtggatcacctaaggtcaggagttcgagaccagcctggccaacatggtgaatccctgtctctacaaaaatacaaaaaattagcaggccatcgtggtgtgcaccggtaatcccagctgcttgggaggctgaggcaggagaatcctttgaacctgggaggcagagattgcagtgagccgagatcacaccatcgcactccagcctgggctacaaaagtcaaattccatctcaaaaataataatgataataataatgttttctacaagcaaggagttactttgtactgtgaactggtgtgaagggatctgccatgtgtaagcttttggattgatgacagttatttctaattttaaaaatagcaacccaacagaaaattgggaaaatgcattcatagggatttcacaaaagagaaagcctgcaaaacataaaaattttctcaacctcattagtaatcagggaaatgcacaagatactacacatctattctctccacaaatattaagaagtttgacaatacaaaatgtattagtccatattcacactgctgataaagacatacccaagacagggaagaaaaagaggcttgattgcattaagggttccacgtggctgaggaggcctcagagttatggtggtggatgaacagcacttcttacatggcagtggcaagagaatatgagaaggaggcaaaagaagcaaaagacaaaaccactgataaacccatcagatcttgtgagatttattcactatcacgagaatagcatgggaaagaccggccctaaagattaaactacctccccctggttccctccccgaacacatgggaatcctgagcaatacaattcaagttgagatgtgggtagggacatagtcaaaccatattattctgctcctggcccctccaaatctcacatcctcacacttcaaaaccgatcatgccttcccaacagtcccccaaagtcttaactcatttcagtattaacccaaatgcccactgtccaaagtctcatctgagacaaggcaagtctcttctgcctatgaccctgtaaaatccaaatcaagctagttacttcctagatacaatggggatacaggtaattgagtaaatacagccgttccaaataggagaaatttgccaaaacaaaggggttacaggccccatgcaagtccaaaatccagcaaggtagtcaaattttaaagctgcaaaatgatctcctttgactccatgtttcacatcaaggtcatgctgatgcaagaggtgggctcccacagccttgagtagttcttcccctgtggctttacaggatatagcccacctcgtggctgtttccatgggctgatgttgagtgtccacagcttttccaggctcatggtgcaagctgtcagtgaatctaccattctggggtctggaagagagtggccctctcctcacagctccaataggaagtgccccagtaaggactctgtataggggctttgaccccacatttctcttctgcacagccctagcagaggttctccatcagagcaccacccctgcagcaaacttctgcttggacatccaggtgttttcaaacatcctctgaaatctaggtggaggtttccaaacttcagttcttgacttctctgcatgtgcaggctgaacacaacatggaagctgccaaggcttggtgcttgcactctcaaggccatggcctgagttctatgttgtcccctttcagccatggttggaggggctgaaacgcagagaaacaaggccctaagctacacacagcacagtcaacctggcccagcacagaaatccattttatcctcctaggtcccgggcttgtgatgggaggggctgctgtgatgacctatgacatgtcctgtagacatattccccattgtttttgggattaacattcagcttcttgttacttatgcaaatttctgcagacagcttgaatttatcctcagaaaatgggattttcttctctatcacattgtcaggctgcaaattttctaaaactgtatgctctgcttcctttataaaaccaaaggcctttaacatcacccaagtcacctcttgaatgctttactgcttagaaatttcttccagcagataccctaaattatcactctcaagttcaaagttctacaaatctctaggacaggggcaaaatgctgccattctctttgctaaaacataacgagagttacctttgctccagttcacaacaagttcctcatctccatctgagaccacctctgcctggaccttattgttcaaaacactatcagcatttttgtcaaagtcattcagcaagtctctaggaggttccaaattttcccacattttccagtgttcttctgagccctccaaactgttccaacctctgcctgttacctagtttcaaagttgcttgcacatttttgggtatcttttcaggagcaccccactccactggtatcaatttactgtattagtctgttttcacactgctgataaagacatacccaagtctgagaagaaaaagaggtgtaaagaaaaagaactgtaattggatttacagtcccacatggtgggggaggcctcagagtcatggcaggaggtaaaaggcacttcttacatggcagcagcaagagaaaatgaggaggaagccaaagcagaaactcctgataaacccatcagatctcatgagacttattcactatcatgagaatagcacaggaaagactggcctccatgattcaattacctcaccctgggtccctcccataacatgtgggaattctgggagatagaattcaagctgcgatttgggtgtggacacagccaaaccatatcaccatatatggagagactgtggatcaacaagatcatctcaaactaacacaggaggtgagcgtttaaattagaacaaccactttggaaagcaatttggattatcttataaatttgagcattctcatatgttatggcaaagtaatttctctaccataggccctggagaaactcttgcccatatgtaccagatgtagtaaaaaaaaaaaaaaaaaaaaaaaggctcatgtaatgtcattcataagaggaaaaatctggaaataagccaaatgttcattaataggagaatgggtaaattaataggagaatgggtaaataaattatacccttaaaaactaagtaacatgtcatttagggtaatcatatgtatgcagtaaaacaatgtgtttttttaaaggaagagaatcctaaacataaattcagggtagtagttaccctcgggctgaagggtgaaaatcaagaaaaaggacagaggaggagcagatgttagggtcagaaccctagttctttggttgtgttgtaagttcacaagtgattaccatattgttcaaatacatttacacagagacccaggcacagacaagggtgaaataggagccaaggtgtactatgagccaaggattatgattaatccaattttgtgcactttaagccatttgaaaaacagaaaagcaaaacaacaaaataatttttaagaaattgaatatagggtgctatgctctgaatgtgtccccctaaaattaatcaccaatgtcataggattaggaagtagggcttttaggtagtgattcagtcatgaagggagagtcttcacaaatgggtgtaggatccttacacaaggactggagggagtgggcttcccctgttttgcccttccgccttctgccatgtgaggacacagtgcatctcctcctgaagacacagtgcacaaggtactatcttggttgcagagaccaggccctcaccagacaccaatcctgctggcacctggatcttggacttctagcctatggaactgtgagaaatacatttctgttcttcagaaattacccagcctagtgtattttcttatatagaagcacaaactcattaaggcacaatgcctcttgtcattttcttctacaattttctttgttgcttctttagcactgggtcattttatatttgctccttcataatatctcttactttcggtttttcacatttctgttccaagtgtattcttagatacatattttccactattagttaacctcaggggttgcctgggaatgtgtgtttctgtgccaccactgtaggactgtgtgtgtgtgtgtctcccattctctcttctctgtctctcaccctctgtgtgtttctttccttctctctgttggtctgtgtgtgtgtgtgtgtttgtgtttgtatgcccgtgtgtgtgtgtctttggacgaatgtgctctgtttgccaaaatgcgattttttgcatgtcggccagtctttgttgagcctctttctgcgtctctgcctgggtcccgtggccagttgtccatcattttcacggcggttccactttgggtttgtgaagtcctcgatcacgtgaggagatgcgtcggtcccggagcaatcgaagtctcatccccatcctgagcggcctcttttctaggatcaagaggaccacactccaacccaggacaaaacccctcagcagctcattgtccggcaggagaggagcagacacacctccaagaagatggttgtacccctgcacggctcttctctgagcaatgaagccacaccacgatacaattctgaagaggaagcctggaatgggagacagcaacaatccctgtccctggaatgctggcctctctggacaagtcatgcgtttcgcacccctccccttatgcccgtggcggtggcaaggttctttaacctgcctgggctctggcctgtgctctgtcctccctcttgctctgtctcccctgtttctgaggggcctagttgcctcttggtctggctgaataacttctacgaagatcgcttcccagtccatcagggagacactttctggagatccgcgacatgactctttctctctccaaacctgtttctgctggattgggcaggtctgataagcctggaacacttggcttccatgcgtgtctcagacagggaagcttctttggtctccttgtttcaccttattggtgggtggattgcctagaatgagcgctaggtgatcatgactggccttgtcttctaggacaggtggtgtcccatttcctttgcacgtcctgtctcacaaatgagggatatcttctcctctgctcataggtggactgattccctgaatcttttgtctgtaacgaatgtcaggaaaccaaaggaactgggctgggcctggggatggggttggggccgggtgccgggaaggttgcgtcagggctacctgggcggtggaggcttcggggtggggtgaatgttgcagaaacctctgtgctcctctggcaggcatttcaaaatgtggcttggactgagggaaaggccccgtccaggttcccaggtcttctttgagttcccttggcactcagggaaaggccacttgttcccccttttcaccgggcacatgcctggacaccattgttggtttcgccatcaccccatatgcctctggtgatgcacattcacaccatctgctgtgggatacgccagtgccaggcgtgatcgcattgtctccacctcggcttcgcaccgtccctgtttgcacctgtcctggaaagcggtgtccgcttgcaggagccccagggcttttagaagcggggcacgccactgctctttcaacggaggagggaggcagagggctcacggatcagtgaactttcagctgacaccacgccttgagggccatgggatcattctgtgctgcagcgacgacctgcctgcctcaccagatgtgctgagcccatcctttctaacccggaggggtccaaactaggatctgaagaggagtcctgagaacccagcaggcaccctgaagatccccctccatctgtggaagtcggctcaaggaggtcttgaagattggacttctgagggtttggccctgggacaggatactcaaggactcctctcccaccccgccccaaactggacctcagcccccatgccacagcccccactttctccccagagctgagggacagacagagaattgtgactagaaattcgatcgagtggtacgaggggccacgtggccaggggctggccaatgaccaggccgcccgggatgagctaataatggaagcaatttgtaactttcagtagctctctaggcctgggtaccggagggagggaggtgggcagaggaggggagatgggcacccccagtctttccatcctcctcattcgactaggggcacccgaatcccctattccttatttcccctatcactcaggcactggcagggtcctttgcccactcctgttggccgctgcggctccaaagcgaggtaagctggtcctctacccctcaaactcttcacaaccctcatcccgtttaccagcacctgcaaaccacagcctcccttcctgtcccattagtgaatttaaatcggattttgtttttcctcttagttgaaagaaaaaaaatctttttgtgttcttttgtgtaacctatctcggatttggagaaaattttaattcaaattaatacacttatatgggggggtgagtggtactttcctccttttcaataaatttctatacttgctactttatggagagtttacttttctttggggatgagttacaccttatgttttcacatgtgttacttctttaatgataagttcaactcctttctccattccatcctccaattttgctatttataaatatcacctaatggatttagagtttattaattttcatcctccgtcactagtttttcagctgttacagaatcaccacaatttatttttctctgtatgtggatgaggttttgtgttgattcctctttttgttttgtaaatgaatttattgtttgggaaactcttgggggggtgtaaaaaaggtctcttgattaattccaacctctcctcttctgaagaacaatttgcttgaaatgttttgagtattttcctcatttttattatgtctaaatttgaggtattttaccttctttaaaacctggcctctttttaaaatttaaccttttgcatgttaaaccatttttaaggtttttgttttataaactgcaatggttagtagatttacttgcctttccctgacctccttcacgcgcctgcctcctccatctcaaaactcccatccccagcttccacaattctcagcttccaatggactcatcctcccctctcctcccagccaaggagggatgcctgggaagtagacagtgtccttcttgggtcagaacctatgctctggttctagttcaggacacctccagtctgacctccaagccggcaaaacaagtgagagcagaatttctgctcaactttttcatttgggactaagttatttccacttggctgtattctggagaactctgatacatgaaattgaattttaaattctcatttttccctaaattctaagaaaagtgcaggcagattgtttttcttccttaaatgtaagctgttagcttaggggtcagcccttttggatcttttatctcctgagggagacttttcagagagacacagagtgttgattcttccctttagttttgggtaagctagaaggggcagatcaattgggcttccatattgatctctggctctagctctgaacaaagaagggtagagagctggcctggggacttgtccctttggtcagtaaggtttggcttaggagagagtttgaagtaaatcccagctctgaggaaattcttctttttagcattactgtgaaaataaactcttaaaatggtgtgacatggcttcaaactattcagattccttgaagtaacaaaaataaacttacaagagtaatttgtgtttcccaaagatccgcctccagtgactgtccatttctctcagggaaacagaacccaactgggcagaagtaaaactgccacccctcccctttcagttccccagtcacattgacattctgggcacatttggcccagccctcatccctgcttctcccaagtatgaatctaaattactattaataaggggctgctccaagttaattggcattaaaagaattcatttcaatttgttaatattaaatgaatgctctgcactttagctcccttcttcgccctggattcccagatgagtgatgggaagagagggcagggaagtagaatgaggattttatttctggctcttcagcttagccactgtggtgcctcccctgggggtgtgcgatcaggcacagtgggggtctgcttggggaaggtctgatggtcttttttggtgaaattcatctgtttcagcaggagttgtgggggagggtgggtggggagcagagggagagggacagaatggtttgggggactttgtggggagcagagggtctagggagaaagtgggaagggaaagggacggaggtcaacaagagttttggaggacaagggttgtaggctgtggggggtaaagccgatttgtgaagaactggtgataggaactaaacaacacacctagaaggggaggggctttgagcaggggtggggaggtgggatttgaggcaaaacagccaggagttctgaaactattaatatttaactgtgtgactcagggcaagttgcttaacttttctctctgcctcagtttcttgacctgtaaaacagggatactaataatagaacttatctcagggggttatttggaattagaggaaatacatgccatgtgttttccacagtgcttggcacatagaacctgccagtaaatgttagctctttttatggcagagtggttaacaggatggattctggagctagacggcctggttttgaatctcagtcatgccttatgtgagttgtatgacctaggcaagttacttaaccccttgtgctttagtttccttgtctgtaaaacggggttaatagtacctagctcaaaggctgctgtcaggattaaatgagttatatgtacgaagagcctggaacaatgcccatcccataggagacactatgtaagcattagttgtcactgatattgttgctcttctgatctaggaaggttgaaaatagaggcacaggtgagctactacttacaggctaagattggaatcagatcaactctttcactcttatccctgaagctagtcctgcaactggggctgcatatgagggcttggggagagatcctataaccctggaatctgggatatccaagtccttcctctgctctagctcttgggttggggtggggctggtaatgggagaattactttcttggtctaataactccctttagtagagagttagtcctgggagtgtgagttgggggaggttgggtagagcagaggagattaaatatcctttatgtaccagcccacacacacttgacctctccagagggttgggaagacagagattcaaagaggggaagtgatctgacaaagtcctaaagctagaacttggcagagttggcatctgaactccgatctgcttgatggcaaacttaaagcccttccattgctgcatgctttttgaagggagaaatgggacacgtgtaaacttgggccaggaccatggggtagatgtaagatgggcaaagatagagtattggagtgggaagtggccaagcaggaatgtttcaatcatggaagatttcctgaggaaagagattccacatcagggttcagatggtaggagaatgaggataggaagtaaagaagagggagggagccatgcattgacaaggaaggagaagaaaaaagaatttatgcaaaggctgggtcagagtaatggacatgaattcaatttgccttgggtttgccttaccatttattgaaggcatactatgtactgggtacatacatgatcacatttgatgttcacaacagccctgacaagtgggtttcttatccctatttccaaaagagttcattgaagttctgagagcttaatccccgctttaggttacacagtagtagctggatttcctggcatcagaaccctcacctacgctgcctctgagcatggcttctgtgtcccagtctcgatttccatgactgtttcaagtcctcctgttcccccgcatttgtagtcactcttggtgactgggaacaaagggctagagcgtgagctgaaactgagacagggagtggcaagcaggcagtggggacagaaacttttctcgcatccacccatgagaagaagatggacagaatggtggtctttctggagagaggcttccaagccactttcccaagaaagacagctgatcttgggatgaatggcagggacctgattgggtaggggatgggtggtcacattgttttctgggctgtagactttatttcccttcctttgggaagagaagaggaagaggacagctcaggtgtgggtttgagccctggattaagactgcccattatccactaaaatctcttctttccttgcagcacgagggtggagggacacccagctggacactccatttcccagctgctcttattgccaggtgtagacacaggggaatgtgaggtgagcatgtcctcaaagcctgatggattgggtaaattctcctttgtgttctctctttcatgagctgggcagatgtgcctgagacaggtttgaccaggcaactgaaaagacatccctaagagaagacaaagcaaaggtatgaaaggaacacacatccctgactgactaggaggaacagagctgcctgctgtctggaaccgcttcctccaagactaagtgagaaataaacttctgttttctatatgctactgtgttttggggcctttgtgttatagcagttttgctgtcatcctttccaatttaccttctcacaccagatttttcaaattaaaaagattatatcaggccaggtgccatggctcatgcctgtaagcccagcactgtgtggggctgaggcaggcggatcacttgaggccaggagttcaagaccagtctggccaacatggtaaaatcccatctctactaaaaaatgcaaaaattagctggacacagtggcacactcctttaatcccagctacttgggaggctgagacaggagaattgcttgaacccaggaggcggaggttacagtgacccgagatcatgccactgtgcacagtctgggctacaaaatgagattctgtctcaaaataaaaaactgattacatcagatcacggaataactataataatatttattgggccagatagtatgccaaggactctatgcatattatttagtgtaatctatgtgacaatcctctgagatacgtgttactattattccaatttaaacacaaggaaacaggttcaaggaaggtaagttatgtgctgagggacacacaggagggagtggagctggatttcaagcccactggatgtgcagaactgagccttttcaccatgggggcaaatccctcctgaggacagggctggaaaggccatggagatcatcttgtgcttggacaagcctcttaacagtcacaacagggacctgactcccattcctaccttcaagaagctcagcaggctactactcgtgttcatgttgggtcactacatacggttttatttgaaggaaggaccccagagttaaactcatttgaaaacccctgataaattcagtcccctccctctttttacaggtgaggcccggagagaagatatgacttgcttaaggtcacacacttagtttctctttcaatctttctaaatctaggacgagttttcttcccactgtatcaggctgcctgaacaaacagggaagtacaaaaatagccaaatccaagaaggaaggcagtggtctgtgtctcctccaataatttcatgggacagccaagcctattttcttgatttcccttgtgcccctcctgtcggatatctgctttgggaaccatctcttttgggcttgcagagagaacgggctgcaccagctctctaccctctgcatcacccagatggtcaaacatgcaaagggaaaggagagctggggccagagtcaaggcaggcaaagagactcctcgaccccctccagtctttccacatttatatttttggaatttcaggctccctcctcccccgggacctttcctagtagcccaccagggagaagaagagggaaaactgccataaatttctcctacttatacaagatgacagagtttcttgtgccagaaaaaacacagaaagggagctctcagtggagaagggacccagccctataccttctggggtcaatttatctttctgaattgtggcttgggggctaccttaacattgcctgtatgaaatgcaggctttgacttggggcaaccaggccagacagcccctgagctttgtttctgatcacagttttcctgcttcatctcaacttccccctaccccttacgctgtctttttaaaaaacaaccttcttgaggtataattcatgtgtcatacaattcaccatttgaaatgtacaattcagtggttttagtatattcacaggtatgtcaaaccatcaccatagttaaatttagaacattttcatcacctcaaaaagaaatcttgtaacctttagctatcacctccctatccccccatattccttcttgcccttaacaatactaatgtactttcagtctctgtagatttccctattctggactttcatatgaatggcatcatataataagagacctactgtgactagcttctttcattgagcatagtgttttcaaggttcatccatgttgtggcatttatcagtacttcattccttttcaaggctgactaatattccattgtatggatatatcacactttgtttatccgttcatctgttggcgaacatttgggttgtttccaccttttggatattatgattctctctttcctcttattctctagacattttggatagtatccagtgaggcctgtgggcaagaatgggtgtttcttatatttgggaacacctagtacccatgaaaggagggtcttggcacatgtctgctttcatattaagtacatgtactagctggaattttcctccctctgttgttactgagttggggctgctccctcctttatcaattctccctttttatcatgattgctatgttggaaactcgctgactcttcagactaggggattcagatccttctcttggggcttcagagacatggagtggatgaatgaatgtcttcccatcagggaagagttcctgagtctggtatcaagtgattatccagtgcctcacagtggaaggaaggtctgtgaagactccagggttgagggaaagttatgttcttggaggtatgactgagcccagaatccaggcctccagtttccatctccttgcctggcccatttcagtcttcagacattctttgaggtccattcagtcactcacccagcaacagacactgcctctgccctcatggaccttgcagttctagtggtgagagtaagatgaatacaagtgagcaaaatgatggcaagttgttcaagcttgttcaaacttctaaacactgttcaatgaatgaatgaactaacaagaacttactatgtgctctggaaagaaaatgtgaaaaatgtcgagttgtaaatcactttctgctaccgctacctttcctagtctggaagtcagcattacttctccatcccttggaggagatagtgggcagatattacaaaatgttagctaaaaagagccaccatttattggaccagacatacaccaaggggtttctatagttcattaattttcaccctttgaattaggcatcaatatttccattttgaagatgagaaaaaccgaaacccagggtttaagtagctatctgaaatcacacccataccagtaagtggcagaacatttgctctggacactgggataagtatgtgtgtatgggttttttttgttgttttttgttttctgtttttttttgatgttgttgtttgtttgttcttgggatggagttttggtcttgttgccgaggctggagtgcaatggcatgatttcagctcaatgcaacctccacctcctgggttcaagtgattctcctgcctcagcctcctgagtagctgggattacaggtgcccaccaccacgcctggctaatttttgtatttttagtagagacggggtttcgccatgttggccaggctggtcccaaactcttgaccttgtgatccgcccgccccgacctcccaaagtgctgggattacaggcgtcagccactgcacccggccatgtatgtgtttttattcctagcacttcataacaaatgccaacatctcttcctgcggccctaccacagagggagctgatcagtttcccctcctgcccaaaggcacagcagccacagtggaagtgcctgagtcctccctcacagccttctgtctagtggttattcccgcttcaaggctaaggaagggaaggaccggttttgccttcaaaggttttttccttccagcccttgctgtgtagcccgttgtgtgtgggaggaaccatgagaggcctggatattgtcaacaaaagacttgaacaagccaaagagctgatgatgttgacaagaaggggaccttaacaaggcagataatcaaaagttgatgactgacagccccttttgcatcccttcaccctctgctaaatcaggtctcttacatgatcttgatgacaaataataaaaattataaacacattacagttttcacatgcatttgttcacttctcacagcaaatatgagaggtatctaaggctgagcagcttattacagaaaaaagcttatgggactagaaccttaattttatgtaacaaagtttatatagagcttaccatggatcatgtactctcctaaatagttcaaaactttcatttttagagagatgggtgtcttgcagccaggcgcagtggctcacacctgtaatcccagcactttgagatgccgaggtggacagatcacctgaggtcaggagttcgagaccagcctgaccaacatggtgaaaccccatctctactaaaaatgcaaaacacaaaaattagctgggtgtggtggttcatccctggaatccggagactgaggcaacagaatcacttgaatccaggaggtggaggttgcagtgagctgagatcatgccattgcactccagcctgggcaacaagagtgaaactccatctcaaaataaaaagggggggagcggtcttgctatgttacccaggctggtcttgaactcctgggttcaagcaatccttccacctcagccttctgagtagcaggactatgggcccatgccaccaggcctggctgtatctcataactattaactcatctactttttcaccaccatgtgaagtaggcattactgttattcacattttttaagatgcagaaactgaggcatggtaatcaagtatcttacccaaggttgtacagccagcaggtggtagaacagggatcttgagcccagccccagcatctgtaaccacttcgcaaggtgggcatcgcatggggactacacttgaaactctagtttgttagtctggtgcccctgcttccgcctgcctccctcagtctttatggcccattggaaaaagcaagccagagctgtggctcccagggtgacgatccttcagctgcttccttggcactgtcattccctcctcccatctcccgccaagggctacagccgagaataccacagacggtttgccatggatcaagatttctctcaagaaagagctcacagaaaggctgctgtgagaaaggaagtcacttgctactccccttattcctccatcaggaggagctagatgaggtcactgcacatttgagtgggtgctatcaaagcacagcctctggccagtgtggagacaaacgtgggctgtgtggcccgtgactgagtggctgaaaggaaacctgaggtggtaggtgatggaactgattgaaataaaacttctgtaggaatgctgcatgccattcattcaacagtgctccctgaccaggtcccagggctgtgcatatgagctgcaaatgggtttgttcattcatttacatatctatttgcttatttattcaataaattctgattacgcccctaagaggcactgtgctagatatcaaggaagaacaagacaacatcccttccccacaggggctcccggtctagagaggggaggaggaaggaagatccacagtgatttgcatcatatgctgaggaaagagagtcatttactatcaccgtttgacatcctcaccccagtgcggtccttctctttgtctctccatgctgagagtgggcagtccctgctctgccgtccttcagacacagccctcttccctcaagctgccctctgcctggatcccacctcccttgtgagctggagtatttgcttgaaggagtcttgactctctttccctgtcattcactgtttggctgcaggcagtgacagtggtggcaataaagcagcagagaggaggctttggtatcagagcagggactcacgggtgggatgggacggggatggttttctgtttgccccactgtgttctctgtgctgctctgcccagggaggctgacctctgcagactgtgtcacatgggccccctgatctctcggccaatagagttcccggctgagaagggggagagaggagtcagggtatttgtttcctccattccctgtcagcccccctttttgcctgcttgaagctctggtggtggttgtgtttcctccatggtcacagctttgctgagtggcctctctcttgtgtcccgtgagcccagttggcattgggctttggtagagatatttctatcctggtgccacactagcaccaggattagttttcttcatctggtctatgcctttagaaactgtcaaatcactaaacccttcagtgaaaccctctcgaatgtgtcatttattttctgttgccaccctgactggctcacctgggtgcagaggaggtggggacagagcaggttggggctccagttcagctttattatccctctttttcagggtttcccagaggaagagagagaatttggacaaatgaatgaggaacaatgctctcctgagagtttctttaaggggcgagaatcactgccgctagctcctttgaaagcagaattaagaggcagtgcaggaaggcacagcaggaaggctcatggttagactacagagaaggaagcagccactgctggggacctaccctgtgctggtcactgacaagctgtctcattaaacctttccggaccctcaacccctcctagtatcttatcctcattttatagatgagaagactgtggcccagagaggtaaagatctggggagcaggatgggagcttcactttgtctcagttgttctggcaaagagaagcctcaccttgtgatcaagggattgggagggtgacagataaattttggcttaagtgtcagcatagcactgggaatctggagctagatggcactggcttgactccttggatctgcctcttactggctgtgtgatactgggcatgcctctgtttccccatctataaaaatggggctaatgataataacacctgccttacaggttgtgtagaaggttgaatttgtagttgtgaggtgcccaggaacagtgctggcacacagtgagcgccatacacaagtgttacagaatggagcctcctgctctctccttattttccaccccctgccctcttctcattgcccacctcccctgccttctcctcatcatcctgaaaaagggtgaacagccacccaggagcccctgaacaggcatgttggtcccaggccctttgtgagcatgcttttccctgccctgccccctgtcatcaccattctggatggagcagcaaggacggagacacttagttgggctatccactccaggtccaacgccagtgggatcagcttcgatgggatgcacacagactgacctcttctccccagccccttcaatttcccagagctgcagggggcctgggagttcttggtaacagcacattaaacctctgtttgtgggaactttaatttaaacacaaattagagatggcaaatgactctggcagccagataagccatcccgggagagcaaggagaaagccaagagaatcagcccagataaggcctgactttaaactactggtgatacccagaagcctgggacagatgaaatctaggggtcctgaatgaagaaccccagaagctccacaccccagttgtccttgctctgggctctatgccagctccctctcctgtgttctctatatttctatctttttgcaaaattctaacctgattctttggctccatccctccgacccccaccccactgttttagagaatgcactttctttactttgcttctcatcttcttctgtgacctactattctgagaaagttctacttgttatctaacctccatctatgctactacctttagagtctaatacatcctgcttagtggtagctctgggagtttctgttcatgtggcaaatgtggtgtggtaaaaacaacctgaaaaagacctgggtgaacttctctgcatctcagtttcctcatctgtatgatgagtgtgtgagaaagaatctctaaggacttgtaaactctgacttctcacagagaatctgaggacaaggacatcccaggaaatctctattgttctggaactcatgaattttccactgttctactgtttgggagtgagcgtggggagagcagtcaagcctgttgattcctttctgcgaggggtctacaggctttgcttccacccctccgcccacaacccaggcttaggccaggcccaggcccaggagagaggctgcctttccagttctgtcaaggcctgctgagcccagctctgtggggctgtggctgctaagatgttgtctctgtcctctggggtaggagcaacatatgttccctctgtcacagcacctgtgagggtggcagagggatggcaacccccaagagggcagagttccatctctccaactgaccttgaatcatctttttatcctgcttttctgggaggcttaaagtgaaggtggagggagatatcgcacagtcccaaagcccccactaaatggggagctattgtctttcatctttcatgcagggtaaaagaagacacctcggctacagcaagaggaaagaaggtcaaaccacaggcagaactttcaggttgaatgttagagcagactgtgatcccaagaggtcatccaagacccttggtctcagaggatgactatgaggccctggtccctggctggggtgggaacaataatcccaacagccccatgctagactgacttgggagtcagaaggtccctgggactagaatagaaggactttggcattttccctggcctagggcccttagacagaagtgggcagctgccatcaggagcctggggcccagctgtgtccaccccttgccctcctcccccctcctgagtgcctggctgcccctggagccccaggcttgcctgccatctgggcagctcagaggagggcccactgccaagggagtgccagcgttgatttatggcccacaaccttggcaggctcaggctgtgtgcccgaactgcctttgctcagggaagagatgctcctcttaaagggacagtgcagaggaatgcaggaaagtccaggacaaaagcttggcagggggctggcaaaaaagacctccacccatcagcactctgggtgactgtcactccctagggaaacttctccctagggaaccacccatcaaacctgttatcataccctatcctttgtagacttggcccaactgtaacatattaatatgtttactgtcagtctctcccactggactgtaatctctaggagggtaggaaccagacccattgtgctcattcctgaatattcagcacccagcacagtgcctggggcctaataagatctcagtaagaatttgtcaagtgtaggaaagaatgaataaatgaaggtccttgtccaggaggtggagggaagcccacatgtcttcttagtgcctgtcatagtttccgagaccctgcggcatctgctgctatccccaggatctctccctccaggacccttcctcacccctgtcatatcaacccaggaccaatggggccaatcttatctggatacccttgccttcccactttccttgagtcacctttcttaagtccttcacacaatgttcttttcctcccattttccttcctccaagatactttctcaggttacctacagcctcagtcctggatccagatactctttcagataatcttttatttttttatttttatttttattttttatttttcttgagacagaggctccctctgtcacccaggtgggagtgcagtggcagtcttggatcactgccacctgtgtctcccaggttcaagtgattctcctgcctcagcctccagagtagctgggattacaggcttgtgccaccatgcccagctaatttttgtatttttagtagagacgaggtttcaccacattggcccggctggtctcgaactcctgacctcagatgatctgcccccctcagcctcccaaagtggtgggattacaggcatgagccactgtgactggcctatccagcaatatttactgagtatctactatgcactaggcacaggttgccaagaattcatgaataaatggaacaggcataatccctgaactcaagggccatacatttcagagagtgaaacagacaaaaaaataagtaagcaagttagcaaatagatacatgcaattttgagacctgttgtgaagtgggtaatcaaagacagggtggagcagggaccctttaaattgggtggtcagctaggcatggtggctcacgcctgtaatcccagcactttggaaggctggggctggcggatcacctgaagtcagcagtttgacaccagcctcaccaacatggagaaaccctgtctctactaaaaatacaaaaattagccagacgtggtggcgcatgcctataatcccagctacttgggaggctgaggcaggagaattgcttgaacccggaaggcggagattgccatgagctgagatcgtgccattgcactccagcctgggcaataagagcaaaactccgtctcaaaaaaataaaataaaataaaataaaataaaataaaataaaataaaataaaataaaataaaataaaataataaaataaaataaaataaaataaattgggtggtcagagaaagtttctgtgaggaagtgacacttgggctgaggtttgaagaatgagagggagtcatgtaaagagtgaggtaaaagcattctagaaacagttcagtcacctgggtgtgcacagcagcatttgggggatgggagtgggagaggagatttcccaaactgcactctcctatctcttttacattttgaaagcccttgcccttctaatgtgggaggaccactgcttaaaatctttggagaagcagccctggccttacctggaagctggttagaaaacagagctcaggtgccaccccagatctactgagtccgaatctgtattttaaccaggtcccaggtcatttgtgtgcacagtggtgtttgagaagcagtgtttcaggaagtacctcacaggaggaatggagtgtgaggacatcagatgatgtgaggtgggtggggttagggggttggttgctgaagagtggatttgaatcacagatgggggtctgagtgtgtatatgtgcctctgtgtgtgtgttcctccagccctaatgactgtgggctatatgaggatgtgcatctccaagtgcttttccttccatgggtgtggagtaccaggggatactgtacatctttatcccactgtgacagtgcccccacttccacgtacagctgtgagtcaaacagaatctgccaacctctgggtggtgggagcatctcagaagcaaggcaaggcaaggagatcccttgttcctgacctccggcaatccatttatttgacccgagtctcataaaggcgtcctgatgagcccaatcgcttgctaatggttatgagccaagacctggggatttatggctgaggcctccgtggccacgaacaggagtagggctgcgcacaggaggccaggctgtgcatggcttcagttcatggaggcctgtacccagaaccacagcggagactaccacatccccacctccaaaactggggcaaagaacattgccctgggtgggggaagctgggctaatggcctgacttggctgggtggggtgtagggggagatactggagaagtgagtggaaagggcactggaattggagccagtcaaactggggttcaaatcctggatctgttttccacccgtgtatgacactggaaaaatcatggctctccctgagcctcatttttctcatctgtagatgggaattgtgatgctatctcataggtttgtgagaattaaatgaggccaggtacggtggctcatgccagtaatctcagcactctgggaggccaaggtaggaggatttcttgagcccaggatttcaagaccagcctgggcaacatgctgaaaccctgtctctacaaaaatacaaaaattagccaggtgtggtggcatgtgcctgaggctgatgtgggagaattgcttgagcccaggagcttgagactgcagtgggccatgatcatgtcactgcactccagcctgggtgacagagtgagatcctattgagagagagagaattaaatgagataatgtttgtgaaaagcacttcgaataccaattgtatatatttaagtgggtcaagagattgggattctaattccagctccaccactaacttgctgggattctagcactggttttgttacaaatggcttttttttttttttttttttttttcctgagacagggtcacactctgttgcccagactggagtgcagtggtatgatctcagcttgctgcaacctctgcctcccaggctcaagcaattcctctgcctcagcctcctgagtaactgggattacaggcatgctccactactgcctgctaatttttgtatttttagtagagacagggtttcgccatgttggccaggctggtctcgaactcctgacctcaaatgatccacccgccttggcctcccaagtgctaggatttcaagcgtgagccaccccgcccacccagttaccaatggctttgtgacctggggcacatcacagaccctttctaagtcttagttgccccatagacactaagaggggacacagtgctcttttggttgcctccagctctgatgttttgtggttctaacgaggagtccttatttggaaatggaactttggaatggtttggatctcattctggccatagagagggcatcattgcaactgtggcttcagggccaatgtgcggttaggggggctgagtcagaacagctccctcttcctcgatagtgccatcctgtgagtataacccctgtatgggtgttggacacagtgttggggaagactgtgcaacaggggtaagtaggaaaggccttgtggtagggggttagctgggtatccatggaaatgcctgaactactcatgccttttgcacaagtaggtcttcaaataatctcttcttcttccctctttcccactctttccctgtctaaggtgtgtggtggtggtggtggtggtgtgtgtgtgtgtgtgtgtgtgtgtgtgtgtgtgtctaacctgattgggagagtaagccaaatggagtgaagtggagaaacatccccaaaagtcccaggtagagacctaaggatttctaaatcacagtgcagaacagggtcctctacccttttcccattctgggaacatcctgaagccagtcattgtgggagagagacatgacccccaacccagcctcacagaccctacccctcttccatgctttgccctacactccttccgtgtgcttgtatcctaaccttaagccctagagacttctagctacccagagagcagcctattcagtgatgtttactgagcgcatgttgtgtgccttgcactgggcctggagcaagggctaaggagtgaaattagacctgatccctgtcctgaagatgtcacagctgagtaggcagaaagactttaaacagataatggcaacacgatgtgctaaggaacatcaatgtacaagataacaggtagtctgtatttatgggagagggaggcataaaagaagatgcttcagctgctttctaaacatgtttgtcgtggaacattgaaaacatacgaaaacagagcagtatagtgtcctcatcatgcaactgcaacaatggtcacaccaggatcttggtgtgtctatactcccacccacgttccataccccactgcaccattacttggggtggaactgggctggttttgaaagaggaacggcaattccccaagtagaaattgctggagggaaaagtttgcaggcagaggggatgctgtgctcagaagcttgagcagtgcctggtgctggtacatcaaaccaaagctgaaggagtgggacaagatgctttggcccccgtgcatgctggctctaatgcatctgtcacacagcatgccttgtggctccttttggaactggggtctccaggcaagtcttcggcagagccaggttagggcagagccagccttttgagtgcagggagtgaggaggcaccgctaagacggcgggccttggctgggcgtccacggggctttggtgggcctagagtgctagggactggcatgcaccagcactgacaggcaaagagggcgcagtcaggccctccaccccgggtcggcacgcggtcttaaatattacccgggagttttcaattatctctccttaatggatttgcaggggctctttcgtcaagcgcagggtggctgggtgtgggggtgcggggagcgcgcggcgagggctggagctgggaaaatgacccatatttcaatattaaagccctttacgatcgtcagcagcatgaaagatgctgcaaattaaacggagccgcccgcgccagcctctccatctcgcaagttttaattaacgctgagggggaggcggctgacaggcgggtcggagccgggccagcggcggatctgggagcctgcggatcccagattccgaactggagcgtcagggatctcgcgggccaggccaggcggaggcggagggtggtgggctccgagtcctgggcgagggcgcggaagatgcccgtggagatgggcaaggctgaggggtgggggacaggttggaaggtctctgagcatctgaccgggaaacaaaactctgcaactgaatgcaggaagctttgttcttaaaggtgagggggcttgtggccaaatcatctagctcttcatccccaggctccttcagcgcgcatccttctgcctctcttctttcgaccaacacttcccccaaacgctcccccgcgttgattccctgtcccctcccacctcatcctgtggccccttgtttcgggaggcagttgtgcttctgtgaccccctggctcctgttctgggacgtctgctttctccatcactccctggcttcccgggcgggccccatcctcctgagcggagcggagcagcgtgcacagaagcgccactgttctgccttggcagggcctggcccgacagcttgtgcctgcgcagcagacccatccgtcaggcgggaaggatggagcgacgtccggctgcccgctctgaggactccccagggagacacatctggccttggcccagactcctctcttcccttctccccacccgccaacccttcccccaaataccagctcagtatatacttctgtctctcctcctttccttgcttctcctcctccctcccatacacatgcagcctggggcctggggcccaggagagctactcctctcatgggtcacactgagaagtccttcctccacctgcatccacatggcagggcataactctaaagcttaaaaagatccagcgatctcagtggaccacaatccaaagctaagtcagccaaccaacactcaagggcttaaatcaaggactttgggcaaaacctatagagtggaggaattagaaaaataatacaaataaaagacatggtcattattcctgggtatttacagatactttgtgcttcctgaaatgttttgcagaaatcacattctcctctcattgtgctacacagcttgtaagcaccaagacaagaaattcaatgataaagcaaaaagaaaagaaaagaaaaaaatcctcttctactttcttcctggtgtgtattttttcttgtcaatttctgataatctatcaagcctacttaaaatagtgcctgcttatgcagtatggttaggatgatgaacacacttaaacaggatagggaataagtacaaactacaagtgctgtggggatgcagagtaataggacaagtggtgaaaattaaaacatttttggcttaatcaaggagtacttcctggaagaggggagacctgatttggaaggagaggtgatataaacttgaaaagaaagttccagatgtggaaacactggttttattctttgtttttattttgagacagaatcgtactctgtcacccaggttggagtgcagtggcatgatcttggctcactgcaacctccacttcccgggatcaaatgatcctctgcctcagcctcctgagtagctgggactacaggtgtgtgccaccacacccagctaatttttttgctttttttgtagagatggggttttgccatattgctccagctggtcttgaactcctggactcaggcaattcccctgctgccttggccttctaaaatgctgggattataggcatgaaccaccacacctggctaacaccggttctaaaattaggcagaatctatattttacttcaggttgaggagcagataatcttggctatattttccctgacaatacagtaagatgaaagaagccttgtgcaatagcaggaagaattcagggtagacagtgggatcttggctaatgctggagactaaagtgaatggagagagaccctgaagcacccttctcccatacttggctatgggctatgggagggatgcctggactctgagacttggccaccatgttgtgttttgccattagaagatttggacatgaagttgaataaggcaggaacgacctcacagcatcaaccacaacccccaatgtggctggagaaggagggagagagggcaaagaatatcttcctcttactcagattgtaagtggagaaactgaagtccattcactcaaatcaataagtgcctactgagcacctcctatgtggcaagcactatataggccctaaggatccagagatgatcagggcatggtccctgtcaacatggtgctcacagtctagtgggaaatagagttcactcgtcattctatcattcaatcaaaaacaaaaagtattgagcacttactctgagccaggcagagttgcaggtgctggagatgcaactgtgaacaagacagacccaatccctgccccatcagagagtactacctggtgcagaagacacatacataaacaggcagctataattcagggtgatgtatgatatgaaggggaaaggacagttgccatggggtggcatatccatagatatgccatagatccataggttcccatgaggggatctatccgagtctgtgaaaggggatgcgaggatgatgtggaagaagcaacaccgaatctgatctgctcacaaggtgcgcagaagtcaggtgtgggatatcatggggagggtgtcctggcctagagtttgtgttccttttcagcatcttactaggagcttgtggccaaatcaggcccaggcagagcttcttccctctagtcacaggatagcactggcctgcaccaacacagctcttccaacaccagcaggggaaaccagatgataatcctaacagagccagaccaaggaatgaggttatcagttttcctttttctgctgggaagtttctgccttggggctaggctatgtagggggaggctgggaggtgggagggcactgtggaggatcttactctttccaccctcctctcactgatcctagttttgaacaagaaacaggtgatctgtttctctagttgcagctgaatagaaaccaggacaagaaagtgttgtcctccccagacacgtttctgtctcctggatcctaaacagctgcctacttgagccatatgacttcaatccacagggcctcccaggagctgaatccagaagggcaagaacaaagtagcaaagcaggaaagggcattcagaagagaacagcatgggcaaaggtcccaaggccagaggacttggaaactgcaagtccctcactgtagagatgagtctgtagaggaggttgacacaagcttgtgaaagacccagtatgccaggctaagggggtgggaacagtgagggacactgagggttttatggcttaaattttgacaagtgtatctacatatagacaactaatgtaacactcctttttttttttttttttttttttttttttagagagagatggagtctcactctgtcgcccaggctagagtgcagtggtgagatcttggctcactgcaacctgcgcttcctgggttcaagtgattctcctgccttagcctcctgagtagctgggactacagactgatcccaccacatctggctatttttttgtatttttggtggagacagggtttcaccatgttggccaggccggtttcgaactcctgagctcaagtgatccacctgcttcagcctcccaaagtgctgggattacaaagaacactttctttttttaactttttttttttttgagacagagtcttgctttatcatccaggttggagtgaagtggctcagtcatagctcactgcagccttgacctcccgtactcaagcaatccttcttcctcagcctcctgagttgctgtcaattttttttttttaagagacagggtctcactatgcaggctaggctagtctcaaacttcaagagaccaaggtgggaggatggctgggctcaagagatcctcctgccttggcttctcaaagtgctgggattgtaggcgtgagtcactgcctgtccatataaagtaaccctcttgaacccactatccagacttgaggttttgttaagttactgttaaaattttgtcaattttgctcttgagttttcaaaataaacaggtcattacagataaagttgaagttccctttgtcccttccccagtaccattcccctccctttcagaggcagcaccatcatatattttttctatttttgtcatagatatatatccatgaataacattataaggcttcagtgcattttaaaaagaggtccaatggttatgatataatttataactttagttttccatcgcacattttttaaaaagtctttatttgaggttttcggcaaagtgctgacaagggtaaaactagcgttagaagatcatgctggttaccaagtggagtattccaggtgacagaggaggaccaaggatggtgacagtgggaaggaggagacagaggtaaaaggagactccacaccacaggtcactggtgatcgccctgtgagggcagggttgttttatacatgctgttcttcagcaccatgaacagggcctggctgttgaagatgcccagtaaatatctgttgacagagaaaggttgacaggggcagatggatccaggatgactcccaaattcctaacccagtggaaaagcctggatgatgatcccagtctccattatgagggccccaggaggagaagctggattgcagggaaagatgaatccagaagccatctctctgatctagaggaaacgaggctgtgctgtgtggaagggattaatgttaggaagcagaccggacttccgttcttaggacagaaaaaaaatcttgtagcaggtagttcaaggctataaaagatctgaagggacacagagatggtaagagtggaaaggttcagtcctgctgggggcaaagggatagttgaaaaacaagccaaaaacaataatcactttcctcagaaggccaggagggcagggcccagcttctgcgtcagccacaatgagtgtctcatagccctctgtgcggtgggtacccacagcccattagccaaggcagaggaggaggaagaaggtatagtaagtgcatctaggatcataaagaccttgtcagatgcccacactcaactttgctcccactccatattcatcaacaagatggaaaagtggggtgcttacagctgcttcttaggacttattcttgaccaaattcaatttctctattcagggaaggatgtgaaatataacctgctttccaactcttaagacccagagctctggctcttcacctcaaaaagctaccctctgcaagagctccctcaaagtcactgccacccccacttcctcaccccaccacccctgccccaggcacagccaccacccaccctctgctgctaattcacctataaacggtctcctgccttgcgtctccactcagttttgttctttctctaacaggttccactcccctgaaagcccacccgatccttcctgttaccctagcactgacttcctaaatgaaatgcagtggctcacagttctgtccttctgtttttatcactctttccactcacaattctttgggacctggctatggttaagtggcatttctctacttcatccctgggtgcagggacagaaatgcttttaccatccccagtgcccctctctgggggtagcagagaagtcactttagttttgtttggtctggtggagtaaggcacgcccttctctcagagagggagctgtcatggatgtaagccagtccctgtcctaggagtacttgcaatttagacttgctctttagtcaaggaatgttaaatattgtaaagcaatgccgtagctggagggggagaatcttggaatcccctttccatgagcctgctatttgaaggtgtggtgggatcccttggaagtgtgggccccttgtactctggatctaatccctagagtcaccaaagggccaacataatgattctcaaaccaatctgtgattggtcccctcataccttgaacttgggcaggctgctaatttttatcagagcaatacaccctgtagataccacctccctgaactctaaactgagcagagctctaaaccatcaaagaatcaggctatatagactaccaccttaaatgggtgtagattcaacatgattcccaaagtcacgtgacttgcctcgctaaccagggttcttccttagtggggaaactacttgggccttttttccttctccttttcacttacctgaattattacatttatttataattaacatatattgcatgtaatattaaaaaaaataaaacttagaaagacttggtggtgggtgctgctgaattaggtatcagagccccagttaggtgggtgtcctgtggagtttctgatgaatcaaaagccattgttgagcactttaaaaacatggacgccttgagccctgggcagccccaaggctgtgactaccgagggcacccacagaggattagaactggggcactggaacgagaggaccatcagaagcaaggcctggatgctcaaattcccaccacagtcataaaacttaagagcatctaaggcgcaagcagcttttagtttctttcttaaggatccaactaatcttgtgttccaccttgtagccttctataaagtgtgaccattcacttggttgatgattaatgattcagttagtaattattaaacagaaaggaaccagaaataagaatcataaatttaaacaaaacattgcatgttcttaatgctaaacttgaaggtaaaacactaggaaggtagaaaacacaatgttgctatttgttttgttcttttaaagaatgaagaagtcagatttcctggtccttgtgtaggctctcttcctgacagggtttctcaaacttttctgccaaagtccctttgttattagaggcaggagggtaaacttggatcccagcagtctgagggattgccctgaagggccattagcaaggaccaattatttctttttttttttttttaaaaaaaaagacatgtttacttaaataataggttacttcatcttcattatttgcattatataaaaataggattttttattaataagaaaatagcagagtcttttgtggccttaagttttagctctaaaatgatgcaaactttgcattttataacgtagtatattttatacaacttaatataaaaatgatgttttaaaccatctgccatcaaaaaacctctgtggccctcagagaggcttcttatatatccggggacaccctcagcgagcagccactgcagtgtggcctggggcacttgcacccaggtgagaggtgctacggggtgcggtggtttgttaaactagctgccactgtcccaggttgtatctttaatgactaccatttagtgagcactactatgtgccagactctacgccaaatgcttttgtatgcttatgccatttaaattctcacaaccacctgcctaaggccacacagctgtaaggtggcagagtggggattcaaacacctgtctgcttggtttcaaagccaactgtgaccccctgctgactcttagaggccaaggctgaagcccctggctgagtgagtggtggtgacctggggaaaggactgttgtggtgcatctggaaagagtgtggggggtgttccgaaggtagtgccttatctcaattgattgttcacagtcagttacagatcaaactccttgttctgctccttcccccttctcactactgcacttgaccagtctttaaaaaaaaatacatacaatgcaggtctaatacgagaagggtcagaaaagctaggcttagctctagctctgcctttgactagctataggttctttagggaggccctcagccccgtctataaatgggactataaaggtctgtgaaaagggcaatggaaaaaagatgaatgttgagccacatatcaggctcctttcttgctccactgcttatcagctgtgtcgtcttaggcacatcactatgactctaagcctgtttcctcacttctaaaatgtgaagaacaatacccgcctcacagggctgctgtggggatgaaaaataatacacatgaaacacctggaacagagtttacatatagtagttgcacaataaatgcttcccaatagtagttatccttgtaatactggtattagtgatactactaaagtattattatataaagtagtattagcaatgctactaaagtattcatattttaaaattgtgattattaaagtgagaaaaatgtatgaaagaaatactacaaatttaggtaatccattaaaaataaggagctggaggctaggcatggtggcccacacctgtaatcccagcactttgggaggccaaggtgggtggattacctgaggtcaggagttcgagaccagcctgaccaacatggagcaaccccgtctctactaaaaacacaaaaaactagccaggtgtggtggcgggcgcctatagtcccagctactcgggaggctgaggcaggagaatggcatgaacctgggagatggagcttgcagtgagtggagattttgtcactgcactccagcctgggcgacagagcgaggctccatctaaaaaaaaaaaaaaaaaaaaaaagaggagctggaggaggcccaccttaatgtacgccaaaatagttctgctggttgaaggcctggagttccctgcaatgggtggggaaggggattagcctggggaaataatgcctgggtcaagttagggaagatccaggtccctctgctgagggacagtttggaggacagagcctgaccctccatgaagagagactctcaaggtctcttttagctttaacattggctaagtgtgattctatgactcaaccagtctaccgtaattcctcagtgtgggcaggacatgaaagacaacccaccagtatctcagtgagtttgtgtggcgcccaccttggcagtcacacacagacacttcccagagtctcagtgatgatgattctctctaaggggaacccaagccttaaccaaagaccacctctccatcttcctgctggggccttgcaggtcagcctagagggagttttccagagcaggtggcttcctgagtggccaagatcatgtgagcaggataggttctcttctcgctgggcctttcctccctaagctggtgtcccaggcacctctctctgtttggaaatcagattctttatggtttatttttgacaccagatcatcgctgcccaagtttcatcaatttgtcactgtttttattgtcagcaattgcccataactggagcacgtttaaaatgtcattgatcttggtattacagtgtcgtaatctgacagtaataggtgtagccagcacaggaagcccaggccctgagattgatggcgcacagcacaccaattatattctgtccatctaagtgataaaagagtatgtaggaggcattcaatagataaattagatatcactcccaattatgtcctttatttgatggagtcatatgctccccttagaactttttttcttcatttggcttgtaaaggggaattacttgaccccactaaagactgggactgcctcccctgcctgtcccaacttgggttctaccctgatcccttccgacaggctcatagtctttcacctgggctttctctgggactcacctaggagttccccagtgtggtaggtccacaggtgtaaagggaaggaggcagaggtgcttcaccatttgggaaggagttgggtcaggcctttgggaaggactaggaagtctgacaatgcctttaatgtgacactgcccaaataaatgagaccgggagaggggctggaaaatgggtaaaaatcctccagtccagacaacagagccttcaaattaggacaactagtaattggctatggctggggaggaagaggatggtaaaaaggttttcagtccttaagaagtgaattcatccatccctctacctccactccagactgggtggggccaattcaagcccttcctcggaagaactcccagaatcttctacatccccattctgatccatatcagatgacttcctcagctcaagtcctagctctgccactgtggtagggacataataccagctttcctgggggaggcacagggctcctgtttgagaaaaagccccaagaatggttcatttccaagaagagagctcacctgaggcagggaagtgcctggccaaggaatagaggtacagtgaaggcataactttattggaggcctggcttataagcatcataaactctgaggacagccttgacctggtccagacccctgtttccccatcccccaaagccagcaggaaacatggcagaggccgagacaccaagtagtaaacagtgatctaggtccattgatcgagctttcaaagagaaagtgtccatgggttgggctgctctccattgccctgttgccatttcaatgttataaataattctggcactaagtgccctgtcacaccgagtggaagtagttcttatagagtgaaacctgagaatatgggtcatgggaggaggggtgactgggggcaggggtagagatggggagcgatcaccccaaggctcctcaactacacccctaggctggtgatagatgaatttctggagcagaggatggcatttcaaatgaaatgattataggaaatgagtgtgatttaaacaacgtcttggctgataagcaccagccagctggggggagatggcaggctagaagtggaggaatcaaaagcccagaggcccccagtgttaagtagctgtctgaagctccgctcaaacacacacaccagctttggtctcaacatgtttttaagagctggttatgatttccttgagggcagctcagattaagactagagtggagcccccagctaagcaccttcaataactgtccatcacatcctctttagaaacagcagcctcttccccttggctcagggaccctgtaattggggagggctgtgaagctgcgtggcttgtcagcctgttcccaggcagcacggggcctgtctgtcctttgcctggggtcctgccccagatcccgggaacagagattgagccccacccacagagagctctcagtcttcaagaagagagaaaacatacaacctagaaaagaagagaggaagcaaagagagcaaaaggatggaaaccaaggaagaggaaactgtcaccaaatccagaatttgggcctttctcaccacatgcactgctgccatcctggtccaagccacacatttctcacttggattagtgcaatgacctttcaacaagtctccctgcatcttcccttggccccctgtgatctattctcaacacaaaagacaaaaagactatttaaaaactgaagtccaggccaggtgcagtggctcatgactgtaattccagcactttgggaggccaaggtgggtggatcacgaggtcaggagttcaagaccagcctggccaagatggcgaaaccgcgtctctactaaaactacaaaaattagctgggcatggtggaaggtgcctgtaatcccagctacttgggaggctgaggcataagaatcacttgaacctgggtggcagaagttgtagtgggtcaagattgtgccactgcactctagcttgggtgacagagtgagactgtctctcaaaacaaaacaagaccctgaagtccaatcatgtctttcctctctacttcactccgagtaaaaagcaaagtccttaagttgacttacgaggccgaacatcgtctgttccctccttacctctctgatgccatctcctcccactcttgctcactcccacagacttgccaggcatgttcctgcctcagggccttagcaccagccactccctctacttggaatactcttgccaagatgtctatggggctaacttcctctctcacctctaagtctttgttcaaataccatattcgcagtgagctctccttgacaaccatattaaaaacctcagatttcccctccatgctgatccttctgtacgtgatctattccttttctgtaacaattatcattttctaatatatgatataatttacttatttagtaagaatattgttcattatctgtctttctctgctagaatgtaaactccacacaggtgggggttctttctctgttttgatcaccaatgtattctaagaacttggaatagtactcaataataattgcttagtgagtaaatgcaaaggatgaggttcaccaggggagggtttggagaagagaacagaggggaggccatcccaggcttgggatgaacttgtgccttatctcacaacaggccatgtgtgaggatctgagagtccgagtgttgggcacaagttcaagagtcgggctaggacatcacccaaaatggagagattcagttatcaaagagactaggctggatttacctctggaatctggtggaggacttggctttaggttgggattttaccatcttcatgaccaaagcatacttggggataataatgccaaagggatgtgcagggcaagaatgaggtggttgggaatggaggcagactgggaattcaggtgggggagggtagctgaaagaacaggcatgtgtcttctaagtctggaaaaaagattgaggtggaattagagggcctgaaagaaaattgtgtatgcaagtgggaggaagagcctgggtcactggaagctatcatctccaagagcatgttccatctccactgagggcagaatcaaaagccatgggctgcacctaaagtcgaaggaactagagtgagacatcaagaaaggcctcccaacaatgtgacaggtggtggaggggaagcactgggcctttttctctggaaaacttgagcaggacataactgggcgcatacctgagccaggctaacccagtgggcactgtgaggctctggggtgggagtgtggtactagagccccgaagagggttcctgcctctgcctggctcccaactccatcctctcacctgcgaggcttctgagcttctaagcacgcagaaatgtcctctctcctgacctcaagtttctgcatcttttcagagtggaaactgagagtattcagtattccaaggccccaccagtctagggtccaaaacatgtgtaccacgtctcctcagaatatcagtgctcatctcagttttgtggtgtcctcagggtacaagccaggagaagcagaaaatacctttggaggttatacaattcagtggttactgcagttataatggagtgaggacatgggtggcctgggagttctgaggttccggggagacttacttgtcactgtataacttttggtgccttttgagttttgaaccatgtacatttatttcctattcaaaaaacataaaacaattaaaatcagatgaaagcaacaacaatagtaacaacaaagaataggtctagggaagtgggaacttgatgcctccaattgctaccctgaaggcaatgacctgcctcctcttgcccatgtgtaccctcctccacatctggcatctccattctctagaggctcagagaggggtgtggctggcctgatgtcacccagcatttaagactagcaaaattctggggcttagctgtccagactctcagtgttgtctttcttttctgatcctcaatgaccccgtctactcattgacctgtccatgtttttggcagaactttgcatatgctacaaatcaaccttcaatgggtcgtttttaaaactgtgtggtcttaaatgccacctttcccaggaagtaatctcttttcacaaagagaaagagatgacagctctcctctcccccagtgtggtgtctgatgtttcattccctcccttcctgcctccctcctccctaccaccctctaccactaaagtggctctccactgaaacttggccctgtctctgatgagatatgtgactttgagcaagtcatttaacctttctgtgtgtctgtttcttcatctgcaattgaggatcctgaccttcctcccatggctcttcacttatgcatttgtacagcaagcatgtattctgtgcctggtgctgaacctggcactgaggatcacacaagacaatgtatgtgaagttaatacagagacagaaagttactgccaaggcctccttccttggatgctgttctgggctgggtgctccaaccccctcatctggcatgcccttggaggaactgcttcacagtctactccaaacctctcaacttctagcattgctcctgggctgaagccgatatcctgctctgcatgaagggtcagggggtgcagaaatagcctatttcccaggctttttcatttggttagatccttaggtatcactttgcctacaagaaggaataatgttgaaatctgtctgttggtctttagtctggaattttcagtgtccacctctcttgccctctgtgggcctttccctgggacttgggctggaacaaggggtaggaaatggattctatccatgtcctcactctgctcatttctctcctttcctgaatcccatgcatccatggagattggtacagtggctaagattctgggattggaaactcacatttgtctccctccaaatgtaagctggctgtggaggaaagatggtcccttctttaaaatgaacaccaccatctcagagtatacagtagcttgcttcaggcagaggaggcagagctgccttccagagctcttggcaggaagctgtccccactccctgcctgaccaccgaggattgggtgagcatcactgggagggagcggtgtttatagaaaaaacgtgctgcttcagccctggtcattgctgatggaccatggcagcaaggaaggtcaagtccagactaaggaggtacttctcattatcagggactgggtttaaggtgagaggttggttggaactactcagacacggtcttcccagagcaaggaggaagggtgagatgatctgggagttgtgaaggactcaggggttccatgatgttgcagagctggcagtgactgggaggatgccagggagatgtcagttcacccatgtctagagcagaaaccccatggtcagagaccaggtatctgcaaccccaacattcccagcataatgcctcgcacaaggctaactggagactgaggaagacaagtccttccctggaagatggtgccaacactgtgctcacagaaggacagctactttaaagccccagcaagaaaatgatctcacactgtgggacctggaagtacttcttcatgtccagcctcaatcctccttaccacagctcaattggatctcagtccaacctgtgggatttgtccatgcccagaggtgaaacccagcaaggaatatggactttgcttttaggcctacgctgttggctgtgggagatagaacaagttggccaaactgtcgagtacctgtctccacacctggggagtccccaggaaagtggagagggaagatcttccagggaacggccaccctccatgaggagataagcagaacagcagagggcaaggaaggttcagtggccaggagaggtggggctcagggagtccctcctggctgggggtgagggagcttcctggatgctcagcctctccaagcccctgaggaaagactgtagcttctggagggcaggagctgatcctgcatcatctcggcagaccagtgcccagcacacagcagatgctcaaaacacatgggtcgaatgaatgagcctgcggtcaagagcctgcccagccagcaggtggagtgggtctttggagaagggattcccctctctgggcctccatttcttcatttgtagaatgaggggctgcagtagattgtctctaaggttttgtcagcccctgacgatctgtggtttcctgtttccctgctctctcgtcaattccttgccaattctctttccctctacagcttctcttttcctttccctttaagtctttttcttccactaacccccaatctctgcacccccgttttcagtctctcccctccccagacaatttctctggctttcccctttacaggtatttcttcctctctgcttctgataactgcccccatcactatccttccctgatgccttcagtgttctgcaccccctgccccccaaaagccgcccattctagtgcccctttcatccaccttagatcccagaggcgggagattggaagaaaaggaggagggtcctaaagcagccactcccctgcccctgcaatggccccaccgcgatgtccccgtccccccgccccgcccccctccccaccacgcctctccctcagcagccagtgccgcactgagccctcgccccacgctaatgcgatctggagagaccctgtcggtgcgggcggcgggcagtctggcccagcgtccagggcggcgctgatggatggtcccctgacagtaatcgcagaatgaggacgcgcaggtgacgctcttgcccgaggccctgctgtttggctagcccaggagtctctccctccgcagcgtctgccttctgggcgctctcaactcactcggctttgcgggaggcgcaaagcctcaggttagggcagaggtgcgggcttcctctgctctcactctcccaagacactggtttctgtttgggaacagatcccttcttggatccacgctgcttctgtgattctgaacaagccacccatctcctggagtctcagttctcccttctgtataatggcctttaaagcctggtggagtgttgggggcacgggagataatactgaggaaaatcacgctctctcttaagtagaaaccgaatttcacttttagtttacaatgctcagaataatctgggccaaatgtgcaaagccaagtaagagctgagtggctactcacacacagaatatatgtttatacacatacacataatgtttttagcataccaggactgcttagacgtctttaaagagaacactagcccaggtccttctccagggaggcgactgtctccagcaggactttttctcccctctactgaggccacctacctgtcttaagcccccagaccccatccgttctggggttcccctgcaatccagagccaggctgaggtggtatgcgggaagatctccctttggaaaatgtttctggataatttcccaactccttgaccatgttctccccacctcacccacattcagataacacaggttctaaggctccttcactcctccacccctgggggatactccttgggcctggccctgtggaggggctgggaggtgggatccagaaccaattgcaattctgaacgcacacccagccgcctcctcactcccttttaacctttccctctagtcagaagccaaattgagatagtcttgagttttgatttaattcctgaaatggagtcataatctgcttagtgtcctttctcccgagtcctagatactgaagtgtgtgtgtctgtcagggggagttaaaagagcagctctgtgacctttggaggaccctcacactcactcacctcccaaacaccaccaaagagcaggagacgccatggcactgagttgctgggtagtatgatgatggtactgacaactcacatttactaggcacttaccacatgccagtactgagacaggcactatacacgcatttctcacttaattctcacaactacctttcaggtaggtaccattcatatccccaacttacagatgaagaaactgaggcttagcgaggttaagcagtttatgttccatcctgcagtgatcacagacggtcctcgacttatgatgctttgacttacaatttctcagctttatgatgatgccgaagtgatatgcattcattagatactgtacttctaatactcatacaaccgctctgtttttcactttcagtacagtatattataacatgttgaatctcatgttgaatacatgagatgaataaatatctcatgttgaatacatgagatattcaacacttttttataaaataggctttgtgctagatgatcttgcccaactgtaggctgatgaacgtgtcctgagcactttaaggtaagcgaggctgaactatgatgtttggtgggttaggtgtatgaaatgcatatccaccttacaatattttcagcttgctacagctttatcgggacacagcctcatcgtaagtcaaggagagtctattattaagcggcagagcccaaatttgaaactacacagtcagactgcagagcctgtgctcttaaccacttagttgtgtgacacctggcagggtatttaacttctgcacgccctgttccctcatttgcaaaacacagataagtagggatgataagacattcccttcaaagaattatgttgattaattgagctaaggcattcaccatactcacagtaagcattcagtagtttaggtgccctacacattggagcagggttgaggaagggaaagagtacaatccaatgggctattaattgttcattgttactgttgatagtaatagttatcatgcattgagagccaactgagcataggccaccctacaaggttaaaattatgtctgttttacagatgaagaaactgagtttcacataaattatgtaaattacctaaagctatccagttaataagtgacagaacagagctcttgtttaaacactgggcccttgactccaaagcctgcagttcccagcacccccagggtcaccaaaacctggcctctcctgggagaggtcagggctgaggccaacaagcccaagtcacaccctttaccacctgggacctgattttctccaggtgagcaatgttttcttaaaagaacaggaggacagtaaataattaaccaagacagtttctccctccctgaagccaaggtagaacctccccactacagccaacccccactctcctcactcctgtttcctctgtgctcaagtttgtggccattaaatagaagaggagaaagtttgagccaggcatgaaatatttatcagttaattacaatatgcagattctgttcctaggggtgatttatctttttggaaatataggaaaagatcctggaaacttgtatcctaatcgctcggcccattattgtagcaaccaggtagaaactccatttactatgtaactacaaattttcccactactggaggtatctgcctctgcttctatcactggtggtctggggaaaatatgcttttctgataagagatgagcctcttagaggtcaatttgtcaattcctctgtctcctctttgggtggcctctttgtaaattctaatagctacaggaaatgaaaagggtgagagtctctgaaattctgggatctcaagagaagctaattctaagtgaaaacctccccgactgaagcagtgccactggtgaggggatgtccaaggttgagaagcagctctcagctgagcatccctcccctcccttgctctggcagaagtgtcagccctcccccttatctcttgtattatttcctagggcctgcatctcaatctctggctacacattagcaacctggggagttttaaaaatccagatgcccaggccctactacaggccaaacaaattggaatccctggaggtgggacccaggcatcagtattttaaaaaaaacttgtggctgggtatggtggctcacacctgtaatcccagcacgttgggaggccgaggcgggtggattacctgaggtgaggagtttgagaccagcctggcaaacatggtgaaaccccgtctctattaaaaatacaaaaattagctgggcatggttgcaaacacctgtaatcccagctactcgggaggctgaggaagggataattgcttgaacccaggaggcagtggttgtagtgagccgagatgtgccactgcactctagcctgggcgacaagagcaagacaccatctcaaaaacaaaaatgaacaaacaaaaaaactcgctgggggttccaatgtgcagtgaaagttgagaccctctagagctaatagaagagtatcactgcctggtaaatgggccctgcttatctgcaagactgtgtaatttttatccctccctctctggtgctggaggaggcaattccttcactttttagaatctgaagaacatctctctttcttcacaagaagcttgtaacacaataactaccacttatcaagcccctgctgaatgcttggatctatgcacataaaattcaatctgatctacagaacaactctataaggtcagtgggtatgtctattttatggatggctcagagaggttaagtaatttgcccaagtttgtacaactagcgagtgtcagatcagggacttgaatcacaaacccatgcttttaacccctgtggtacactgcctctcactttctcagggccagaagggaagggcttcaggtcaaccatatgaagtgcctacggaatgtcttggggaaggaaagaagagagaagcaaggagaagtatagggaagcagacaagggctacagatgcatagggcatggagggcagaatggtggctgggaaagactgaagagggtttgtagggctaagaggaggtacctgaaggagggtgtggtaagccaacacgtgcatgggaagggggcagtggctatggagatagctggggagtgggggaatggggtccaggagtgggtgccggcagttggaacatccagaacagtgagcagtgcccatcgtggactgggtggttggggagtgggagggacctcgtgtcagaggaggggtctttgtgagcatgaagtagtgaggaatgctccaccatgaatactaagggcaagaagagaaagggccagaggggaatgggtgatgtttagctgctggggtgattaatgggggtgaacggagggtgaaactcaagcccttccaatgaagatggtggggaatggttgtccaagaacaacagtgcactgtttcaaggagaaagccaatgtccaggggaggggtggctgagaaggacgctaggcacagttgctccttcccttttttcccaagttctctttatttaccaccaaacagtaaattaaactatattagccagttccaggggaccctctgaatgggcttcctacctgtctcgtggcttggaagagaccaaggaatgttggcgtggcttggagaaagagtgagtgaggtctgggctgaaagttgagatgactccatggaccaccccctcgtggggcacaaaatggtgatgtgctggcaagagccactggctccctctggaccagacaggcactgagagatacatgggtgttgggccctcaggtgtcctgtagaaagtggtagtgttcttagagcagtttttagagcagccccttggcctcagggagggacacagggctccttttctgtgagagagagagagttgggggaacaaggagagagggcttcccatggctctggtttcagggtgttgacctgggtttgaagaatggagataaaccttgtgggaaataacaggtttaagccactctcccctcatttcctacttctgtctcttcctctaggtacagctgttgggagctgcttctcccgccctcaatctccctgtctgtggttccagagggaagaagagggggaaaaaaaggatgaagagaactgtttcagtgctgggggaggtgagcttatagcagggatttagatgggaaatacctcatgggataggagcagttttctccctctccaggcctctcacagatgtgaaacaactggcagatctgactttcccacccctaaccattggaggggatgatgtgtcttgaaacctgtgcttctcgattgagaggctggtgggggaagagaggtcaggaaaaggggccagatgtgtgttcaggggtccccagggagttgagggagactagcatctccttagggtaaggaaggcaaaatgcccattcctgatcccagattgcttggatactgtgcctgggagtcctcctacctcgccttaattcctgtctccacacacagcttggccaagtttcttcccctgttggagtctcactcccaatcccctactctatctctccaggagcctacaaagcactttgaaatccaaagtttgtgggaggtggctctatcgcacaaatactctgaggtgcaacatgacttgactggtaatgaggcaaccatcccacctagggcagagttcaaggactgccttcaagaggggctggcctcagtttgcctgttacagaaaccacgggctaatagaggctgccctctgcctcacaaagaaggagataaatgggtccactggagagcaatggtcacaatcaagtcttaatgatgaattaataattcataattaccccagacttgcagataagcacaagcccactggaattatttcccagggaggaacacagtcagaaagtgtgagaaggggacttcagtacagacattacttccagaggccattaagttcatccctctgcttccaaaccagaacctggaagacatgcattagcttccttggctgattcctcctaacagctaccaccccctgagcttctaaacagtgccatattgcccctctgttcttcataaggccagaggaccattcctgccaaagtgacctcagaacctggactctggatttctggggtctctctgttctctgctccccattctgctatttacatatgaggtcccctgtaggagggcctggtgctaggtgtcccggcgagatgtggacatctttctggctcttctccttctcttatctaagtcctcacatggtgggaaaatacctctctaatgctatgtagaaagagaaggagggagtgtcccttctagcgtggatgcctttggttcccagatctggatttgaggggctggctctatctcttaagaagacatttacctagcgttggtaatggagatggggccttaatagggctagggaggcacacccaactccagacccagctctctgctgttccccttcccagtgcacacaatcccaattcccactccagaaaattttaaaaaaacatatcttaaaaaaaaacctcgaaaagccaagcagaccctcagtttcaaggtatctcctcattctctctctctctctctctgtctctctgaatctacaaagaaggagtgagttttgtctctccaagtactcagagccttagatcacaaaggggccttagatcctggtcttggggagatctttgaccaccacctctgctgtggcacgaccattgtcaaaatgctagaaagaagagagactggctcttagaccaagggaatttgggatttgaaaggacttccatttccagttctatagatttccttcccattagcctcttcatgtgcatcaaatgtaaatggcaggctaaacttacaggatgaagagagttgaaagactgctgcctaaaaatgcccttttccaaatctgtgggtgcagaagcacattgaaaagcaggtacccagcctggcggtgtggcacatgcctgaagtctcacatgcttaagaggctaaggtgggaggactacttgagcccaggagtttgaggcttcagtgaactatgatggtgccacaacactccagcctgggaaacagagctggaccccatttccaaaaaaaaaaaaaaaagtagttacccaggtaaggtggatgatcaagtacacccagtgagaagcacacaaaccttaccctttacccaaactctctcccttacctgtcccatttccggtctctagaggaggatcagttagggggtgtgacccaagttacccagataattaactgtggaagcacgattttttttcactcctttggcctctaaatatgagagatctttacatctcttgcctagctccctcttattctctaccctctccccaacacgcacgcaaatcctaacaacaaaaaatcctaaatataggaagacaaaccttcctgacctaccattttggcccacctgcaacccctgtcccccgcccctccccaatttttttctctcctgagcctctgctcttcgcttctaaaataaaaaaaaagaagaagaaggaattttcaatagtccaacttgtcaagcgaagaccatcttttaaccttcaacagcagcgaaagccatgtgaactcttggtgaaccaagattgaagtcataaatcacgtgtacaaaggcggctgcggaggctggcgcgggctgcttcacctttaatgctttctggggctgacaggcagcggcccagctaaagttcacagtgcccggggagggcccgcctccgcctcacctcccccagcctggcctgggcccatggccccggaccggtcagccgcgcggccgcctgagctgcgagctgaggaggccccttggctgttcccgcaaagggccggggggcgcattttctctcctgccagcgagctccatcctggtccttccctcaccccccacccccacagcctgctgtatgtaaatagggaaatagatctacacggacacaataatttagcttggttggtctttggcattttctacaagaccccaagagatggactttcctctccccttcctccgtttagaaatggcatccttcatctctgtctatgcaggcccaattatccagatcctcagggctccaatagggtctgagtcattggaaccaggaacacctggctgaaacatgccacataattagattttctttttctttaccttttctttcttatttttataagaggtccggaattagcctcttcgactggggtggagtagctggggtgtgggaaaggaacaccttcatacaacttccagctttcagccccttggagagatttccaatttccccgaagccgctaggatttcctttcctcgatctcttggccacctcctcctccttctccgatcttttttttttccctcctcccactgtcttctctacggtttaatcaaagttcagcgactccacttgcctctcctctcatttctttcggaaagcggaaaccagacgacccagcggccatgggacgagtcgccccaactcaaccccaacaggacgctggaggggcctcccttgcccacctctcttcgctggcactggcctcccgcacccgggtctgcagtccctccgccatctcacaggtgtgcagccgctaggcctgggggatccgaatgactggggctggataggaatgccttcgtgtttcccaagaccccggggcctgctccacaaagtttgaagggtgggtacacctcaacccaggcaagttgctcccccaaacccatgactgactaatctgatatgacaaaagcccatgatggatttggtatatgttaattcacaatgccttttcctccagaatttaactataagttaatacacaccggaaaccacgcgcatacacgctccttaatgggcttaggtattagcgagtcctaacgatgcatacaaatgtgctctgcgctctgtagacccctcaagatttatgggccttgagctctctgaagctgtaaacaaggagaaaaaaaaaagagaaagtgaaagcgactggggggaagagacagaggcctgactcgcccctctaggttttggagagaagggattctttatgtattttcctttccttgcaagctcggtgcgtgtgcgttttggcgttggtctgggggtggtgttctgcctgaatgctggtgtgcgtgggcagtgtgttatttgcgtgctggggtaggatgcctgcctcttcggattcctgtgcaggggcctgaacacagcaggcatttgtgagcatatatgcgtgagtgtgcactgtgttagggtgtgtgggtgtgtatgtgtgtgtgtgtgagagacagacagagagggagaggcaggcttccccctgggccaggctgctgtcccttgaacggtggtgaacaaatctctaacgacaatcataataacaataaataatgaataataataataaaacagtagttaacagtccctccataacagaataacaataaaatgcaagaggaaatattttgaggtggagacagaaggagtcaggatcacagcatctgagggggagataggaaaggaagggaggaagaaagcttcttaatatgctcttggcggggctggggttggtaaaccctttcccagacaagggacggaagaggggaaggagagccaggaggccactctttattgcttttttttctcaggcttttgctttgtgtgatcagggaagggatcccacatatgggaatggttaatggattttgggactctctaggagcccctgttttaagaaggaggccaaatgtgcaggctcaggccaagcgccagagatgaatggggtgatgaccacagccttgatccggcaggagctcagagatgcccgggaagatggggtgcccgaacagaagcagaaaaacacttgtggccgctgggaagttgggagagccaggctggggctccggcaggcccagggaaagttccctttctaggctctttattaaaaaatttaaaaggaggagttgaggcgccttgaattttccttcgtgagtttggagaccagccgatttttcatgaagctagcaaagactgcggtcctggatcctgcaacatatacctcattttctccaggtacagttttctggtcatttaattagtttgttttcttgagggagatgggaatcaaaggcgtagaaatagtaagtttgctagagaggaagccaccccacagtttcgagtctaacgaaatccctcctttaaaaacatttgtacccccaataaaaacaaaattaaataggaatatagaaacacaaattagccaacttttttaaaagagaaaaaagaaaaggaaatcatcgtaacaaatgagcgtgagaacttctaaaaaatttgtcacgaaccctttcagaggtctggattctttttcagtagccggtgacccatttggtctgaaaagagaaatacactatccactgagtcacttatttaaagccaacacacacacatacacacacacacacacacaaacacacgcattcagaaagccctgggtgcactcgtatttgaaaacaacagcgggtggaggacgctgtgatacctaattggacaaaacagcaataaaataagaccagtggaagtgctgagcacagggcgcagggctagggcccgggttttgtgttccaggccaccggcgaggcagcggccccgggcgatggggggccgggcggtcagacaccggctggcgactctgctcagcctccacagcccagcctgcagcccctttcccccagcctctgggcctcgtgggctctctccgctccgacgcctgttcggggcttccctgttgagagggttttaggccgaagggccaaacgactcaagccagactctactttttcatttttctcccttaggcctctccacttgctcgagctctcagccaccaggagacagacggaaggggcttctgggctgtgttgggagcgggcactgtcccctacccactcctgcacagtttcccaaagtccagcgacctccgaccctccttgggggaaaaaataccagtacccagacaactctgcatcctgttatatgactgggcttgcttcaggaatatcttacaaagaagaagaagaagaaggaagaggaggaacggcttggagtcatgtttacatctagttctactgatccgttcacatctggagagtttatttataactccctctataactctctgtttggaggcactggtggctctactgacagactgatgtctaggaaatattgctctatgtctaaccgtacctaaatgtgctgtggttgtatttacagatttacgtttgagggaaatataattatttccattgtatttgtgcatatacagtagttataggagcagatttatatatgggaaaatatacgactctcttacagccatccggctttatgtacatttgatatcctaacagatttatatctctgaacagctatatagataaaaacgtatatcgttagaattatgtatcaggagatatatacttattgattgtgaaatagagtagttagagcattcacttagagccatatatggctatggagatatttctatattattatcactatatataggcatatctatttataactgcatagttataaaaatagacataattatagtcctatatgtgcatgcttcaatctctctctagagttatagacactatcaaatataactctatagagagatctgtatgtatataaggtgtaattatcttgtgatgtgtttacgttgggacttaggcccgtctgtctagaacagacatatttatatgtaggtgctgggagagacttattcacagatatctgcagaggaccaactgggaacactgtatctgccctctaggaaaccagctaggagagttgtgtacttatggagggatggagttacaaaagggtaaatagagctcagggagccttaaggaggggaggtgaatggagggtgggtgggctcagtttgaacagatagtgggaggaaaggggtaaacaccagcacccaccagaaggtgagaaccagttttgtgaggggctggtgcagacaactgtggacaaggggcttgtaaaatgagaagcggctaacagtcctgccacatcaccctgagactctccaccgaggaagcagcctttagtttggcttttagtgcactgtaggatacggactgtcgtgtcactcctgtagtcctacagcgtttctcttgaaccctaatttttaggtctcaaacagcgggcttcagagataaagaggtttaggcaggggcagggcgaggagcatggggtgtactttcgctttccaataagtgaggtaatccaggaaagtgagttaatttggccaaataaagcttgtttttatgtgggcctcctgtgccctggtggggttgtaggatgggaccagaatctggtggactgaggagtgaatttccaagtattgggcctgctctgatgggggcttggagaggtagtcctccccacccgccctccttctctgaggcctcagtggcttaattccctctgggcacagagggactccttcagctccctaacagtgctgccctgggtcttttcagggagaatttgactttaggaacagggaacatggacttactccactagatctcacttctcccactcacagctacaccactcttatgtcagcctccttccaggtgccactcggccaggggtccacagttcttcccatgctaccaaccagcccagtggggaaatacctcccatgactgccagtttttctgtttgtgtgtgtgtgtgtgtgtgtgtgtgttttaaccagggagttacagataacttcgttaactgcgtgaaggaattgtcctgaactcagtctctgtggccaacctagcctccaggatctctaggatgctaggacgggagtggagacccttggaccaggctaaccaccatgtgccatcctccacacacccctgcccacaggactaggaattcctgcagtgcagggactctgtctgctgcctggcacagaatggttgcccaaacatacttgttgaggtaaacggaatggcagtcaatacaaaaactcaccctcactctgcacaccaccatagccactgctggctagcaggcaccctagccaggctgggagataacatggcggctggcagcagcttgggctttgaccggaccagtggttagtagggtgggagagaatcctgagcctaggatggggcggggactggagcaaggcacctggaatccagaaatctgggggtaagccaaggcagacccaccgccccagtgcacttctgttttctatctccagtctcatggctccctggacccccaaaagttatgaaaactaaaccagagctgagacctgggctaggaaggaattgcctgtcaacccgaggggtgcaaagaggaaccaccattgggtccattaagaaatccacaaataaaacaaaaataaatcagtgtgacacagacaacttggctgaaggaaacgtttctctctgtgcctcagccctgctccagggctaccaaacagatcaggcttaatatttaaaatgtttaatagttaaaattttttaacaatttaactttaaaaaggtcacacattttctgatccagcaatgccccaatcagattgtttcattttattattattatcaacactgtcccctttttggcacctgtaaaatagttcctttcgggagtttggagccaggccaggcaccgtcggtgcatgggataagatgggcaggtttggagctcctctgtctagtgaggatcaccgtctgcagagaagggttggcctccccgtctcccatcaaggcttaaagcaaggagaaccatcccgaatttggttccttttcccctaagtatccttagaggcaatccactctgtgactaggtgactaggtgaaggactgaggtccagaaaggagctatcttaaaactggaatcccatttcctagtctgcagccttaagcagtttccctctcagacaactagtcctctcctttctccccatgaaaacccatggcttagagggatggttgttgctttccctaaagaaattcaggaagggagatctgagggtcatttctcagcggtggcattctttaaaggggatgcagcctgactgccaggaggagagaacgagtcggccgagccaatgcgcatgcgcgaggcacgagcagcttctcccttcacagtggtttccacagttgtcttagaaaccagtcccgaggcttggcaaagggggagacttccgtggcagtgcttgggtgtcaaggctctgaggatccggcctgacctctccactggggtgaggggaaagtctccggatgccaagagtcacaaagggctgaacagggtgaggaaacccgacacagagtccggaaaaggcagcatggaatccctccctcaggcctgcctggacggtgttggttggggtgagtctccccaaaagtcatgacgtggtgatctcgaggacaggacggcctgcgtgccgctggggtgctctctcaccgaagggtcgttctcgttgaaagcagaaccccacagcctcaggggttgcctgggtgtgtgtgtttcaaagcctttgctgtaagactctgtgtgtgtgtctgtgtgtgtatgtgtgtgtgtgtgtgtgtgtatcctattctctcttctctgtctctcagtctctgtgtgtttctttccctctctctgtcggtttgtgtgtgtgttccccttgtgcgtgtgtgtccttggctgaatgtgccctatgcgccacaaagctgcttctcacatggcggactgtctttggtgagcctgtttctgcctctctgccagggtcatgaggccggttgtcaatcctttttgccaacgcggttccgctttgggtgtttgaaggcctggcccacgtgaggagatgcttcggtcccagagcaattgaaatatcatccccatcctgagcggcctcttttctaagatcaagatgaacacactgcagatgaggacacgagccccacaggagctctttctcccgcaggagaccagcagacccacgtcagagaggatgcttgtatcttttcatggctcttctctgagaaatgaagccacaccacaatacggtctggaagaggaagctgggaatgggagatggaaacaatccctgtcaatggaacgctggcctctctggacaagccaccgttttggaaccccaccccttatgaccctggcagtggaacgatgatatatcctgcctggccgccggcgtctgccctgtcctccctcctgctgtgcctcacctgtttctcaagtgcctcgatgcctctcgctgacgcccaatgtcttcaacaaagatgacttaccagtccatcagggagacatttcttcgagatccgtgtcgtgattgtttctctatccaaacgtgtttctgcttgaatgggcaggtctcatgacctgggagctcctggcttccattcgtgtctcaggcagggaagcttccttcttctccacgtttcccctcatgggtgggtggattgcctagaatgagcgctaggcgaccgtgacaggccctgtcttccaggaaaggtagtgtcgcatttcctctgcacttcctgtctcattcatgagggacatcctctcctctgctcctgggtggactgactcccttgatcttctggccgaaacgaatgccagggaaccaaagggactgggctggggctggggctggggctgtggctgggcgcagccgaagttgcgtcagggctaccagggcggtggaggattgggggtggggcgaattttgcagaaacctctttgctcctctggtaggcattcgaaaacgtggcttggctccggcacaggcccctcaccccccgggtcctaggtgttcttcgattttccttggcattgatggaaagttcacccgtttccccattcaaccggcacatgcctggacaccaccctctgtttcgccgtcgccccgtatgcctccggtgacacacattaacaccaactgctgtgggataggccagtgccacacgtggtcacatggtctccacctcggattcgcccctgttcctctatgcaggtgtgctgtaaagcgcggtcagctttccggaaccccagggcttttagaagcggggctggccactgctctttcaaaggaggagggaggcagagggctgatggatgagtgaatttgcagctgacactaggccttgagacctatgggatcattctgtgctgcagcgaggccctgccggcctgaacagatgtggtgagcccatcctatctcacacgaagggggccaaaatgggatctgaatgggagtccggaaaacacagcaggcatcctgaagctccctctccctcggtggaagtcggctcaagcaggacctgaggtgaggactcctcggggtttggccctgggacaggagaagacacccgcgacgccctctcccacgccgccccaaactggaccccgggtctagccgccaccgcgggggtagcaggagcctcgctgctgccgcgctcagaggtggcagtatttaaaggggacccagcctgactgccaggagcggagcgcgagttggctcacccaacgcgcatgcgcaaggcgcgagtggcttctccagtcacagtagttcccacggttgtcttagaaaccagtcccggaggctgggtgaagaaggagccctccgtggctgtgcttgggtttccgggctctgaggctccggcctaacctcttcaccgggtcgatgggaacgtccccagattccaggagtcccaaagggccaagtaccatgaggaaagcccagcggagatgggggaagcagcacgggatcccagcctcaggcctgcccggacggtgttggttggggtgagtctccccaaaagtcgtgcctccgtctgtgatctctaggacaggtcggcctgcgtgcccctgggctgctctctcacccgagggtcgttctcgtagagagcagaacatcacagcttcagggattgcctgggggtgtgtttttcaatgccctcctcctttgaaagagcagtggcctgccccgcttctaaaagccctggggttccgaaaagcggaccgcgctttacaggacacctgcaaagaggaacagaggcgaatccgagggggagaccatgtgaccacgcgtggcactggccaatcccacagcagttggtgttaatgtgtgtcaccggaggcatacgaggcgacggtgaaacaaagggtggtgtccaggcatgtgccggtggaagggggaaacgggtgacctttccatcaatgccaaggaaaatcaaagaacacctgggacccgggggttggggggggccgcctgtgcctgacccaagccacgttttcaaatgcctaccagaggagcaaaggggtttctgcaaaactcgcaacacccccaaacctccaccaacctggtagccctgaggcaacttcggctgcacccagccccagccccagccccagcccccagccctagcccagtccctttggttccctgtcattcatttcggccataagttcaagggagtcagtccacccaggagcacaggagaggatgtccctcaaaaatgagacaggaagtgcagaggaaatgcgacaccacctgtcttggaagacaaggccagtcacggtcgcctagcgctcattctaggcaatccacccacccatgaggagaaacgtggagaaggaagcttctctgtctgagacaactaaggaagccaagagctcccgggtcatgagacctgcccaatcaaccagaaagacgtttggacagagaaacaatctcgacacgagtctccaggacgtgtctccctgacggagtgggaagtcatctttgttgaaggcatttggccagagccagaggcatccaggcccctgagaaacaggggaggcagagcaagagtgaggacagatcagaggccggagctcaggcaggatacagaaccgtgccacggccacgggcataaggggtggtgttccaaaagggtggcttgtgcagggatgccagcattccagggacagggagttttgccatctctcattcccgggttcctcttgcagactgtatcgtggtgtggcttcatttctcagagaagagccgtgaaaagactcaagcatcttctctgacgtgggtccgctgctctcctgtgggacaaagagctcctgtgggactcttgtcctcgtctgaagtgtgttcatcttgatcctagaaaagaggccgctcaggatggggatgagacttcaattgctctgggaccgaagcatctcctcacgtgggccaggctttcacacacccaaagcggattggaggcggcgaaaagcattgacaaccagcctcatgaaacaggcagagacgcagaaagaggctgagcaaagacagaccgtcatgtgagaaaccgctctgtggcgcacagggcacattcagccaaagacaaacacgcacacgagcacacacacacaaacccacagagggtgggaaagaaacacgcagagactgagagacagggagagaaaagagaatgggagacacacacaccgacacacacacacacaaacacacacccacggagtcatacagcagagtcattgaaacacacacctccaggcaacccctcaggctgcggggttctgctctggaggagaaagaccctcaggtgagagagcagcccaggggcacgcaggccgaaccgtcctcgagatcacagacggcggcacgactttggggagactcaccccaaccaacaccgtccgtgcaggcctgaggctgggatcccgtgctgctttccccgtttccgcctggggtttcatcataatggtccgccctttgcgactcctggcatccggagactttcccttcgactcatggagaggtgaggccttagcctcagagcttcgacacccaagcactgccacggagggctcctgctctgccaagcctcggggactggtttctaagacaaccgtgggaaccactgtgatgggagaaaccgctcccgcctcgcgcatgcgcattggctgagacgactcccgctccacttctgagagattggctgcgtcccctttaaatatcgccaccgccacgcggcggccgggatgctcctgctgcagccacggtggcagctggatcctgggtcctgtttggggcggcgtgggagagggggccgcgggtgtctcgtcctgtcccaggcccaaacccccaggggtcctgtcctcaggagctgcttcagccgacttccaccgagggagggggagcttcaggacgcctgctgtgttctccggactcccgctgagatccgattttggccccctccgagtgagataggatgggctcaccacatctggagaggctggcagggcctcgctgcagcacagaatgatcccataggtctcaaggcctagtgtcagctgcaagttcactcatccatcagccctgtctccctcctcctttgaaagagcagtggccagcgccacttgtaaaagccctggggttccggaaagccgaccgcgcattacaggacacctgcaatgaggaacagaggcgaatccgagggggagaccatgtgaccacgcgtggcactggccaatcccacagcagttggtgttaatatgtgtcaccggagacatactgcgcgacggcaaaacaaagagtggggtccaggcttgtgccggtggaagggggaaacgggtgacatttccatcaatgtcaaggaaaatctaagaacgcctgggacccggggggtgggggggccgcctgtgcctgacccaagccacgttttcgaatgcctactagaggagcaaagaggtttctgcaaaattggcaacacccccaatcctccactgacctggttgccctgacgcaatttcggctggcacaaacccacagatagtgggaaagaaacacacagagactgagagacagagagagaagagagaatgggagacacacacacagacacacacacacgcacacacacacacgcagagtcatacagcagaggcattgaaacacacacccccaggcaacccctgaggctgcgggtttctgctctggaggagaaagaccctcgggtgagagagtagcccaggggcacgcaggccgacccgtcctcgagatcacggatggcggcacgacttttggggagactcacccgaaccaacgccgaccgtgcaggcctgaggctgggatcccatgctgcttcctccgtctccgcctggggtttcatcatcatggtccaccctttgcgactcctggcatccggggacgttcctttcgaccccgtggcaggtgaggccagagcctcagagcctcgacacccaagcactgccatggagggctcctggactgccaagcctcggggcctggtttctaagacaaccctgggaaccactgtgatgggagaaaccgctcccgcctcgcgcatgcgcattggctgagccgactggcgctccactcctgacagataggctgcgtcccctttaaatatagccaccgccgcgccgcgatgctcctgctgccgccacggcggtggctggatcctgggtcctgtgtggggcggcgtgggagagggggccgcgggtgtctcctcctgtcccaggcccaaacccccaggggtcctgtcctcaggacctgcttgagccgacttccaccaagggagggggagcctcaggaggcctgctgtgttctcccgactcccgttgagatccgattttggccccctccgagtgagataggatgggctcaccacaattggaggggctggcagggcctcgctgcagcacagaatgatcccataggtctcaaggcctagtgtcagctgcaaattcactcatccatcagccctctgcctccctcctcctttgaaagagcagtggccagccccgcttgtaaaagtcctgaggttccggaaagcggaccgcggtttacaggacacctgtaaagaggaacagaggtgaatccgagggggagaccatgtgaccacgcgtggcactggccaatcccacagcagttggtgttaatgtgtgtcaccggaggcatacggcgcgacggcgaaacaaagggtggggtccgggcatgtgctggtggaagggggaaacaggtgacctttccgtcaataccaaggaaaatcaaagaacacctgggaccctggggggtggggggccgcctgtgcctgacccaagccacgttttcgaatgcctaccagaggagcaaagaggtttctgcaaaattcgcaacacccccaatcctccaccgacctggtagccctgacgcagcttcggctgcacccagccccagccccagcccccagccctagcccagtccctttggttccctgacattcgtttcgcccagaagatcaaggcagtcagtccacccaggagcagaggagaggatgtccctcaagaatgagacaggtattgtagaggaaatgcgacaccacctgtcctggaagacaaggccagtcacggtcgcctagcactgattctaggcaatccacccacccatgaggggaaacgtggagaagaaggaagcttctctgtctgagacacctatggaagccaagagctcccgggtcatgagacctgcccaatcaagcagaaagacgtttggacagagaaacaatcacgacacgggtctccaggacgtgtctccctgacggagtgggaagtcatctttgttgaaggcatttggccagaacgagaggcatccaggcccctgagaaacagggtaggcagagccagagggaggacagagcagaggctggagcccaggcaggatacagcaccttgccaccgccacgggcataaggggtggggttccaaaagggtggtttgtccagggaggccagtgttccagggacagggagttttgccatctctcattcccgggttcctcttgcagactgtatcgtggtgtggcttcatttctcagagaagagccgtgaaaagactcaagcatcttctctgacgtgggtccgctgctctcctgtgggacaaagagctcctgtggggctcttgtcctcgtctgcattgtgttcatcttgatcctagaaaagaggccgctcaggatggggatgagacttcaattgctccaggaccgaagcatctcctcacgtgggtcaggctttcacacaccccaagcggatccgcggtggcaaaaacgattgtcaacaggcctcatgacccaggcagcaaggcagaaagactctcaacaaagacacgccgccatgcgagaaaccgctttgtggcgcacagggcacattcagccaaacacacccacccacagcggcacacacacacaaacccacagagtgtgggatagaaacccacagagactgagatacagagtgagaagagagaatgggaaacacatacacagacacacacagacacacacatgctcactcacacacatacacacacagactcacacacagagtcatccagcagaggtattgaaatactcacccccaggacacccctgagactgcggggttctactctcgacaagaacgacccccggatgagagagcagcccaggggcacgcaggccgacctgtcttagagatcacagacggtggcacgacttttggggagagtcaccccaaccaacaccgtccaggcaggcctgaggctgggatgctgtgctgcttttcccagactccgcctggggtttcctctttctgttcggcgctttgcgactcctggcatctggagactttcccgtagaccccgtggagaggtcaggaccagagcctcagagccctgatacccaaagactgccagggagggctcctgcttttctaagcctcggagactggtttctaagacaaccgtggaaccactgtgatgggaaaagccactcgcgcctcgcgcaggcgcattggctaggccgactcgcgcttcgctcctggcagtcaggctgagtcccctttaaataatggcagcgcttcggggcggcggcgaggctcctgctgcagccgcggtggcgggtggatccggggtccagtttggggcagtgtgggagaggggtcccgtgtgtcttgtcccagggccaaagccccaggagtcctgtcctcaggacctccttgagccgacttccaccgagggagcgggagcttcaggatgcttgctgtgttctcaggactccccttcagattcattttggcccgctgaatcagataggatgggctcactacatctggtgaggccatagggcctcgctgcagcacagaataatcccataagtctcaaggcctagtgtcagctgcatatttactgatccatcagccctctgcttccttcctcctttgaaagagcagtggcctgctccgcttctaaaagccctcgggctccggaaagccaaccgcgctttacaggactcgtggaaagaggaacaggggtgaatccgagatggagaccatgtgaccacgcgtggcactggcgtatcccacagcagatggtgtgaatgtgtcaccggaggcatacattgtgacggcaaaaccaacaatggtgtccaggaatgtgcccggtcgaagcggggaacgagtgacctttccatcaatgccaaggaaaatcgaagaacacctgggaacgaggagggtgcctgagccttagtccaagccacattttgaaatgcctgccagaggattaaagaggttttggcaaaattcaccccacccccaaccctccaatgcccaggtagccctgacccaacctcccctgcaaccagccccagccccagccccagccccagccccaaccctgtccctttggttcctttccccgacattcgttatggtcaaaagatccagggagtcagtccacccaggagcagaggagaggacgtgtttcacgaatgagacatgaagtgcagaggaaatgcgacagcacctgtcctagaagacaaggcctgtcactgtcgactagcgctcattccaggcaatccacccacccatgaggtgaaagatggagaggaaggaagcttccctgtctgagacaagtatggaagccaagagctccagggtggtcaatcctgccctatcaagcagaaacaggttggaaagagagaaaccatcacgacagggatctccaggaagtgtctccctgatggactgggttgtgatcattgttgaagacattcagcgagagcgagaggcatctaggcccttcagaaacaggggagacagagcaagaggaaggacaaagcagaggccaaagcccaggcaggatacagcactgtgccactgccacggccatgaggggaggggtaccaaaaaggtggcttttccagaaaggccagcgttccagtgactatctgtgaaaatgctttgtgatgcatgggttatccctcagagttaaacatttgttttgacttagcagtttggaaacactctttttaaagaatcaatgaagggatattttgaagcccatggatgagtatattgagaaactaaatatcccaccttagaaactagcaagaaattattagtgaaaatgttctgtggtgtgtggattcatctcacagagttagacttttgtttttattctgcaggtttcaaacactcttttgtggaatctacaaaggaacattttagagcccactgaggcctatagtgaaaactgaatatcttgtgataaaagctagaaacgagctatctgtgaaaatgtttgtgatgtgtggatttatctcatagagttatacttatgtttatatacagcaggttggaaacactcttttagtagaatctaaaataaaaaatttctgagtccttgaggcctattataaaaaaagaatatccctgataaaaactggcaacacattatctgtgaaaatgctttgagatatgtggattcatctcgcaaagttaaacccttgttttggttcagaaggttgaaaacactctttttgtaatatctatgaagggatattttggagcccatagaggcctatactaaaaaccaaatatcccaggataaaaactagaaacaagctatgtgtgaaaatgttttgcaatgtgtagaatcatctcacagagttaaaccttgttttgattgggcaggttggaaacattctttttgtagaacaaaggaagggacattttggagctcattgaggcctatagtgaaaaaccacatatgccatgataaaaactagaacaagctatctgtaaaaatcttttgcaatgtgtggtttcatctcacagagtttaatctttattttgacttagcagtttggaaacactatttttctagaatctgcaaggggacatttcaaacccaatgaggcctgtagtaaaaaactgaatatcccacgatgaaaactagaaactagctatctgtgaaaatgctttgagatgtgtggcttcatctaatggagttgaatgttagttttgattcagcaggttggaaacttagcagtttggaaacactcattttgtagaatcaaagaggggacttttcttagccccctgaggcctttagtgaaaaatcaaatatcccgtgataaaaactagaaacaagttatctgtaaaaatgctttgcaatttgtggatttgtctcacaatgttaaacctttgttttgattcagcaggttggaaactgtctttttgtacaattgatgaggagatatttcaaagcccattgattgaggcttatagtgaaaaacctaaaatcctaataaacactataaataagctatctctgaaaatgctttgagatgtgtaatttcatcttatagagttaaatctttctttttattcaacaggatggaaacattcttattgtagaatatacgaaaggatatttcagagcaaattgaggcctgtagtgaaaaacagaatatactgtgataaaagctagaaacaaggtatctctaaaaatgctttgtgatgtgtagttttatcatacaaagttaaacctttgtattgcatcagcaggttggaaactctctgcttgtagaatatatgagaggtcaatttggagcccattttggcaggtagtgaaaaaccaatattctgtgatagaaactagaaaaggctgtctgtgaaaaagctttctgatgtctggattcatcacacagagttaaatctttgttttaattcaggaggttgaaaacactgtttctggaaaatctacggaaggcgggttggaaacacttttttttagtagaacctacaaagagacactttggagcccattgaggcctgtagtaaaaatacaaatgtcccatgatgaaaactagaaaaagttttatgtgaaaatgctttgcaatgagtggatttatatcaccaggttaaagctttgttttgacttagcagattggaagcactatttatgaagaatctacgaagggacattttagagcccattgagggctcttttaaaaaatcgaatgtcccacaatgaaaactagatataagctatctgtgaaaatgctttgtgatgtacggatgcatctcccagagttaaacctttgtttttattctgcaggttgcagacagtctaattctggaacgtgttaaaagacatttcaaggcccattgagaactataataaaaaacaaatattccttgataaaaactagaaaaatctatcagtgaaaatcctttgtgttgtgtggattcaactgagacttaaaattgttttgattcagcacgttggaaaaactcttttttagaatctatgaagcaacatttcacagcccatagaggcctatagttgtaaaaccgaatattctgctataaaaacaggaaacaagctatctgtgaaaatactttccaatgtgtggatttatctcacaaagttaaacttttgttttgttacagcaagtcgaaaacaatctttttgaagaacattcaaaggaatattttgaagccaattgaggcctgcagtggaaaaccaaatatcttatcataaaaacttgaaagaagttatctgtgaaaatgctttgtgatgtgttccttcatctgacagagataaatctttattttgattcagcaggttggaaacactatttttatagaatctaggaaggaacatttctgagcccattgaggcctatagagaaaaacctaatatcctgtgataaaatctagaaacaaaatatctgtgaaaattttttatgatgtgtgaattcatctatcagagataaaacattttttgattcagcaggttggaaaaactctttgtagaatctataaagggatatttcagagcccattgaggcctactgtggaaaattgaatattctgcaataaaaactagaaacaagctatctgtgtaaatgctttgccatgtgtgggttcatcttacagagttaaacctttgttttgattcagcaggttgaaaacattcttttaatagaatctacaaagggacacttcaaagtacattgaaggctatactgaaaaacctaataccagtgattaaaactagcagcaagctatctgtgaaaatgctttctgatatgtggatttgtctcacaaacttaaacctttgttttgattcagcaggttggcaacactctttttgtacaacctatgaagggacattttggagctcactgaggcctatagtgaaaaaatgaatatttcaagatagaaactagaaacaagcaatatttgaaaatgcttggtggtgtgtggattcatctcacagaggtaaacctttatattgattcagcacattggaaacactctttttaaagaatctacaaaaggacattttggaacccattgacaagtatattgaaaaactgaatatgccacgatacatactagcaacaatctattagtgaaaatgctttgtgatgtgtggattcatctcacaaagtttaacctttattatcattcggtaggttgagaacactctttatgtagcatatacaaaaaaaaagatatttttgtgaacattgaggactaaagtaaaacaccaaatatttcacagtaaaaactaaaaactgtctatctgtgaaaatgctttgtgaagtgtggatttatctcacagagttaaacctttgttttgattcaacaggatgaaaacacctttttttgtagaatctatgaagggacatttcagagcctattgtggagtatactgaaaaacctaatatcccagcataaaaactagaaagaagctatctttgcaaatgatttgtgatgtgtggattcatcttacagagataaacctttttgtatcagttaaaccctttttttattcctcgcaagttggaggcctcccacctgaccacggggccatgttgtggacagcttgtgcaatgaagggaatgcaaggatggagttggaaacacttcctgtgtcatctgtcttcacctttttttgcagatggaggtgcaggaccccatccacacctcagcagactgtatgctcacccgtatctgaccttattgctgctcacactcctagttctggaatgaaatcccaagatgttggaggagtgttcctttcatgacgtgaagcacctgctcggctgcaaaccgaattcgaattggattcaagcggcctgtggacaggactgctagggtcccgccctgggttggccacaggacaatgaggccctgacaggtgtcttctcctgagagtggtgtgctcctcttctttctagaagagtggctcctttgtatggggaggtgatttgtacacctgtgagtctcaaccatccccccaactcaccatggactcaggaagcacggaaaaacaaagaacatgcagccccataggccaagcagagccacacagacaggtgcaccagaaggtgaagggactcaaaaaaaaaagcactgcagtgcattaaacacattccttttaacagatgcccctcacacacacacacacagacacacacaaacacacatacagccacacacacacacacagacattcaaacagtcacaacactgccacagaaacacacagactggcagctcctgaggctgcacggttctgcaggaagccccttctgagagagagcagccctggaaaacagaggcgggctgtacctagaaatcacagggagggaatttcaaaaagattcactcccacatcgtctaggcaggcctgactcatcgtgggtatccttttggatccttagggattttgtggtttattcctgggactccacttgatgtgtcttcaggctggctcaccactgcccactcctaggattgtgggaatatcccatagagccctcagagtagacaggtgatagttcaatgccaacacacagccacagaggactccttctccaccaagatgaagggacttgtcaccagccaatggtggcattcactgtgatgtgagccgctgctcaccactggtgcctggtggcctgactgtcacatgcgcatccacaaagcaggctctggcacctggctgtcagggctgtaagcctggcaaagctcaggaaaatggtacagccagagctggcctagtctccagaaaaaggctgcctgcagcaaccgactgcagcatgctaatagtctcaaacatagggccttcatgagccatctccgtggtagggtcccacaggagaaggaggagtttgaagactgtgaggtgggatctggagactgctcttctgagtccattcccaaaagaggctgtgtgcatgaattcggtctcctggggatgggaataaagtctggtgagttgttaagaggtctctgggtgatggaataatatctgagatccaagaggcaggtgtcagtggaagatggccaggcccttgaaccccctgcctttcttcatcctgggcctcacaggggctcctgcttctcagcatggctctctggtaaaggcaggaaccatgacaaaggcaagtccaaggtggagcactgttctcacacctaaaacaggcctctcgcaggtgcacatgaggttaagagagtgtctcagaggatgtctggggcaatttgaaacctgaaaataacatccaggtgtgctgttgatgggcactgtggaccccccatgaaagcaaagaaaagtcaaggttctcctgggagaatgagcaaacttgtgcaggagtccaagccatgttgaaggattcctgccagagaatttaaaagcctcctgcaaagtgtaaacaatgccagccaccattatgagaccactacccacaacctggtgtgcggccagcctacccaaaataccttttgctttctgatatacctggcaaccaaaatatgcacaatgaaagtcagtcccacccaccaacagcccaatgaaataccccatccacaatgagaaaggaagtgcagatgacatgaaacagagcctagatttccaagtaaaagccagacacagctgcctgtttctcatcctacaggagtcatgcagctgtcttttagaagtgggagaacaagttatcttgatggtgtatataatcgaaatttatgattccgaaagtatcacaactgcccagtaattaaaatgtgacagtgtttataagaaaacactcatgcaatggattcccatgagaatcgtcctccatgaactgggaaacttttagtgtggaagactttgagccagacccagaaaaaccccaggttcacaaggaacatggaagtcagactgagccagacctaggaaactctaggcccacaaggaacatggaagtcaggaaaagaggaggacagtgtggaggccacatccaagccagcatcagtccatctcactccaatgtggctctgggaatggaagctgaattctggagctggccagaagggtcccagtttgcaatccaacttttccttgcacgattgagtcatcccacccgggcaccaggccatgctgtttactgtgcaatgaagggaatgaggggatgcagttggaagcaacttctgtgtcatctgtctgcaccttttttgcaggtgaaggtgtgagatcccatccacacctcaacagactgtatcctcacccctatctgaccttattgttgctcacactctgtgtcccagaataaaattctgagacaatggaggagtgcctccctgatgacctgaagcacctgctcagctacaaaccaaaatcgaggtaaattcaagaagccctgcgactggactgctggggtctggccctgggttggccacagaacaataaagcacggggagttgtctgttttggggtgtggtgtgcttctcttctttgtagaaatgtggctttttggcaaggggaggtgattttgaacctggcagttgtcagccattcttccaattcactgtggattcaggagccatggaaaaatgaagaacatggagaccttcagcccaagcagagccacagagacaggccaccggaagatggggtgacaaaaacagtgctgcagtgtgttagccacatttctttcagcagactccacttacctccacacacagacacacacacacacacacacactcacatgaccgcagccacacacagatatccacgacttgaaacactcccacaggaacacacatcccagcagcttcagaggctgtgtgtttctgcaggaagctcctctggagagagcagcctggggaacacaggtgggctgtacctagacatcacggaggggagcacatttcaaaaagactcacccccacaccctctaggcaggcccgttcaggccatcttcatggtcaggtcccgctggaggaggaggcacttggagactgtgatgtggggcgctggaaactgttcctctgattccattccccaaagaggctgtgtgcaagaattgggtcccatgggggaagagaatacagtctgctgagatgttaaggggtgtccaggtgatgaaatcataccgaagaccccagaggcagatgtcagcagaaaatggcagggcccttgagctcactgcctcccttcatcctgggcctcacaggggctcctgctactcaacatggctctctgggaaaggcaggaactatgacaaaggcaagttgaaggtgaagcagaagtcttacactttgaacagacctcacgagtgcagatgcagttcagagagtgtctcagtcaccgtctgaggcaattgcaaaccaaaaaaagtgtgtttaggagcgctgatgaagagtagtatggactcctcatgaaagcaatggaaaatcaattcttgccttggagaatgagagggcctgtgctagcgtccaagccatgttcaaggattcctgccagaggacccaaaagcctcctgcaaacaccccaatcccccacagtgagaccactactcacaacctggagtgcagccagcctacccgaagtactttttgctccctgaaatccctggcagccaaaagatctgtagagagaggcagtcccccatagcaacagatcaataaaagatcccctccacagtgaaaaagaatatgcagatgactgtaacagagcctagatgaccaggcaaatcctgacaccgctgcctgcttctcatcctataggaatcatgcagccctctgataagagtgggagaacaagagtttccttgttggcagatatggtaaaaatgctttgctatgtgtggattttcttttcacagttaaaactttgttttgattcagaaggataaagacactttttttgtgtccctatgagggaaaatttcaaaatccattgaggcctatagtgaaacaccaaatatcccacgattaaaaactacaaagaagctatgtctgaaaatgctttccaatgtgtgatttttatctcacagagttaaacatttcttgtgattcagtaggctggaaactctccttttctggaatctaagaggggatattacagagcaaattgaggcctatagtaagaaactgactatcctgtgataaaaactagaaacaaactatcagtgaaatgctttgcaatgtctggatttatctcacaaagctaaatctttgttttaattcagcagtttagaaacactttcaccataggatctgcaaagggacattttggagcccactgatgcctatagagaaaaatggaatatcccgtgatgaaaacttaatgcaagctatctatcaaaaggctttgtgaggcatggaattatctcacagacccaactttttgttttgattcagcacgttagaaacatgttttttttgtgaaatctaagatgagacattttgaagcacattgaggcctggagtttaaaacaaaatatccgcgataaaaactagaaacaagctatctgtgaaaatgctttgtgatctgtgaaataatgtcacacagttaaacctttgttttaattcagcaatttggaaacactctttctgtagaatctacaaagggacattttggagcccatggaggtctatagtgaaaaacagaatatctcacgataaaaacctggagtaagctatgtgtgaaaatgctttaggatgtgtaggctcatctcaaagagttatacctttcttttgattcagcaggttgaaaacagtctttttgtagtatctaccaataaacttttcaaagcccattgaggcctacagtgaaaaacagaatatcctgcgaaaaaaaactagaagcttgctatctgtgaatatgctttgtgatgtgtggattcatcttacaaatttaaacctttcttttgattccataggttggaaacactctttttgttgaatctaaaaagaaaaaatgtcagagctcactggggcctatagtaaaacaaataaacaaacacaaaaaacaaatattacacgatgaaaactaaaaacaagctatcagtgaaaatgttttgtgatgtgtggattcttctcacagagttaaacttttttttatttagcattttggaaacactctttttgtagaatctttggagggacatttcggagccctttgaggcatatagtgaaaaactgaatatcccgtgatagaacctagaaataaggtatcagtgaaaatggtttgtgatgtgttgattcatctcctagagttaaatttttgattcaacaggttgagaacacttttattgtagaatctatgaagagcattttcaaagacctttgaggccaataatgaaaaatcgattatcctgcggtaaaaactagacagaagatatctgtccaaatgctttgcaatgtttggattcatctcacagagttaaaccactgttttaattcagcaatttggaaacactctttttgttgaatctatgaatgggaatttctgagacctttgaggtatattgtaaaaaagcaaatatccctcacacacaaaaccagaaaacagctatctgtgaaaatgactggcagtgtctggattcatctcacagagttaaacacttgttatcattcagcaggctagaaacacgtttttcataaatctaagggaagacatttcgaacccctgaggcctatagtgagaaacagaatatcccgtgataaaaactacaaacaagttatccaggaaaatgctttgtgatatgtgaaataatgtcacatatttaaaactttgttttaatttagcagtttggaaaaactctttttgtagattctacataaaaacatttcagagcccattgaggcctatagtgaaagaccaaatatcccatgaaagatactagaagcaagctatctgtgaaaaagctttgcaatgtgtggatccaactcacagagttaaaactttcttctgatttggcagaatcagaacactcagttcaatcaaaattgaaacactccttttctagaatgtacgaagaaacatttcagagcccattgaaacctatagtgaaaaccctaatatctcatgataaaaaatggaaacaacctatctgtaaaaatgctttgggatgtgtggattcatctcaaagaattaaacattgttttcattcagcaggttggatacactctccttgtacaatctacacaaggacatttcaaagtccattgaaacctgtagtgaaaaacttaatgttctgtgataaaaactacaaaaaagctgtgtctgaaagttatacgcaatgtgcgatttcatctcacagagttaaatctttcttgtgattcagcaggttgatgaaaaaacgattatcccacgataacatccagaaacaagttatcagtaaaaattatttgtgatgtgtggattcatctcacagagttaatcattttttgattaagcagattggaaacactctttgtgtagaatctacagagggacagtttgaagcccattgaggcccatagtgaaatacaaaatatctcatgataaaagtagaaacaagctgtctttgaaaatgctttgcaatgtgtgggtgcatctcacagatttaaacctttgcatttattcagcaggttgaaaattctattttatagaaaacatgaaggggtatttcacacccattgatgcctatagtaaaaaacagaatatttcacaataaaaacaataaaagtctataactgaaaatgctttgtgatgtgtggattcatcttccagagttaaatatttgttttgattcagcaggttggaaacactctttatgtagaatctatgaagagccatttcagagcccattgagacctgcagtgaaagaccaaatatctccccccacccaaaaaaaaaaaaaaaaaaaaaaaaaaaaaaaacaagaaaaaagctatctgtgaaaatgccttgccattgtggattcatgccacagagttaaaccagtgttttaaaaatgcaggttggaaacactctttttgcagaatctacaaagaaatatttcaaagcccattgaagcctatagtaaaaaacaaaatatgtggagaaaaaaactacaaacaagctatctgtgaaaatgctttccaatgtgtagattcatatcatggagttaaagctttcttttgattaagcaggttgaaagcagtctgtttttagaatctatgagaagacattttagtgcccattgaggcctatggtgaaaaactgaatatcctgtgataaaaatgagaaacaggctatctgtgaaaatgatttgcaatgcgtagatttaactcacagagttaaacctttgttttgatttagctggttggaaacactctttttgtggaatcaatgaagggacaatatggagcccctggagaagtatttggaaaaagcgagtatcctacaatgaaaagtagaaatgtgaaaatgttttgcaatgtgtggatctatctcacagagttaaacctttgttttgattcagcaggctggaaaccctctttttgcagattgtacaaaaggacattacaaagctcattgagacctatagtgaaaagttaaatatcccacaaggaaaactagaaacaagctatctgtgaaaaggtcttgtgatttgggtaatcatctctcagagttaaacatatgttattttttcagcatgtagaaaacactatttttgtagaatataggaagggacatttcggagcccatggacaagtacattaaaacactgaatatcctgcaataaaaactacagacaagctatctgtgaaaatgctttgccttgtgtggattcctttcacagagttaaacatttgttttgattcagcaggttggaaacactctttttgtagaatctactaagggccatttcagagtccattgaggactactacagtgaaagaccgaatatcccatgataaaaactggaaacaagctatctgtgaaaatgctttgcaatgtgtggattcaactcaaagagttaaacatctgttttaatttggcagctttaaaatctctttttgcacaatctacgaataaacatttcaaaactcattgaaacctacagtgaaaaacaaaatacgaggagatatagactagaaacaagctatctgtgaaaatcctttgggatgtgtgtattcataccacagagttaaacctttgttttgattaagcaagttggaaacagtcagtttgtagaatctaggagaagatattttggtgcccattgaggcctatagtgaaaaacgaaatatcccacaataaaaacaaaacaaacaaacaaaaccaagatatctgtgaaaatattttgcaatgtgtggattcacctcactgagttaaatctttattttgattcagcactttgaaaaccctctttttgtacaatctatgagagtcatttgggagactattgaggtctatagtgaaaaacgaagtatctcatgataaaagctagaaactagcaatctgtgaaagtgctttgcaatgtatggatatatctcacagatttaaacacttgttttgattcagtaggtcagaaacactctttttgtaaaatctacatagggacatttcagagtacatgaaagccattagtgaaaaactgaaaatcccatgacaaaaactagtaaaaagctatctgtgaaaatactttgtgatgtgtcaattcatatcacagagttaaaccttgttttaattcagcaggttgaaacactgtttttgtagaaactaaaatggcacattttagagaacattaaggcctaaagttaaaaacgtaatatctcaagataaaaactagaaacaacctatatatgagaatgctttgtggtgtgtggattcaactcacagggttaaacctttgtttttattcagcaggttgtaaatgctgtctttgtagagtatatgaagagacatttcagagcccatcaagaagtatatgaaaaaactgaacatcctgcaatgaaaactagacacaagctatctgtgaaaattccttcctatgtgtggattcctctcacagtataaaacctttgtttttattcagcaggccaaaatcactctttttgtagaaagtacaaagggacattttggagcccattgtgccctgtcacgaaaaactgagtatcgcatgataaaaactagaaacaaggcaactgtgaaaatgttttatgatttgttattttatgtcacagagttaaacctttgcttttattcagcagtttgaaaacactctttttgtagactctatgaggggacatttcagagcctattgaggtctatagtgaaaaatcaaatatcctgtgataaaaaccggaaacaagctatctgtgaaaatgctttgagatgtgtagatttatagatttatctcacagaattaaaggtttgatttatcaggttacaacactctatttgtagaatctacgagggtacatttcagagaccattgaggcctacactgaaaaaactgaatatcccatgataaaaattagaaataagctattagtaaaaatgctttgcaatgtgtggacttatctcacaaagttaaaccattgttttgacttaacaggtgagaaacactctttgtagaatctaagaaggcacatttcagagcccattgaagtctaaagtaaaacatcaaatatcccacaataaaaaatagaaacaagctatactggaaaatgatgtgtgatgtgtagattcatttcagagaattaaacctttgctttgattgagcgggattgaagaatctacaaagggacactttgaagcccattgaggcctatagtcaaaaaccaattatcccatgataaaaactagaaacaagctatcagtgaaaatgctttgtgatgtgtggatttctcgcacagagttatacctttgtcttgattcagtcagttggatacagtcttttcatagaatctaggaagggacatttcagagcccatggaggaatatattgaaaaactgaatatctcacgacaaaaagtaaaaacaagctacttgtgaaaatgctttgtgatgtgtcgattcatctcacagtgttaagcctttatttttgtacagcattttggaaacactcttttagtagaatctaagaggggacaattctgagcccattgaggcctattgtaaaatatccaatattccgtgatcaaaactagaaacaagctatctgtgaaaatgcttgcaatgtgtggattcacctcaaagagttaaagttttgtttttgttcagcaggttagaaacattctttttgtagaatctacaaagagcatttctgagcccagtgaagactatagtgaaaaaccgaatattccacgataaaaactagagaaaaaaaactgtgaaaatgctttgcgatatttgaatttatctcacaacattaaatatttgttttgattcaacagtttggaaactcctttttttttgtacaatctatgaggaggtatttcaaagcccattgaggcttatagtaaaaaaccgaatattctgagataaaaactatatgaagctgtctctgaaaatgatttacgatgggtgatttcatctcacagaattaaaccattcttttgattcagcaggatggaaatattcttttggtaaaatcttcaataggatatttcagagcaaattgatgcctacagtgaaaaaccgaatatccagcaataatgcgcaggattcatcttacaaagttaaacctttattttgcttcagatgcttgaaaactcagtttgtagaatctatgagggtacaatttgaagccaatatcagcctgtagtgaaaaaccaatatcccacaataaaagtaaaaaaagctattagctaggcacggtggctcatgcctgtaatctcaggactttgggaggctgaggcaggcggatcacaaggacaggagatcaagaccatcctggctaacacagtgaaacccggtctctaataaaaacacaaaaaattagccaggcgtggtggtgggcacctgtagtcccaactaattgggcggctgaggcaggagaatggcgtgaacccgggaagccgagatcacaccactacactccagcctgggcgactgagactccatctaaaaaaaaaaaaaaaaacaaaaaaactatctgtggaaatgctctgtgatgtgtggatttatctcaaaaagttaaacattgttttgattcagcaggttacaacactctttttgtgaaatctacagaggaatctttcaaagcccattgaagcctatagtgaaaaatcaatatcctgagataaaaactagaaacaagctatcggggaaaatgctttgcaatgtgaagatttgtctcacagagataaacctttatttacatacagcaggttgggggacactctttttgtagaattaagaagttacaattaagactccattgaagcctatagtgaaaaacccaatatccagtgatgaaccctagaaacaagctatttgtgaaaattctttgtgatatgtgatttcatatcaaagagttaaacctttatttttgttcagaaaaatgaaaaactttttttgtagaatctgcaaagagacatttctgagcccaatgaggccaatagtaaaaaatcaaatgtctcatcaaaaaagctagaaacaagctatttgtgtgatttccaatgtgtagattcatttcacagagttaaacctttgtttttatacagggagttgggaacagacttttaaagaacctatgaatggacatttcagagttcactgaggcctatactgaaaaaccgaatatcctgcgataaaaactaggaaaaaactgtctgtgaaaatgctttgcgaagtttggagacacctcacagatttaaactgttgttttgattcagcaggtaggaaacactggttttgtaaaatctactaggagacatttctgagcccgatgaggcatatagtgaaaaaatgaatatcatgctttaaaaactagaaacaagtgatctgaaaatatgctttgtgatgtgtggattcctctcaaagagttacacatttgctttgattcagcacttttaaaacactgttttttattattattattatactttaagttttagggtacatgtgcacaatgtgcaggttagttacatatgtatacatgtgacatgctggtgcactgcacccactaactcatcatctagcattaggtatatctcccaatgctatctctctctcctccccccaccccacaacactccccagagtgtgatgttccccttcctgtgtccatgtgttctcattgttcaattcccacatatgagtgagaatatgcggtgtttggttttttgttcttgcgatagtttactgagaattatgatttccaatttcatccatgtccctacaaaggacaagaactgggtatatacccaaaggactataaatcatgctgctataaagacacatgcacacgtatgtttattgtggcactattcacaatagcaaagacatggaaccaacccaaatatccaacagtgatagactggattaagaaaatgtggcacatatacaccatggaatagtatgcagccataaaacactcttgttatataacctacaaagggacatttcggagtgcttgaggcctttagtgaaaaaccgaatatcccacaataaaaattagaaacaagccatctgtgaatatgctttgtgatgcctggatttatctcagagagttaaaccttcctttttattccataggttggaaacactcattttgtgcaatctacaaagggacatttcagagctcgttgaggctaatataggaaaatctaacatcctgcgataaatactataaagaagctatttctgaaaatactttgtgatgtgcgatttcatctcaaaagtttttttgtagaatctacaaggggagatttcataacccattgaagcatacagtgaaaaatcaaatatctcttgataaaaactcaaagcaacctatgtgtaaaaattctttgcaatgggtagattcatcttacaaagttaaacctgtgttttgcttcagcaggttggaaactctttggttgttcaacctacaaggcaacaattcatagtccattgaggcatttagtgaaaaaccaataacccatggtaaaaattagaaacaagctatgggtgaaaatgctttgtgatgtgtgggttcatctcacaaagttaaaactttattttgattcaacaggttggaaacactctttttgtagaatctacaaagggacatttcagagcccattgatgcttacagtgaaaaaccaaataccccaggataaaaactagaaacaggctatctgtgaaaaagctttgcatatcatctcacagaattgaacatttgttttgattcagcaggttggaaatattctttttgtagaatctacaaggggaaattttggagcaaattgaggcctatagcatgaaattgaatattctgcaataaaaactagagaaaatctatctataaaaatggtttgtgatgtgtgggttcatctcacaaagttaaatctttgttttcattcagcatgttggaaacacctttttatagaacctatgaggggacatttcatagcccatggaggcctatagtgaaaaactgaatattatatgatagaaactatagaagctatatgtgaaaatgctttgcaatttgcggtttcatctcatacagtttaaagtttcttttgattcagctaagttggaaacactctttttgtagaatgtatgaagggacatttcggagcccattgaggcctatagtgaaaagttgaatacttcgtgataaaaactagaagcaagctatctctgaaatagctttgcaatgtggggatttatttcacagagttaaacttttgtttctacacagtaggttcaaaactctcttttagtagaagctaagaggggacaatttagagccctttgaggcttatagtgaaaaattcaaagttttgtgattaaaaactagatacaaattatctgtaaaaatgtttggtgatgtgaaaattcatctcacagtgttaaacatttcttttgattcagtacattggcaaaaatttgtgtagactgtacaaagggacattttggagcccattgagaccaatattgaaaaaatgaacatcctgctataaaactagagaagttcttagtgaaaatgctttctgatgtgtgaattcatcttacagatgtaaacctttgttttcattcagccggttggaaacacgctttttatagagttcaggaggggatatttcagagcccattgaagcctctagttgaatactaagtatttctagtgacatatggtgttgagcatcttttcagaggtctaagaaatgtgccaggtatggtggcacacgcttgtggtcccagctactcaggaagctgaggtgcgagagctacttgagccctggaggttggggctgcattgagccataattgcaccactgcactccagcctgagtgacagagctaaaacctgtctcaaaaagataaataagacctggtgcgatggctcataccagtaatccaagcactttgggagggcaaggtggatggatcacgaggtcagcagattaagaccatcctggctaacatggtgaaaccccatctctactaaaaatacaaaaagttagctgggcatggtagcgggtgcctgtaattccagctactagggagactaaggtggcagaatcgcttgaagctgggagtcagaggttgcagtaagccaagatcatgctgttgcactccagcctgggcaacagagtgagactccatctcgaaaaatatattagaaaataataattaacaaataaataattgacttaatttttagaacagttgtaggtgtacagaaaaatagagcagaaggcatattgagctctaatatctgcctcacaccacagtacacacacttcctatattatcatcttgttactgtggtacatttgttatgcttgatgagccaatattgatattattaagttcatggcttatattaagattcactctttgtgttctaccatttatgggcttcgacaaatgcttaagcacatatatccaccattatagggtcacacagaaaagtttcactgccctaaaaatcttctgtgttccacctattcatccttccctctgctcaagcccctggcaactactgaactttttgtaataccatctgcctagttttgccttttctagtattccatataattggaactctacactatgtggccttttttcattggcttctttcacttagaaatacgtgtttaagattcctccatgtcttgtcatgccttggtagttcatttctttttattcctcaagaatattccattgtatgaatgcttcacagttagtttatccatttccctattgcaggatatcttggttacttccaatctttgttggttatgtataagttgctataaacattcatgtgcagaatttgagtgggtataagttttcaagtcatttgagtatataccaaagaatgcaattgccagatcatatggtaagcatatgtttagttttgcaggaatttgcaaaactgccttccacagtggctttaccattttgcattcccagcagcaatcaatgagagttcctgttgctccatatcctcatcagcatttgttggtgtcagcatttggatttgagccagtctaatagatgtgtaatggtatctcatcattgttttaatttgaattccctagtgacatatggtgttgagcatgttttcagatgcttatttttgctatctatatagcaaagggcagatacagacagtggactgcagggaaagagcttgctatgatgataggaagatgcagacagagatgatctcagggttaactgggcatcaactgtgccttctcctgtcacataaaatgtgatctacctgagttttgactggaaacacagaatatctgattatccataaatatttcttactgaggcttgaggtttatgtacgttatgatcaaaaggtgatatcaccccaatatataagcaggttggggtacaacagggaatgactgttggagatgttgagagtctacattgaatggatggtgtcactggctgcccatatatttctcattatggactttaacctttcatttgccacatgaaaggccactgagataggctaaatcacatttttctcttggggatctctgttactgagaaatttttgcgttctgggctacactgggttcataatctgactatatatatatattgtgtgtatgtttgttccttccctaaaatgctcagttcagctgcagttctagaggcaaatactactaggtttccattttagagagttgaagatctgaggtctggagaagttagtgtgtagaaagttatatttaacaagtggcaagaccatgtggccaggtcagataagctgccttcagattttactcttgaacttctactggataatgtatttttgttatagaaaagaaaagagtgaacttagatttttttttcaaaatcatggactgtaagagttctttcaagatatgatgaaaagcaataattgtctcattttacattacctttaattattgctcaccaataattgattattgaggcagcaaccttttacattcctctctgctttctatgcatgagggggcttcactgtaaataagaggtccaagattcagaaatatctttaacttgcaatacttgatcacatatatccatctgaaaaacattttgctcattagccatatggactcatatggcaaactacagccagagacacaaaatgtggaaagaagaaagggctatcagaactctcgtgtctccttacattttgtatttctattcatatgcatctagaatcaaaaggaatttgagcaaatgggaaatgcaaagtcctaatcaaagcatacccacatttcggttatctgcattattgcacatttaaatttataatgcatacaaaggatacaatttaataggtataaaaatgttaagtaaacttttctctcatgcaccccagtcactcagtagctcactttagaggtgacattttaattttgttgtgcatactttcataatttctctctctctctctctctctctctctctctctctctctctatatatatatatatatatatatatatatatatatatatatattttttttttttttttttttttttttttgaggtggagtctcagcctgtcacccaggctggagtgcaatggtgagatctcatctcactgcaacatctgcctcctatgttcaagcaattcaactgcctgagtagctaagattacaggtgtgtaccaccacacccggctaatatttttgtgtgtttttagtggagacgaggtttcaccatgttggccaggctggtctcaaactcctgaccttgtgatctgcccgcctcggcctcccaaagttttgggactaccatcgtgaactatcacacctggccagttttttctctttaaaataaattttattttgtatatttaaggtacacatatgatgttatagaatacatatacatagtaaaaaggttaccatagtgaagcaaattaccatatctatcacagatacccacattttttggtgtggcaagggaaggtaaaatcttatttagcaggaatcccatatacagtataattttattacctatagtcctcatgttgtatatagatgtataggattgttcatcctacatatctgctactgtgtatctctgacccacatgtccttatttcctcccttcctctctacctgataaccactctgttgttctcttttttttttttaggcagagtctcactctgttacctcccaaaagtcctgagattataggcgtgagccaccacacttggctgctttcaccatttcagacttaacttggagaagaacctgaggaaaaacatgactttaaaatgtttatgaatggagaaatctctttccattcaccgtcctttcctccatttcattcttattgtgaaatatgcaaacaaacatatggatatatcagttattaaataaacgtctgtgtgatacctatccaggtgaagaaatagagcactatcatcaccaagaagtcctctgtatgcccctaactcatcctaaagtcttccttcccttgttagtaacagatataacagatacccacattacctgtggatatctgcgtttctctccttggttctgtctataattttattatgtatttattctttcttttctttttttttttttttttggagatggagccttgctctgtcacccaggctggagaatagtggcatgattttgactcattgcaaactccaactcccagattcaagtgattctcatgcctcaacctcccaaatacctgggattactggcatgggctatgtgtcaccacgcctggctaatttttctatttttagtagagatggggttttacatgttggtcaggctggtctcgaactcctgacctcagtgcctggccttattatgcattttttaaaagcctaaagtaaagtctggttttgcctggtttttctcttacgtaattggagtaaaagtctgtatcctgctgcatctggctccttttactcaatattaagtatttaatattgacacttagcattgtttctgcattctattaaaacagtacaccagccaggcacgatggctcacgtctataatcccagcactttgggaggccgaggcaggcagatcacttgagttcaggagttccagaccaccctagccaacatggtgtaaccccatctctactaaaactacaaaaattaggccatgcggtggctaatgcttatcatctcagcactttgagaggctgaggcaggtggatcaggaggtcaggagatcgagaccatcctggcgaacacggtgaaaccaaatctctactaaaaatacaaaaaattagctgggcatggtggcatgttcctgtagtcccagctactcaggaggctgaggcaggagaatcagctgaacttgggaggtggtggaggttgcagtgagccaagactgcaccctgtactccaacctggacaacagagtgagactaggtctcaaaaaaaaaaaaaaaaaaaaaaaaggccaggcatggtggctcccacctgtaattccagcactttgggaggctgacacaggtggattacctcaggtcaggagtttgagaccagctttaccaacaaggtgaaaccctgtctctaccaataatataaaaatttgctgggagtggcagcacccatcagtaagaccagctactcgggaggctaagacaggagaattgcttgaacctgggaggcagagattgcagtgagccgagattgtgccctgcactccaacctgggggactgagcaagaccccatctcaaaaataaaaataaaaataaaaataaaaataaaaatacagtacaccagtgtgtatcccttcattgttggtggacatgtgggttgtgttcatttttgtcagttacaaatgatgctgttgtgaacatttgtgtatttctatttggttaccattagtgtgtatagtgtgtatagtgaacagtataaaacaagaggtgaaaccataggttacagggtaaacatatcttccattttactagctattattggttttatcccaatgttaacacaccaactgacagtcttacaatgtctgataattcccaaatctttgcattcttgttggtacttaattttgtcaaaattttaatttgagtcttttggtgggtatgtggcaatgattgtgatattaatttactgggccttttcttctctgtaactagccatgtcaagatagatgtgtggtgtgggaggggtaggagcccctagaggtggcatgggctctggaatccttaatcattctatgtgaaaaagttggtgaggcagtgatttttttttttttttgagacagagttttgctcctgttgcccaggctggagtgcaatggcgcaatctcggctcattgcaacctccacctcccaggttcaagtgattctcctgcctcagcctcccaagtagctgggattagaggtatgtgccaccacaacaagctacttttttgtatttagtagagatggggtttcaccatgtttgtcaggttggtcttgaactcctgacgtcaagtgatctacccgcctcagccttccaaaatgctcatattacaggcatgcaccactgcccctgaactgttttcattttattaattggctgattcattcagacacataattatcaagtgaaatctcactatttccttaggatttatcttcagtttagcttagaaaatctattcctattttaaaacatatacaattattctagtatggtgacacatgtctgtaatcccagctacttgggaggctgaggcaggagtatcacttgaacctgggaaactgaggttgcagtcagtcaaaatcaccccactacattccagcctggatgagagagtgagactccatctcaaaaaacaaaacaagaaggttttctccagatcatttttacatttgattattcagtctgttttgaccataccttaaagaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattctatatttgaaagatactatacaacattttatttacatattttaattgaagtctactgaaaatacaccagaaaacctaacagatacacttaacataagggaaacattatcctacactgcttcactttttcaaagatgttattcctcctagttaatgacttactctaaaaagagtgttagaagtagctgaaaagaaaggctatgtttaaatatgtgaagagggcaagtttgaacatttaatatttattgcccacctcttagctttgttatgctctcaagtgactcttaagagaatttcacacttcgacaatattcagagaataagagacatgacattgttaaataccatcaacatgcctgctgctccgttttgaaatgttcctgaattcaaaataccccaaaatagttcagaatatcttgcttctgatgtcaggatttactctgaacagaaatattttgaatgaagaaacacaaatatgtaatgaggtataatagtacccctcactaattattaaagaaagactacccgaaggctagatttatcttcttgcttgaaaaacaaaatcaaggaaacacccacagaaatacaagactctggatatgagggaatgaagtacttcccgaaagacagaaaacaaaggagttaaaccctgctactgccctaatttagtggctagagtttccagcagtggggcagagaaagtgggctcctagagttgtacaaagccaagagttccaggagactaaggtaactagagtttctaggtctgagaagctagagattcaaagagagaaatctctgatatctacagatgttctcctttcagtgcttagcagaatactgattagtgtatacatgtgagtaatctgctcactgccagggaaacaagcatcttcaaagattaaaaacaaacaaacaataacaacaacaaaaaccagtgcctgacattcacatatgacctggattatacctgtatttgccagccaaatgaaagaaaaaagctcaattcacagtgcatttggtaaagcaatttaaaaggtcttgcctcaggggtagaaattaattagatttaaactgagtactgagttgaatgcatcaaaaaatcataaaagaagtatctaaaaggatcaagcggttttgaacaaattaactgtgtcctagagaaaaagctcatattttgtacagaaatacaaaatatccagcactcacaaagataacattaacaaaaacttccattatattaaactgtagttaggttaaaatttctttaacagattcacagagactggcagcacaaagttttgtaaggatttagagctactggaactctcataccttgatggtagaaatgtaaaatgttttaaaaacttctgaaaactctttggaaatgtcttattttctcataatgttaagcatacacctatactatgacaaagaactccattataaggtgtttacaggccctcgatcagaaaaaacataaccaaacataagttgtataaacatgtatatggaaactttatttaagatagtcaaaaatttgaaaaattctaaatgtctatcaaagaaaagtggataaacattgtgtgacataatcacacaagagagattacctttcaccaattaacaaataatgagcttttgatacgcacaatgacacaattaatctcaaacacatgttgaaccaaaagatgccaggcagaaattagtgcacactgttttaattccaaaaacagatacaactactgtgcagatatgagaaaagtggttgcttcattaatgagaggtattaactagaaagagatattaggaaaatttattgggtcatatttgtgcacttgaatgaaagtagaatttatttttgtaaaaataaagatgtcagcagatattcaactactatacatgtactgtcacatgtaacctaccaaagaaaaatatgtttaaaaatacttttacaaaatgacaatttaaattaaataaatttgcaactatttgaaaaccaatttggctgttttctataaaagtaattattcatccacccaacttccctataatcaagtcactcctaggcacttattcaaaaggagtaaaaactcttctccacagaaagacttgaataagaattgtaataatgaattaacttttaattaccccaaaatagtaaagctgatgtgttcaacaacaaatagaaaaaaatctggtatattcacacaagaaaataccacctacctattgaaagagaccaactatttatatatgcaacagcatttatgaatatcaaaaacattattttaactaatctgtacacaaaagtacatgttgtatggttccattcatatgaatttctggaagacaaaaactattctattgtaaatagaatagttgttgccttgggaatggagatgcagttaaatgagaaagaacatgagtggactttgtggtatgatggttactacaacataatagtaaacgttactatattttaattatatatgtatatgcatttgtcaaaacttataaatattacttaaatttgttcaccctattttatgtaaattttatataaaaataaacaaaacagaaaaaaatcctagtctttttaggagtatgatcaaagttaatcacagattgtttatacgtgaatgaacacacaaaaaatatgtatgcacttacctctccaaaatgttgaagtgtctgcttgtaaaagataccgttaatatttattcatttcacatattcatatgattcaaacatttaaatatttaaaacaaatattaccaacacttttagtaaattggaaaatttaagtcaatatcgaattgagagtttttttctcatttggttgattcattaattataatcagcaaaaaaaatttgcatatgttacgtttcattatacagatacatttgtgacatataattgcagtattgggcaatgactgataaagttgtattttatcaaaacagctttctgagtatgtgatattgtgatatataagtaaaaaaaaaatgctaattcatgatattctgtccctggaagaatatggacaacagaaatattttgtagcatcaaattttagacaaaaacagaggtttacatttaacatcaatgtcaataatagagtcagaattgatatcaaacttgagaaatatttttaccaaaagtaggtctttcataattaatatgaattgatttctgccaaactatcatatttagccatgtggtcagtaatataatgtaaattatatgtagatatatatttttaaagttgaggacacctaaataaaacatgtaaattattttaattacttaacaatctattatatacaaagtatttaagtatattttaaacatatttaatttaactaattttttgagtgatttgggcaaaattctgttttagttcatgtatagacatgcttatatttgagttactgaaaatgcaaacatttaagtagtctactcttagcatattaatatgtcctgtattcattacaacattaattgcattaaattcagctactatgaataaataatctatcacatatacattttaaaggtagaagcatttcagttttatacaaggatgtctttttgagctgacataggtttccaagatttgagacaatatcagaagatttattaaaaatgatatgagacagcaactccccacatcactttgctggcatatatctgcatgggtgggctttacttgcttcaacagcacatgggaatgcagtgtgccccccataatccccaccaaccaccactgcagatggatccttgttgggcacagagtcatcaagccccatctacaccagtgccctgcccttgtgctgtgctgcacacagagcaggggatccccccacaacctgagcaattgctcctgcttgcagaccacagataaggcgccaagacctccactggccagcaccccaccccaagccatcaccacctacagtgcagcagtgcactctgtctccagcagaaggcccttactcccccaacagctgccttgcctccaatactgtggtgaacacctgcagagaggcagacacccctatatccactagtactttgctgcaggtactgcagtttgctatccccagcacagtggactccaaatctcgaggagccacagtgtaagagatcgatcaggttgttgtgggaatcaggagactggagagattggtaggtgaaacagaaggatttttattgagtgcactcagaaccagcagattaatatccaaagactggaccctgaacaaagacagcacttgccttttacgcacacttctaaaagggggtggtctaacttgaaacaagcttacagtggtgcaaagtataatgattcaaaagcaaggatacagaagaagaacaaaggcagtcaatcatactacgacaagttcacaactcaggcttacatatgactcttgctatgcagcccagatagctgttatctaggcttgttccagtgctttgcatgggcttatctcataacatttgctatggcatctaggggactgcaatccaggcctgctcaggtgtctcatgatcttcactgtgctgcttagatgaataacagaatcaaaagagaaaggaaaatttgtttttcttctccctatgttgagggagccctgggagactctccagagcacattctttgagccccagcttcttagataatgctatcgagactttgcctgggtctgggctttgcctgttactgcctttgggatgagtcagcctaatacagaaagattgtttctttctctttttaattttacttttctttctttaatttccagcctcaagggtgatgggagaagatgtaagaaaagttatagggaaaaatgcaaaccttcttggaaggccaaaaactttggagaataatttagctgaaggcagctaaattctcttaagggcaaaggttagataacaagggaatgtaaagaaacatatctagaaaaattggtttacttatgtctcaggaaaccaacctttgatcattcatgtgcaagactgctctctacttaggggtcaacaatgttaatttcccacaaattatgtttgctccaggcctttgtcttcaaatctgtactaaattaatacaaagttctctggcttagtgggactgtactctcattggtgatgctaagcagtgcagtcccctagctgcattctcaggcaaaataactgtgtctgaatacttttttcattggtcgctcagccagagtgtgcgggatggacccgacacaagagaacaaagctggggcctaatacaagtaccccagagttagagcacccagtccagaagttgggagctgagtgttggtgccataaaatctcccagaaatgaagccagtcagctgaatctaccttataacacaaacaaatcttcgacatcatcaaataggatgaaagaaaacaaaataccgtccaaaggtaagcaatctcaaagactgaagttagataagtgcacaaagatgagaaagaatcagtgcaagaatactgaaaactcaaaaagccagagtaacttcctacctccacataactgcatcacctctccagccagggttcagaacagggctgaggctgcaatggcagaaatagcattcagaatgtaaacagtaataaaattcattgagctataggagtatgttgtaagccaatacaacagagctaaaaatcacaataaaacattgcatgacctggcagacaaaatgccagtatagagaacataaccaacctgatagagctgaaaaacaccacaagaatttcacaatgcaatcgtaagtattaacagcagaataaaccacatggaggaaacaatctaagagcttaaagaatggctttctgaaataagataggcagataagaatagaaaaaaagaatgaaaaagaatgaacaaaacctctgagaaatatgggattatgtagagactgaatctacaactggtgtacctaaaaaggatagagaaaatggagtcaacttagcaaaagttgacttttgatatttttgatctcatggatcaaaatatcatccatgagaacttccctaacctagatagagaggtcaacattcaaattcaagaaatacagagaacttcagtaagatactccacaaaaagatcatcttgaagacaaataatcatcagtttccaaggtcaaaacaatagaaaaaatgttaaagacagtgtattagtctgttttcacactgctgataaagacatacctgagattgggtaaattataaagaaaaagaggtttaatgaactcacagttccacatgactggggagacttcacaatcatagtggaaggcagaagtcatgtcttacatggcaacaggcaagagagagaatggggaccaagcaaaagcagaaaccccttataaaaccatcaggtcgtgtgagacttactgactaccacaaggacagtataggggaaactgcctccatgattcaattatctcccactaggtccttccataacgcatggcaattatgggaactacaattcaagatgagatttgggtggggacacagagccaaaccatattattttgcctgtgtcccctctaaatgtgtcctcaagtttcaaaaccaatcataccttcccaacagttcctcaagtcttaactcatttcagcattaactcagaagtccacagtccaaagtctcatctgagacaagacaagtcccttccacctataagcctgtaaaatcaaaagaaagttagttactttcttgatactatgggggtacaggcattcggtaactatacccattccaaacaggacaaattggccaaaataaaggggttacaggccgcatgcaagtccaaactccagcaaggcagttgaatcttaacgcttcaaaatgatctcctttgactccatgtctaacatccaggtcatgctgatgcaagatgtgggctcccatggacttgggcagctctgcccctgtggctttgaaaggtacggttcccacctagctgctttcacaggctggtgttgagcaactgaggtttttttaggtgcatatgcaagctgtgagtggatttaccattctggggtctggaagatggtggtcctcttctcgcacaggcagcgcctcagtggggactctgtgtggggctccaaccccacatttcccttccccacttccttagcagaggctctccatgatcaccccccctcccccacagcaaacttcttcctggacatccaggcatttccatacatcctctgaaatctaggctgaggctcccaagccttgcttcttgacttctgtgcacatgcaggctcaactccacatggacgctgccaaggtttggggcttgcgacctctgactccctggcccaagctgtaccttggtcccttttagtcacagctggagtggctgggatgtagggcaccaagtccctagactgcacacagagaggggccctgggcctgtccccagaaaacattttttcccccgaggcctctgggtctgtgatgggaggggctgctgtgaagacctaggacatggcctagagacatttttcccattgtcttcatgattatgatttggcttcttgttacttatgcacatttctgcagctggcttgaatttcttctcagaaaatgttttggttttttttctattgcattgtcagactgcaaattatataaatatatatataatgtaaataatatgagccaataaatacataactaattaatatttaaattattaaagataaatattaattttaactattttatcaaaattgtaaatatggaaatgtatgtaacatacaattattgataaataagttgggggttttacttatgattttctcaaaacctgaataaaaatatcctttcttttttgagtcctggattttcttcagtttgaacaaatattggaattattaactctgcaccaaagctaaataactgattaaggacacatgatgaacctattagcataaatgtgtaaatgttatttttaaaagcagtgaaaaagttaatgaagatatttaattaacctgaagagtccacttactagataattcaatgtcattaattaggtgactcataaagcagatgctttccattttttgagagtggctagaaaaaaaaagtttatgtttacaacatgactctactaagaaacctgaatattatttcattactttttatcaagctaatatgagaaaggaagcaataagataaaaataaatgacagtcacttcttggactggaagcaaagaagtttaacaaaagaaaaaaaagcattcttccccactttcttaaaaattgagaccacattttaaaataattttgcttgaggtctaattaaaaatattatagtttccattttctggaagattatagtttttcaaaactgcaaacagtaggcagataaatataaattacgataaacataatgtagatgtatctttacagaaaactttagatcaaatgttagctttttctacaaagggtcagattttaagtatgttaggctttgacaatcatgcagtttctgttgcaaccactcaactctgacataatagcctgaaaacatctatagaccacatgtaagtgaatgatcttgtgtccaaaaaaaaaccttgttatttatgaaaacactgcagtttttactttctgcaatcgttatatgctacaaaatgttattttaaaaaattgtttcaatcatttaaatctctaaaaaccattattaccttgcaggctgtaccaaaaccataggccacaggctgccaatgctcacactgaagaaacaaaattgtgatatcagtacagccttcacagagaaaatagagtttgaaactagaatatcaactacaactggagagttaaatgaaaagtcttattagttagatggagtgggttttgcaagacactggtgagaagtacagaatttggggtaattgcagtaattacgtgggcttaaatatatatgtgtgggtagaagagggagatgtcaagcgatgagagtagagatgagtttaggataaattacaaatgtcttcaggccatccaaagtgtttataatttattctaatggaagtgacaagacattaatgagatctaaaatagggactacaagaaacagattacaatagataaacaagactgtaggcagagagcttcttaattccacagttcattggcaagtccaagaagaaacttaaggtgacctgaactatagtaatgacagtggattcacttataagtacagtcttgagttgattaatgatgagaattcattctgagaaatgtgttccctaggtgaacatcatagtgtccttttacaaacctagacggtgtagcctactacacacttcggcaataaggtagaagttattgcttttaggctacaagcccttacatcaggttactatattaaataatgtagccaattgaaacacaatgataaacatctttatatctaaacatagaaaacatacaataaaaagatatggtataaaaaataaaaagttgcacacctgtataggatggttactataaatggcacttgcaggcctagaagttgctctggatgagacagtgagtgagtggtgagagaaagcaaagtctttagatattactgaacactactgtagacttaataaacactgtacacttaggctacattacatttctaaaaactattctgtaataataaaataaccttagcttactgtatcttttttactttataatttttttgactcttgcaataacgcttagtttaaaacacaaacacattgaacatctgtacaaaaaatattttctttctttatacccttattatataagcttttttctacaatggaacagaacagagccctcagaaataatgccgcatatttacaactatctgatctttgacaaacctgagaaaaacaagcaatggggaaaggattccctatttaataaatggtgctgggaaaactggctagccatatgtagaaagctgaaactggatcccttccttacaccttatacaacaattaattcaagatggattaaacacttaaaccttagacctaaaaccataaaaaccctagaagaaaacctaggcgttaccattcaggacataggcatgggcaaggacttcatgtccaaaacaccaaaagcaatggcaacaaaagacaaaattgacaaatgggatctaattaaactcaagagtttctgcccagcaaaagaaactaccatcagagtgaacaggcaacctacaaaatgggagaaaatttttgcaacctactcatctgacaaagggctaatatccagaatctacaatgaactcaaacaaattgacaagaaaaaaacaaacaaccccatcaaaaagtgggcaaaggacatgaacagacacttctcaaaagaagacatttatgcagccaaaaaacacatgaaaaattgctcaccatcactggctatcagagaaatgcaaatcagaaccacaatgagagaccatctcacaccagttagaatggcaatcattaaaaagtcaggaaacaacaggtgctggagaggatatggagaaataggaacacttttacactgttggtggaactgtaaactagttcaaccattgtggaagtcagtgtggtgattcctcagggatctagaactagaaataccatttgacccagccatcccattactgggtatatacccaaaggattattaattatgctgctataaagacacacacacacatatgtttattgcggcactattcacaatagcaaagacttggaaccaacccaaatgtccaaaaatgacagactggattaagaaaatgtggcacatatacaccatggaatactatgcagccataaaatgatgaattcatgtcctttgtagggacgtggatgaaattggaaatcatcattctcagtaaactatcgcaagaacaaaaaaccaaacaccgcatattctcactcataggtgggaattgaacaatgagaacacatggacacaggaaggggaacatcacactctggggactgttgtggggtggggtgaggtggggagggatagctttaggagatatacctaatgttaaatgacaagttaatgagtgcagcacaccagcatggcacatgtatacatatgtaactaacctgcacattgtgcacatgtaccctaaaacttaaagtataataataataaaataaaaaaagaaaaataaagtttttaaatttatattatttacttttaaaacattttattaataagacacaaacacatacagtagctgaggcctacacagggtcaggattatcaatattactgtcttctgcctttatatcttgtcccactggaaggtcttccagggcaataacatgcgtggaactttcatcttctacgataacaatgcttccttatagaatacctcctcaaggacctgtctgaggctgtttaatggttaactctttctctctctcctctctccatatatatatatatgaattgtttggctcattataatcttatgggaccactgttctgtaggtagttcatcattgaccgaaatgttcttattaggcagggcatgattgtatattatttttatttaccactgaatggcaatattaaatatgttacaagaatggtttggatattaaatccttattattcttattattgttattgagacagagtcttgctctgtcgtccaggctggagtgaaatggcactatcgtctcggctcactgcaaccttcgcctcccgggttcaagtgattctcccgcctcagcctcccgagtagctgggactacaggcgcactttaccatgcctggctaatttttgcgtttttagtagagatgggatttcagtcaccacgttggccaggctggtctcaaactcccgacctcagttgatccacccgccttggcctcccaaagtgttgtgattacaagtgaccactcccagccttaattccttattatgaagacatgtaattcatataacaaaagcagtaaaaatgtctagaatcctatgtactttccagaatgctgtcaagagctaagctgccatggagttgaaatagctaattaaaacaataagccaaaatgacagtaacagtcaaatctttactaactgagatagtttaagcaagaaactaaagaggaaagatcgctagctcctccaatgttccattttgtcccatgaaacagctccaggccaaggtcatgtagctcagcacaaatgcagatgtgggaattttctcagcaaggatcttttgaccaaggagccatgaacaaaaagctcctttcatcttatggacctgggtccttgggacagaaagaggaggaagggctaagaatgggaaaatactgagttcagattcagaatagagaataatgatttcaatgtttcccctttctcctctcccttatccctctctccctatcataaggagttctctgcaaaggttttctattgagggtccctaataaggatagctcagatgggggtgcctgagacttgaatggcagacatgcacaggaggatggttggctagcggggaatgagtcctagactgcagctcccattagatattgtaatgcactggctgtttgccaattctggtatagggagagtatctttctctagtgaggcctgccaggtaaagccattgtcatggcctatggttaggcctgaaaggttacacatagggtttctgcctggagttggactcctcagatgccttttggattttctgtcaagtggtaaacattaatggaagattaaaacaactccaatttgacaagacaactaagggcactgttcatgaagagtgggctcttgctgtggaaacttggataatttaggatactatagagaagtgtggaatgaataatataaaaagaatggtacaaataccatccacagttccatgatcagttataaaattaagtatgtaatacattcttgggttttcttctcttctgcattgtcatgtatataattgtttgtcttattttatcttccatttttcccatcatttttagggtaggctggtttgaataacttcataatttattatcttatttcaggatattaagacatagttgagactgaatccgaagaggagtgaatatcatggatacctattttggataggaccactgcattttaatttgtgcaacatatatttgaattatatttgacaggatcatgtacttgttactgttactcttttgaagtttaagctttagaaaaggcaggtgcatggatattgaatagtcttaagctggaccatcggctatttcagactggcttactcaggcatattccaaaactctggtagtttgactaagtacttgctcaatttggaacagctaaaaatgatatccccaggcttactcacaattcaggttttacattaaacctaccttctttaaggaaaagagcctgagatagaaggtgccttcctattctttttcctgacaagcagtgtaacaaaaccatttactttcctgtaacgacagtcacaaatgaccaaatgtccagtccttagttctgtggccaacattctgtgttattcaaatatgaaccttggctgagatcctatgatcaagaagcaagcagctatgacagaagtattttaatgcttagagaaaaaaaaaacaaaggtagcaactcactgttaggttagggttagtctgcagatacctggattaagatatcttaagccactgtgtggtccctggctgaccagagtgagttcatttatatctatctcctctatgtggataacaataaaaacataacagagggagatggattccataaatatgactgttgaaaatgttatagctacagaggatctaagatatatgtttggtagttggactaatgtattgtttggatcaaataaaatatgtgttagagaatgcaactgtttattcaaagtataggggcaaagtttaggcccagatcagtcaggaaggtggcaaactgtttcacacatttcctgccatgtaaatcagaaatgttgtgtagaacagaacttatatacaagctaaaataagtaaacacaaaacaaaagatagtgaccaaaatctttagcaagaagaggtgcatcacaaaaggaaagaggaacaggaatgacctgatatgaaactataaggtatccctgtaagagatatgaatggaggctgctacagtaagtctaaggccaacaatgtagagagaaacagatgaaatttttcttcgtattgttaaattaaaatgcaaacattcgagcttcccagcttccacatcaaagtagaaaaaaaaagaaatttgcattagaaatgtgtgtctagcttttatgaaggatgacagaaaaaattattgtttctcaaagcagtttttctaaaagtacatttgtaaaatggacaatgtgcctcaagttacaaaaaattattttattattctctatgtaaatatgtttcccatgagtacatttaatgatgtttagactaacaattttgtttaaattttaagttaataagataaactttgaaactgggaaaaaaacaaatagcaaagttagcataattttagtgccagtggttgcacaggagatcctgattctccagcttctcagtcatggcaaaaggagcaacagtcccagctctgtcgtttttctggaggagttctagcaatcatttagaagatcagcccaagacctgctccaccaactctccaatcgtgtaagaaactaattctatatattaaattttgtttgcctatattacctaaagatttattcttataatctataatggaaaattggaatattgagtatgctgatgaaaaagattacattttcttaaacaaaagttcactcctaaatgataaattcaattataggagcaaatttaggtaggcataaaaagagaaaagtgaaaatacaattgaaaaattgaggccgggcgcggtggctcacacctgtaatcccagcactttgggaggccgaggcgagtggatcacgaggtcaggagatcgagaccatggtgaaaccccgtctctactaaaagtacaaaaaattagctgggcgcgattgtgggcgcctgtagtcccagctactcaggaggctgaggcaggagaatggcgtgaacccaggaggcggagcttgcagtgagccgagatcccaccactgcactccagcctgggcgacagagcgagactctgtctcaaacaaacaaacaaacaaacaaacaaaaaagaaaaattgaagcaactccacatgcattccagctttacagagtgaaagtgtacgtgaaattttattaagagacaataatttataatgcataattaactcaagaattaatattatttgacacaattttgagcatactaaaaggtaactggattttataatctaattaaaaagtcatataagtaaatacaatgagtattacctttataaatactttaagatgcattcgagtatatgctataatggaaatattcggccgggcgcagtggctcacgcctgtaatcccagcactttgggaggccgaggcgggcggatcacaaggtcaggaggttgagaccatcctggttaacatggtgaaaccccatctctactcaaaatacaaaaaaaattagccgggcatggtggcaggcgcctgtagtcccagctactcaggaggctgaggcaggagaatggcgtgaacccaggaggcggagcttgcagtgagccgagattgcgctgctgcactccagcctgagcaacagagacagactctgtctcaaaaaataaataaataaataaataaataaattagtaaattttgcataagtaaattatacctcagtaaatctggctaaaatacaatgtaaatatgtgtatcaaccaccattaatttaaaaattctagggccaggcatgatggcttatacctgtaatcctatcactttgggaggctgaggtgggaggatcccttgagcccaggagttcaagacaagcctgggtaacagggagagcctcatctctatagaaaattaaaaaatttaattagcctatcgtggtggctcacacctgtaatcccagatacttgggaggcttttttgaggttatagtgagttatgatccagctactgtactccagcctggtgacagaatgacatcttccctctataaaaataaaaataaaatctatgacatttaactgattacatatttaatcaattaattggaataaatgatatcctgattatgacatttcaatagacatattattatttattttaatatttgaatagagtaaataaagtcctatttttctttcaatttgtcatttattttatgttgctttgaatagaaaactaatgctgcaattgtgtacaccattaaatcattaggttctaatttccttgatctattacgaaaagtgattttcaattttaatatcaagggcattatttgcagaatattgttattctgcaaatatattctgcaaatacattctgtaatatttaaatatcataatcaagcaaactcttaaatgtgacacctgaaacaattataggcaaagaaaatactagtaatatagctcacagataaagcttatttagtataaagtatgcaaggaacttcggattcagacaatatggcacagatccatgtttttcccgcctctttttgttatgcacaactgtatattttgaaaatgacacatgtgactaacatgaaaaagctctaagagatggaggtaaacagaagaagagttagtttgatatgcaaggaatggtgaaacagcacaacagcaaggcatcttgtgtatcctgaagtcctgaagaaggccttcagacttatttttcctaatcccccaatctagcaacagaagatacctcaagtaagctccttcctcccttggatcaatcaggagccactagcttgagacacccaccaccatccaggagaagcagctaggagaaatgctaagagaggtgctctccttcccagtacagcttgaggcttccttttctaccaggaagcacaaaggtgggaaaatagaatcaggaagagggacctagtagagaaagtggcctggcctaagaagctgctttgtccctgcaggcctaagactctcttcccaatgaccccagagtagccaggggacattggttgggggattctaccacacccctcaccacatacctcagacacctggtagcctaacctggagaaactgcttccactgccataggcagcactaacagggagcagtggaattcccagcagcaccatattaatcaaagagtctgaaatcacaatgcaaaagctctaaacattaacttggtattgaaactacagccaaaacaattggccagtgcaggacagttctccatgtggccttggattgacccagttctcttccctttcttccttgtaggtcttaataattactgtagattgtgctgggaatacattatggtgagataaggaggggctgactggactagcctgggcctgttgctctttcctctggaagcaggatgtccctcaaagctttaagtcaatgtttcacattggctctgaggtatataaccctgaacaggctgtcttaaagagtcctggctgggcgtggtggctcatgccttgtaatcccagcacttcaggaggccaaggtgggtggatcacctgaggtcaggaattcaagaccagcctggccaacattgtgaaaccccgtctctactaaaaatacaaaaaacttagcgtggtggcaggcgcctgtaatcccagctacttgggaggctgaggcaccagaatcgcttgaacccaggaggcagaggttgcagtgagccgagaccgtgccattgaacttcagcctgggcaacaagaaccaagctccatctcgaaaaaaaaaaaaaaaaaaaaaaaaaaagcccctcagctgtggtgcaagtggggaatgcacagctgagactcgatgtgccctagacagctttcttgagtcttcaggaacgagctcatcatagatcctagcattcttttgtcccttgctgcctacctgtaagtcacaaatctgctttgtgtaacttgttgcatatgagtgtattctgtctcctgcactcagacaagctggtaagcagcacacagtaaacctaatccacaaaatgcgtccagcaagcagggccccatctaatgtaatcatagcttatttgagaagcaggaggggtgatacttcctagtacccagcccaggggaaagacagcagcctgggggcatggggattgaatattttcagaggaaggaagggtgataagtcggatttaggtctgccacttcccacagatgtgaatgagatggctgcatggatcaaggcaaacaaaaggcaatgaggaaatagaggagcataggtcccttggttggggatatttatttaattaccctgtcattcatgggggcagagagtgagggaagtgtgtactcaaccagacactaaggcacctgagagggaaagaagaaaggggtcctcagatcttccttgaggcatctgagaaggaatcaatacatgtgataaaggccttcacagaaagggagactcattatctaaaggacagatatagagaaaggccaggcatgtttctttgatgaaaggacattgcaaatccaatgtcttgggctgaatggcagagtcagaaatgggaccaagttctcggggtccccaaatggaggccaaaggccttatatttctgtcaaggtaagaggagaaaagaaagaaattcagacttttttttttgatacaggagtccacataatacttccaggtcctcttagggagaaaaactggtgacactggaaggttttagaatgaatgcattgaccagtagtgcttatctacctgtgatatggctttggtccatattggatgtcagtgaccatggttctcacttgtgagtgcattattggtattgagcccccgacttcttgtagcacaaaaatcaccattgcctgaggggacatactctttgacaactcagaattcaagccataacagtggggcatatcctgcctgccacctaaactacccaagccccagtggattatttaacaaaagcagtactacatggtaagtggagaataggacattactttattaattcaggactacaacaaactatcccttttaagcagcctgtaaggatccattggattctcctgtggcaacctggggcccaggactcatagacatgcttactgacagcatggcattgtcatgcatcagtgcatcagtgtgaagagactaccaaacaggttttttgtgagcaacaagactgtttatttcacctgggtgcaggcaggctgagtccaaaaagagagtcagtgaaggaagatggggtggggccgttttataggatttgggtaggtagtggaaaattacagtcaaagggggttattctctggcaggcaggggtgggggtcacaaggtgctcagtgggggagcttctgagccaggagaaggaatttcacaaagtaatgtcatcagttaaggcaggagccagccattttcacttcttttgattcttcacttgtttcaggccatctggatgtatacgtgcaggtcacaggagatacgatggcttagcttgggctcagaggcctgacattcctgtcttcttatattaaaaagaaaaataaaacaaaatagtgttgaagtgttggggtggtgaaaattttggggggtgctatggagagataatgggtgatgtttctcagggctgcttcgagtgggattaggggaggcatgggaacctagagtgggagagattaagctgaaggaagattttgtggtaaggggtgaaactgtggggttgttaagaggagcatttgtcatatggaatgattggtaatggcctggatgcagttttgtatgaattgagaaactaaacggaagacacaaggtctgaataagtgaaggagaaaaacaggtattaaatgactaagaattgggaggaccaaggacatccaattagagagtgctcaagggggttcagcataattacttgtttggttggtgagttttggggctctatccttgacagagtcctcttttttaagttttaagttggaggctgagcttggtgaggtgtgtttttaaaagacaatttgtctgtcctaccattcctgaagattcaggatggtaagggctataaaggttttactgaataccaagagcctaagaaactgcttgggtgatttgactaataaaagctggtccattatcagactgtatagaggagggaaggccaaaccaaagaattatgtctgacagaagggaagaaatcatcgtggtggctttctcagaccctgcgggaaaggcctctacccatccagtgaaagtgtctacccagaccaagaggtattttagtttcctgactcagagcatgtgagtgaagtcaatttgccagtcctgggtgggggcaaatccctgagcttgatgtgtagggaagggagggggcctgaataatccctgaggagtagtagaatagcacatggaacactgagaagtgattttttgaggatagatttccacaatggaaaggaaatgagaggttctaagaggtgggctagcagcttgtaacctacatggaagaggttatgcaatgacaacagaatagaatgggcctgtgaggctggaaggagatattttccttggtcaaagaaccatttgccttgtgtgggaagagattgataggtggaagtttcagtcggtgagtaggtgggagtgaccgattagaaggagaaaaactggccgtgagggacagaagttggaatgctagctgcttctttagctattttatcagcataagcattgccctgagcaatgggatctgatgccttttgatggcctttgcagtgaatgactccagcttcctttggaagtaaagtggccttgagaagagcttttattaaagaggcattaatgatggaggacccttgcgcagtgaggaaacctctttctgcccatataatggtatggtggcgtaggatatggaaggcatatttagagtcagtttaaatattgatgtgtagtccctttgcaagagtgacgctcgagttaaggcaatgaatttggcttgctgagaggtaggggagtggggcagagcggtagcctcaatgatagatgtggaagatactatagcatagcctgcctttgctggtgagtggcaattaggcctggtggaactgccattgataaaccaagtgtgatcagggtgaggaacaggaaagaaggaaatatgggaaacggagtgaatgtcaggtggatcagagagatacagccatggaggtcaggtgtgatatccggaataatgtgggaggccagattgaagtccgggccaggaaaaacggtaattgtgggagactcaacaaagagtgagtacagctgaaggagccagggagcagaaagtatatgagtcaggtgtgaggaagaaaatagattttggaagttatgagaaatgtagagagtgagttgagcatagtttgtgatttttagggcctctaaaagcattagggtgatggcaactgctgcacggagacatgatggccagagcagatcctgaactaacatgtaagacttgtctggagtttgaataggtaaaatgggagaattgtaaggagagtttacaggttttacaagcccatgctgtagcaggggagtgataacaggcaccaaatgtcacacacgtccatgtgaagagaccaccaaacagacactgcatgagcaataaggctgtttatttcacctgggtgcaggcgggctgagtctgaaaagaaagtcagtgaagggagataggggtggggccgttttataggatttgagtaggtagtggaaaagtatagtcaaagaggattgttctctggcgggcaggggcgggggtcacaaggtgctcagtgggggagcttctgagccaggagaaggaatttcacaaagtaatgtcatcagttaaggcaggaaccagccattttcacttgttctgtgattcttcacttgcttcaggccacctggatgtatacgtgcaggtcacaggggatatgatggcttagcttgggctcagaggcctgacaggcatggtttactgatagctctgccagacgacatgcactggaccaccattcagccagtggttggctatcttttgactgagactggacatgggcattctacccaacgggccaaactaaatgcagtggtgatggccatgcaggctacctctatcgcgtatcttgctatattttcagtgacttatgggccattgccaaaagcctggccatctgatcaggacaatggcaatggaaggattggactgttagaggatatccatgtgagaacaaggactaagaaaaacagcttgttgtctgaaaaagacaaatatatgtcaatcatatgggtgctgaggcaactatagccacacttgagaggaatttatgccatccttttacatagcccatgggattttacttggaccaaggaatattttttactattcaagcaactagataatgggtacacattagtgaaaaaagatgggctttttaagtacattgtcatcctcaggccaatagagttattgaataatggaactcacaaagcaactgaagaaagaacatcaagatgtcctgctagtgagggggtagcccatctgactagggcaatagggacactaaacactatgcaccaatgcaaaggaaacagcactgcagtgcatattgagggacactgagcttggttgggttggaggtggatgagaaacccacctgactaggctgtctgtgcctgtaaagtctcagtctgtgttctcaaccattctttttccttttcccctatagagtacatgtcctggggatgaattgcagttcagggtgccatagtaccccagagaggccaccctgtctctaatctggagtttatacttcccttgggtacctcccctataaggggattccacaggggtcggggacaggactaaggaatgacagactgctagaatccctctaatgatgctggatgcctctgatccttccatttgggtggatgatgttatgagatatgccagctttgtactggagtggatgattgaggcagaaaggtttgagtcaagcaacaagggcaatggatgtctgcagaagtagcttgggactaaaacagacagaccgggttgctataccaactcagcctaattcttattcaataggtagagaacatctgagaccctggaaagggtgagaggtgggcattaaactgtcagtctgcttttccacatggatggggcattataggcctgtgagcataatgccttagtggcctcttccaaagtgccatggttacaccatgggtaacctgacaaagtgctggatgctccatccacgacctcgttctctcattgactagaacgatcctttcatcttgcctgtggttaactactccagcactcctaatgccacagagtacagtaatggaccctaagtcctagcttactgagtgaggacctagcacatgccacataggaagaattcaaaggtgctatcttttaacttaaataactttgtggaaaaatgtcatgaccacaactaatgaatctttggtgggcaggtgctttgatgcaccaggctcctttaattacaaagatgtgtgctcatgatgatgaagagaacaagtatcggagagtgctagccctctgcatagaggctttaggattgtatggggtaaaatgtatgaggaaaactcaggcaactactgccatcaatgagacttagctagtgagtgccaataccttcatcctcataaataatactagcacagggggtctgtgtgtgccagagggctacatctttatctgtgggcaatctggggtgactgaaatgcagggtgggcaaagtcatgcctggaaaacttacaggtcctgccccattgagtgtgctagggatgctcctagaattcacccccaaaatgaagtgctccattgactcaggagcctaatgctgtataccagacttaccaaagacctgactggatgtgtaactgactttgggtttacgtcttttatgagatctttggtaccattcataggagttattgctcataaaaaaatgaaaataatcctgtcccaaaccatggcaaatattgcctcctccattgccactgtcttagaagccaaggaaacatctcccagatccacctagaaagttattttaaacaacagaattgttccagactctttttgtttgagatggagtttcgctctcgttgcccatgctggagtgcagtggtatgatctcagctcactgcaacctctgcctcccgggtctaagtgattctcttgcctcagactccagagtagctgggattataggcgtgcaccaccactgctggctaattttgtattttttttttttgtagagacagggtttctgcatgtttgtctggctggtcttgaactcctgacctcaggtaatccacctatcttggcctcccaaagtgctgggattacaggcatgagtcaccgcactcggccctccagactttcttttagctcaactgggagaagtgtatacaattgccagcacctcttactgtattgggataaacatcttaggtattgtagaaacataggtagaggagatccagaagctgacccattggttgtagacagtggggccacctgaagaatccttctttaacctctatggcaacctcttacctagatctttgagacccagggctaaattactactgcagagaggtctggctgtgctgctagtggtagtagtcctcctgggactagtaaaatgtattctggctatgactcaattatgtttcactgagacagagtcagccaaggtgttacattgatctgacaagacaaacctccacctccagatctggagaggtcaatgggcatatgaaatacaccagcttttctaagggaaatatcttggttggagcaggagactgcaggtcaactttccaggtgtccttggactgacccaattatcccctctttcttgcttgcagttgtcaagagcaactgtagtatatgctgagaatgcaatatcctgagacagggaagaactgcctgaaacagcctaggccttgttactctctcccttgacagagaatgttcttcaaaactttaggccatagtttcccattggtcctgaggtgtgtaacctagggcaagctgtcttgtggggtccctcaactgtggtacaagtgggccatgcacaatcactccatccacttcaggcacttcacatgcattccatccacttcaggcaactttgttgagccttgggctactggctcgtaatggatcggctcacataggtacctgttgtctcttgctgtttgtctgtaaatgatacatctgctttatgtaatttgttgcatatgagtgtgttctgtttaactgaactcagacaagctagtaaatagtacacagtgtacctgccccacacccaggatgtacatgctaaagctaaacagtgtgactgcctgccaaaaggaacagtttaaatagagctcagaattgtctgccatgatagacaaaatgtccagaatataattacaaatcaccgatcatacaaagaaccaagaaaataacaatttgagtgaaaaaagacagttaactgacaccaacaccaaaacgcatcagatgttggaatcatctgaatatgattttaaaatatctagcaaaaatgtttcaacatcaaatagaaattatcttaaaatatataacaaaatcgcaaaatattaaccaaacttgatttgtaaaaaaacaacaacaaaaaagaaccaaatgtaaattataaaagcaaacaaacactgtaacagaaatgaaaaatgtgttggatggagtcaatagtgccattgagatgcgagaaggtaaaatcagtgaatgtgagggcagaatagtagaatttaaccaatttgaacaacataaataaaacagactgatacataaaatgaacagagatgtaggtatgtgtgaggcaacaacaaaagatccaacatttttattacgtgtaccagaaaaaaagtaaaatgaggctgaaagaatacttgaagaaatagtgcttcaaaaaaacctcaaatttgcagaagacacaaatgtatagattcaagaagcctaagataccctacacggaataaacacatttcaagaaatattttgattaaacttttaaaaactaaagacaaaacatttttatttggtagtttagaaacataaatctaccactttaaaattataaaggtcagaaatcttaaatggttttcattaggctaaaatcaaggtgtcagcagcaccgctttccttctggggactctaaaggagaatacatgttcttgccttttccagcttctaggggctgtcttcatttcttgtctcttgtccgctttccccattccttgtctcttggttctttcctccagtacaattagcaatgtagtatctttaaatattttctaccacactcttccacatttaaaggatccttgtgattaaattggccccccccagataatcaagtatgatctcttattttaagttccgctgtttagtaagcttaatgtcatgtgcaaccttaatactttcttgcattgtaacatcatatattcttatattacatagcatatccttcctgacatggagaataggacagggacagtcttgtggggggtggggggggcattattctccttatcacagttagcaaagattttgtgccatgaaaacatggaggaaatacccttatccttatttttcttcagtctttctcatcaaatagatctttagatccaaaagagaagactcaacattgcttttaattaaatctcaagatgaacgaagaggcactatgagccctgggccctagtattggagtagaactcattccaaaacaataagaaagtttaggaaagagatttttaagttgctctagatatctttgaggattatggagaatagtaaaagttttagaagacaagaaatgggcagtgtactaattttttaaaggaagatagatctcataaactataggtgaatgagtttgacattacttctggaagcaattttaagaagcatgaaaacaatactttaaaagcacttaaaagaacgctttgcaatcatgaaacaacatgggcacaccgagaagaaattgtatcagaaaaatgatatttcttcctattttttgaatctttatcttgtccttttattgttagttggcatgcaataattgtacatatttatggaaacagagtgatattttgatacaggtgtacaatgcgtaatgatcaaatcagggtaattagcatttcaaacacctcaaacatttatcatacttttgtgttgacaacattcaaaatcttctcttctagctttttgaaaatataccataaattatagttatttccatgtgaccagctatagagcactacaacagaacttattcctccaatatagctataattttgtgtccattaaccaacctctgctcccacatccttcccaacatctaataaccacaattctaccatttactttaatgagctcaaatttgtttagctcctgcatatgggtaaggacagacagtattaatttttctgtgtctgacttattccacttaacataatgttcgctagtcttatccatgattctgcaaatgacagaatttcattctttttatggcagaatattattcatatatatatatatgaatgtatatacaaatttggtatatgtatataccacattttttatccatccattgatggatatttagcttaattccatatcttggttattgtgaagacagctgcaataaatatggaggtgcagatacctcttaagtgtaatgatttcctttcctttggataaacacctagtagtgggatcactagatcatatggtgtctctatttttgttttgagaaaccaccatacagtttttcataataagtgaaataatttaacttaccaccaacagtgtatggtagtctaatttttcatgtcttacatgtaaatttttaatccattttgagtttatttttgtataaggtgagtgataggagtttagtttcattcttctgcatatggatatccaatttttccagaagcatgtattggagattgtgtcctttccccaatgtaggttgttgacaaaactaaagacaaagtcttaaaggcagccagatagaaacagtcacctataggtgaaacatcacctatagaggaaaaccaatgtaaatgaaaatacgttttttcgtctgaaacaatggaggtcagaaacaagttacacaatatttttcaggtagtgaaagaaaagagctgccaactctgaatgctacagatgttgtaactatgcttctggagtaaaggaaaattatattttttgaactgtttaaaaagttgttgttagcaagcttaccattaaatgtttactaaaactgttattcaaacaaaataaagaaaaaaaaggaattttgaacatcaagaaagaaggaagatatattaatagaattagcagaaatatgaatacatccaatagatgtgttttcctagtgagtattataaatcatagttgatgatagaaacaaaaattataactccacttgatactaaaggaagtgatacttaaaagtatagaagataaaggaaaataaatataagctgagcttccttgctttaatcaaaagtgtaaaaccattggtatttatatattgttttataaatcggatattaaatcaggtattaaaatatgaagagtagcataaaaagtatatacaaatttccaaagcaaagattgtatattgtagatgtattcaaacattgtaagtaaagcaacatgaaagctcgagtagcacacagtaagtccaaaaaaaaaggaaaactgaaaaatgagaacaaaacaaatgaatatgtagtaaataataaaatgaaatgcttaggtgttagtacattaataattacattaaatataagtgacataaatacaccaatcaaaagagaaattagctgaataaattaaaaaatgcaaccttaactattgctatagtaagaaatacactttaattcaatagtatcagtatgttgaaagtaaaataatataaaaatacataccatggaaatatttatcaataaaagggcaaaagtggctatattaatatctgataatctagaagttagattcaaaaaatcttacaaagaacattactaacaacagaggaggcagttagaggctggctaggcagatagagaggaagggtcttgggagaaagacagcacccatgggaatgcacctgcactacctttgtggtgtagctagaatgtggaaatgtggttaacaacttcctcttataccaagatgtctctcagaagggactgtcccaattatgtttcaataaatcaactaaatgtccttaacttgacccagagctaattgtaatatcattagcattgcagttttggtgcccccatgaattttgcttaggcacttatgactaataatcaagatggagtcactgctgccaaacctaggtatgcacagacagaacactcccagcagggaattttaccccttccattaaggcaggacccacaaaggacttccttgtttctgtcacataaagggatcagaactcagccccatttctggcaacccttgtttgggtccactcttgctgctgagagcttttctgttgcttaatgaatgttaatttgccttactcactctctggtatttgtgtgccttattctcttggttgtgggacaagatcttggacctcactaaattaaggagtgaggagactgcaacactaataataaatggatcaattcaccagtaaacataacaattccaaatatatatgcaccaaataacaaagtcttaaacaacatgaagagaaaaattatagaactaaaaaataataaattatagttgtgggttttaacagccttatctcagcaattgatagaattattggacaaaaatttgacaatcagcaagcatgtagaagatctgtacagcacaatcaaccaacaagattttattcacacacacaaactcacacacacacacacacagacacacatatacagataaatatatgtcaattatatatatatctctctctaaatatagaatcagtccacaaaaaacagcagaatatacagtttttcaggagctcatgaaatattaactaaaatactagatgatttcttgcaccataaaacaaaccctgatacatttaaaagaatttatgtcatatagagtatgttctctgaccatagtggaattaaaataaaagtcagtaacagaaagagagcaggaaaatgtttaaatgcatttcaattatgcaacacagttccaaatgatctatggattaaatataaagtcttaaataaaaatctaaaaatatatttcaacaaatgaaagaaaatacaacatatcaaaatataggaaatacagctaaggctgtggtgggaaagaaatttatagtactaaatgcttcattaaaaataagaaaagatctcaaatcaataacttacacttgtatctcaagaaactagaaaaagaacagagtaaactgaaagcaggcagaagaagaaaaataatcatcacaataacaaaaattcatgaaattgaaaacagaaaaaaatgtgaaacaaaaagctggtttattgaaaaaatcaatcaattgataaacatctatcaaaaccgacaaaaataaatagagatgacacaaaacacaacagcaaattttttaaaaaatgcaaatgatccaattaggtaatggacaaaagacatcaatggacgttttaacaagaaaaatattcagatgtcaaataatccatgaaacatgttcaatattattaatcatcatggacatgtcaaataaaaccatagtgagatatttctacacacctatcaaaatgacttttaaaaattgtgacaatagcaaaagctattcaggatgtaaaaaatacgatcactcataagttgctagtggaaaagtaaaataatagagccactctgaaaaatagctgacagttttttaaaaagacagatatgttattcattctttccacattttttttctgtgtgtgctgattaaccttctctacctcctctccaatgccccagtatccttactagcttctgtgggcactcagtgtacccataaaattttaagaaaataattaaaaattttttaaagtaaaataaaaaccagatatgcatagaccatagatcccagcaattgcagttgtgggtgtttaatttggagtgatgaaactgtggtcccacaaaaacttgttcacgaatgtctacaacagcttaatttgttacagttgaaaaggtcaataagcccaggtgaatgtttaatttgtggtgaatttataccagaaaccatgaaatactactcagtcatcaaaggaacaaaatattaattaatgcaatcatttggatgtatttttaggaaattttgtcgagtgaataaaagtcaattatatacattatgtacaacagtacaagtaggccttgagacctacgggatcattctgtgttgcagcaaggccctgcctgcctcaccagatgtggtgagcctatcctatctcactcggaggggtccaaaatcggatctgaacgggagtctggagaacacagcaggcatcttgaagctccacctccctccgtggaagtcggctcaaggaggtcctgaggacaggactcctaggggtttggccctgggacaggacaagacacccgcggccccctctcccacgccgccccaaactggaccccggatccagccgccgccgtggcggcaggaggaacctcgctgccgccgcgcggcggtggcggtatttaaaggggacgcagccatactgccaggagcggagcgcgagtcggctcagccaatgcgcatgcgcgaggcgggagcggtttctcccgtcacagtggttcccatggttgtcttagaaaccagtccccgaggcttggcaaagcaggagccctctgtggcagtgcttgggtgtcggggctctgaggatccggcctcacctctccacggggtcgacgggaacgtctccggatgccaggagtcgcaaagggccgaccacgatgaggaaaccccaggctgggacgggggaagcagcacgggatcccagcctcaggcctgcccggacggtgttggttggggtgagtctccccaaaagtcgtgccgccatccgtgatctcgaggacaggtcggcctgcgtgcccctgggctgctctctcacccgagggtcgttctcgtcgtgagcagaaccccgcagcctcaggggttgcctggtggtgtgtgtttcaatgcctctgctgtatgacgctgtgtgtgtgtctctgtgtgtgtgtgtgtgtgtgtgtgagtgtgtgtgtgtgtgtctgtgtgtgtgtctcccagtctctcttctctctctgtctctcagtctctgtgtgtttctttccctctctctgtgggtttgtgtgtgtatgcccgtgtgcgtgtgtgtctttggccgaatgtgccctgtgcgccacaaagcggtttgtcgcatggcggcctgtctttggtgagcctctttctgcgtctctacctgggtcatgaggccggctgtcaatcgttttcgccgcggcggatccgctttgggtgcctgaaagcctggcccacgtgaggagatgcgtcgctcccggagcaactgaaatctcatccccatcctgagtggcctcttttctaggatcaagatgagtacactgcagccgagaacaagagccccagaggaactctttgtcccacaggagagcagcggatccacgccagagaagatgcttgtatcttttcacggctcttctctgagaaatgaagccacaccacgatacagtcagcaagaggaagccgggaatgggagatggcaacagtccctgtcactggaacgctggcctccctggacaagccaccctttaggaaccccaccccttatgtctgtggcggtggcacggtgctgtatcctgcctgggctctggcctctactctctcctccctctggctctgcctcccctgtttctcaggggcctggatgcctctcgctctggccaaatgccttcaaaaaagatgacttcccagtccgtcagggagacacttcctggagatccgtgtcatgatcgtttctctctccaaacgtgtttctgcttaattgggcaggtatcatgagccgagagctcttggcttccatacgtgtctcaggcagggaagcttccttcttccccacgtttcccctcatgggtgggtggattgcctagaatgagcgctaggcgaccgtgactggccttgacttccaggacaggtggtgtcccatttcctttgcacttcctgtctcattcttgagggacatcctctcctctgctcctgggtggcctgactcccttgatcttctggacgaaacaaatgtcaggaaaccaaagggactgggctggggctggggctggggatggggctggggctgggtgcagccgaagttgcgtcagggctaccagggcgatggaggcttgggggtggggcaatttttgccaaaacctctttgctcctctggtaggcatgtgaaaacgtggcttgggtcaggcacagccccccatctcgacccgcaccccccgagccccaggtgttcttcgactttccttggcattgatggaaaggtcactcgtttcccccttccaccagcacatgcctggacaccaccctttgtttcgccgtcgccccgtatgcctccggcgacacacatccacaccatctgctgtggggtaggccagtgccacgcgtggtcacacggtctccacctcggattcgcccctgttcctggtggcacgtgtcctgtaaagcgcggtcggctttccggagcccctgggcttttagaagcggggcaagccactgatatttcaaaggaggtgggaggcagagggctgatggatcagtgaatttgcagctgacgctaggccttgagacctatgggatcattgtgtgctgcagcgaggccctgccggcctctccagatgtggtgagcccatcctatctcagtgggagggggccagaatcggatctcaacgggagtccggagaacacagcaggcgtcctgaagctccccctccctcggtggaagtcggctcaagcagatcctgaggacaggacccctgggggtttgggcctgggacaggacgagacacccgcggccccctctcccacgccgccccaaacaggacccaggatccagccgccgccgcggcggcagcgatatttaaaggggacgcagcctatctgtcaggagcggagcgcgagtcggctcagccaatgcgcatgcgcgaggcgcgagcggtttctcccgtcacagtggttcccacggttgtcttagaaaccagaccccgaggcttggcagagcaggagccctcggtggcagtgcttgggtgtcgaggctctgaggctccggcctcacctctccacggggtcgaagggaacgtctccggatgccaggagtcgcaaagggccgaccatgatgatgaaaccccaggcagagacgggggaagcagcacgggatcccagcctcaggcctgcacggacggtgttggttggggtgagtctccctaaaagtcgtgccgccgtccgtgatctcgaggacgggtcggcctgcgtgcccctgggctgctctctcacccgagggtcgttctcctccagagcagaaccccgcagcctcaggggttgcctgggggtgtgtgtttcaatgcctctgctgtatgactctgcgtgtgtgtgtgtgtgtctcccattctctcttctctctctgtctctcagtctctgtgtgtttctttcccactctctgtgggtttgtgccagccgaagttgcgtcagggctaccaggtcggtggaggattgggggtgttgcgaattttgcagaaacctctttgctcctccggtagacatttgaaaacgtggcttgggtcaggcacaggcggccccccacccccgggtcccaggtgttctttgattttccttggcattgatggaaaggtcacccgtttcccccttccactggcacatgcctggaccccaccctttgtttcgccgtcgccccgtatgcctccggtgagacgcattcacaccaactgctgtgggattggccagtgccacgcgtggtcacatggtctccccctcggattcgcctgttttcctctttgcaggtgtggtgtaaagcgtggtcggctttctggaaccccagggcctttagcagtggggcaggccactgctctttcaaaggaggagggaggcagagggctgatggatcagtgaattttcagctgtctctaggccttgagaattatgagatcattctgtgctgcagcgaggccctgccggcctcaccagtttttgtgagcccatcctatctcactcggagggggccaaaatcggatctcaacgggagtccggagaacacagcaggagtcctgaagctccccctccatccctccatcggtggaagtgggctcaagcaggtcctgaggacaggacccctgggggtttgggcctgggaaaggacgagactcctgcggccccctctcccacgccaccccaaacaggacccaggatccagctgccgccatggcggcagcaggagcatcgcggccgccaggcgacagtggcgatatttaaaggggacgtagcctgactgccaggagctgagcgcgagtcgtcccagccaatgcgcatgcgcgaggctctagtggcttctcccttcacagtggttccttcggttgtcttagaaaccagtccccgaggcttggcaaagcaggagccctccgtggcagtgcttgggtgtcggggctgtgaggctccggcctgacctctccacggggtcgacgtgaacgtctccggattccaggagtcacaaagggccgaccaggatgaggaagccccaggggggtacggcggaagcagcacaggatcccagcctcaggcctgcccggatggtgttggttgggtgggtctccccaaaagtcgtgccgccatccgagatctcgaggacaggtcggcctgcgtgaccctgggctgctctctcacccgagggtcgttcttgtcgtgaggagtactccgcagcctcagggattgcctggtggtgtgtgtttcaattcctctgctgtatgactctgtgtgtgtgtgtatgtgtgtgtctcccattctctcttctctctccctctctcagtctctgtgtgcttctttccctctctctgtgggtttgtgtgtgcatgcccgtgtgcgtgtgtgtttttggctggaggtgccctgtgtgccacaaagcggtttttcgcatggcggcctgtctttgttgagcctctttctgctctctgcctgggtcatgaggccggttgtcaatcgtttttgctgctgtggatccgctttggctctgtgaaggcctggcccacgtgaggagatgcgtcggagcaattgaagtctcatccccatcctgagcggcctcttttctagcatcaaaacgaacacactgcagacgaggagaagaatcccacaggagctctttgtcctacaggagagcagcggacccacgtcagagaagatgcttgagtcttttcacggctcttctctgagaaatgaagccacaccacgatacagtcagcaagaggaaaccgggaatgagagatggcaacaatccctgtccctagaacgctggcctccctggacaagccacccttttggaaccccaccccttatgcccttggcggtggcacggtgctgtatcctgcctgggctccggcctctgctctgtcctccgtcttgctctgcctcccctgtttctcaggggcctggatgcctctagctctggccaaatgccttcaacaaagatggcttcccagtccgtcagggagacatttcttcgagatccgtgtcgtgattgtttctctctccaaacctgtttctgcttgattgggctggtctcatgacccgggaactcttggcttccttaggtgtctcaggcagggaagcttccttcttctccacgtttcccctcatgggtggttggattgcctagaatgagcgctaggcgaacgtgactggccttgacttccaggacaggtggtgtcgcatttcctctgcacttcctgtctcattcttgagggacatcctctcctctgctcctgggtgaactgaagcccttgatcatctggcagaaaagaatgtcagggaacccaagggactggtctagggttgggggctggtcctggggctcggtgcagccaaagttgtgtcagggctgccagggccttggacggtttggggtggggcgaattttgcagaaacctctatgctcctctggtaggcatttgaaaacgtagcttgggtccggcacaggccccccctccccacaccccgcgtgtcccacgtgtttttcgattttccttggtattgatggaaaggtcacccgtttcccccttccaccggcatgttcctggacaccaccctttgtttcgccgtctccccgtatgcctccagtgacacgcattaacaccaactgctgtgggataggccagtgccacgcgtagtcatatggtctccgcctcggatttgcccctgttcctctttgcaggtgtcctgtaaagcactgtcggctttccggagccccagggcttttagaagcagggcaggccactgctctttctaaggaggagggcattgaaaaacacacccccaagcaatccctgaggctgtgatgttctgctctctacgagaaggaccctcgggtgagagagcagcccaggggcatgcaggctgacctgtcgtagagatcactgacggaggcatgacttttggggagactcaccccaaccaacaccgtccggtcaggcctgaggctgggatcccgtgctgcttcccccgtctccgctgggctttcctcatggtagtcggccttttgcgactcctggcatctggggacattcccgttgaccccaagaagacgttaggccggagcctcagagccccgaaacccaagtactgccacggagggctccttcttcgccaagcctcggtgactggtttctaagacaaccgtgggaaccactgtgactggagaagccgctcccgcctcgcgcatgtgcattggctgagccgactcgcgctccgctcctggcagtcaggctgggtcccctttaaatactgccacatctgagcgtggcagcagcgaggctcctgctagccccgcggcggcggctagatccggggtccagtttggggcggcgtgggagagggggccgtgggtgtcttctcctgtcccagggccaaaccccgaggagtcctcacctcaggacctgcttgagccgacttccactgagggagggggagcttcaggacgcctgctgtgttctccgtcctcctgttcagatccaattttggcccccttcgagtgaaataggatgggctcaccacatctggtgaggcaggcagggcctcgctgcagtgcagaatgatcccataggtctcaaggcctagtgtcagctgcaaattcacttatccatcagccctctgcctccctcctcctttgaaagagcagtggcctgccccgcttctaaaagccctggggttccggaaagcccaccgcgctttacaggacacctgcatagaggaacaggggcgaatccgaggtggagaccatgtgaccacgcgtggcactggcctatcccacagcagttggtgttaatgtgtgtcaccggaggcatacggggcgacggcgaaacaaagggtggtgtccaggcatgtgccggttgaatggggaaacagttgacctttccatcaatgccagggaaaatcgaagaacacctaggacccggggggtgggggtcctgtgcctgacccaagccacgttttcacatgcctaccagaggagcaaagaggtttctgcaaaattcgccccacccccaaccctccaccgccctggtagccctgacgcaacttaggctgcgcccagccacagccccagccccagccccagccccagcccagtccctttggttcccttacattcgtttcagccagaagatcaagggagtcagtccacccaggagcagaggagaggatgtccctcatgaatgagacaggaagtgcagaggaaatgcgacactacctttcctggaagacaaggccagtcatggtcgcctagcgctcattctaggcaatccacccaccatgaggggaaacgtggagaagaaggaagcttccctgcctgagacacgaatggaagccaggagctcccaggtcatgcgacctgcccaatcaagcagaaacaggtttggagagagaaacaatcacgacacggatctcgaagaaatgtctccctgacggactgggaagtcatctttgttgaagacattgggcgtcagcgagaggcattgaggcacttgagaaacaggtgaggcagagcaggagggaggacagggcagacgccggcggccaggcgggatatatcaccgttccactgccagggtcataagggatggggttccaaaagggtggcttgtccagagaggccagcattccagtgacagggactgttgccatctcccattcccggcttcctcttccagaccgtattgtggtgtggcttcatttctcagagaagagccgtgaaaagatacaagcatcttctctgacgtgggtccgctggtctccggcgggacaaagagctcctgtggggctcgtgtcctcgtctgcagtgtgttcatcttgatcctagaaaagagaccgctcaggatggggatatttcaattgctccgggaccgaagaatctcctcacgtgggccaggccttcacacacccaaagcggaaacgcgtcggcgaaaaggattgacaaccggtctcatgacccaggcagagaggcagaaacaggctcaccaaagacaggccgccatgcgagaaacagctttgtggtgcacagggcacattcggccaaggacacacacgcacacgggcacacacacacaaactgacagagagagggaaagaaacacacagagactgagagacagagagagaagagagaatgggagacacacacacacatacacacacagacacacacacagagtcttatagcaaaggcattgaaagacacacacccaggcaacccctgaggctgtggggttctgctttcgacgagaacgacccttcggtgagagagcaccccaggggcacgcaggccgtcctgtcctcgagatcaccgcgtcacgacttttggggagactcacccccaccaacaccgtccagagaggcctgagggagggattccatgctgccttctccggactctgcgtcgggtttcctcaccctgttcggccctttgtgactcttggcatccggagactttcccctcgacccagtggagccgtcaggccggagcctcagagccttgacacccaagcactgccacggaagtctccccctttgccaagcctcggggactggtttctaagacaaccgtgggaaccactgtgacgggagaaaccgcttgtgcttcgcgcatgcgcattggctgggccgactcgttctcccctcctggcagtcaggctgcgtcccctttaaagaacgccaccgctgagaactgaccctcacatctcccttcctgaatttctttagggaaagcaacaaccatccctgtaagccatgggttttcatgcggaggaaggagagggctagttgtctgagagggtaactgcttaaggctgcagactaggaaatgggattccaggtttaagatagctcctttctggacctcagtccttcacctagtcacctagtcacagggtggattgcctctaaggatacttaggggaaaaggaactaaatttgggatggttctccttgctttaagccttgataggagacggggaggccaacccttctctgcagaccgtgatcctcactagacagaggagctccaaacctgcccatctcatcccatgcaccgacggtgcctggcctggctccaaactcccgaaaggaactattttacaggtgccaaaaaggggacagtgttgataataataataaaatgaaacaatctgattggggcattgctggatcagaaaatgtgtgacctttttaaagttaaattgttaaaaaattttaactattaaacattttaaatattaagcctgatctgtttggtagccctggagcagggctgaggcgtagagagaaacctttccttcagccaggttgtctgtgtcacactgatttatttttattttatttgtggatttcttaatggacccaacggtggttcctctttgcatccctcgggttgacaggcaattccatcctagcccagttctcagctctggtttagttttcataacttttgggggtccagggagccatgagactggagatagaaagcagaagtgcactggggcggtgggtctgccttggcttacccccaaatttctggattccaggtgccttgctccagtccctgccccatcctagactcaggatgctctcccacgctactaaccactggtccggtcaaagcccaagctgctgccagccaccatgttatctcctagcctggctagggtgcctgctagccagcagtggctatggtggtgtgcagagtgagggtgagtttttgtattgactgccattccgtttacctcaagaagtatgtttgggcaaccattctgtgccaggcagcagacagagtccctgcactgcaggaattcctagtcctgtgggcaggggtgtgtggaggatggcacatggtggttagcctggtccaggggtctccactcccttcctagcatcctagagatcctggaggctaggttggccacagagactgagttcaggacaattccttcacgcagttaatgaagttatctgtaacttcctggttaaaacacacacacacacacacacacacacacacacacacacacacacaaacacaaaaactggcagtcgtgggaggtatttccccactgggctggttggtagcaggggaagaactgtggacccctcgccgagtggcgcctggaaggaggctgacgtaagagtggtgtagctgtgagtaggagaagtgagatctagtggggtaagtccatgttccctgttcctaaagtcaaattctccctgaaaagacccagggcagcactgttagggagctgaaggagtccctctgtacccagagggaattaggccactcaggcctcagagaaggagggcgggtggtgaggacaacctccccaagcccccatcagagcaggcccaatacttggaaattcactcctcagtccaccagattctggtcccatcctacatccccaccagggcacaggaggcccacataaaaacaagctttatttggccaaattaactcactttcctggattaccttacttgttggaaagcgaaagtacaccccacgctcctcgccctgtccctgcctaaacctctttatctctgaagcccactctttgagacctaaaaattagggttcaagagaaacgctctaggactacaggagtgacacgacagtccctatcctacagtgcactaaaagccaaactgaagtctgcttcctcggtggagagtgtctcagggtgaggtggcaggactgttagccgcttctcattttacaagctccttgtccacagtcatctgcaccagcccctcacaaaactggttctcgccttctggtgggtgctggtgtttacccctttcctcccactatctgttcaaaccgagcccacccaccctccattcacctcccctccttaaggctccctgagctctatttacccttttgtaactccatccctccataagtacacaactcttctagctggtttcctagagggtagatacagtgtttccagttggccctctgcagatatctgtgaataagtctctcccagcccctacatataaatgtgtctgttctagagagacgggcctaagtcccaacgtaaacacatcactagataattacaccttatatacatacagatctctctatagagttatatttgaaagtgtctataactctagagagagattgcagcatgcacatataggactataattacttatgtctatttttataactatgcagttataaatagatatgcctatatatagtgataataatatagaaatatctccatagccatatatggctctaagtgaatgctctaactactctatttcgcaatcaataagtatatatctcctgatacataattctaacaatatacgttttaatctatatagctcttcagagatataaatctgtcaggatatcaaatgtacataaagccggatggctgtaagggagtcgcatattttcccatatataaatctgctcctataactactgtatatgcacaaatacaatggaaataattatatttccctcaaacgtaaatctgtaaatacaaccacagcacatttaggtaccattagacatagagcaatatttcctagacatcagtctgtcagtagagccaccagtgcctccaaacagagagttatagagggagttataaataaactctccagatgtgaacggatcagtagaactagatgtaaacatgactccaagccgttcctcctccttcttcttctttgtaagatattcctgaagcaagcccagtcatataacagggtgcagaggtgtctgggtactggtatttttttccccaaggagggtcggaggtcgctggactttgggaaactgtgcaggagtgggtaggggacaatgcccgctcccaacacagcccagaagccccttccgtctgtctcctggtggctgagagctcgggcaagtggagaggcctaagggagaaaaatgaaaaagcagagtctggcttgagtcgttcggcccttcggcctaaaaccctctcaacagggaagccccgaacaggcgtcggagcggagagagcccacgaggcccagaggctgggggaaaggggctgcaggccgggctgcggaggccgagcagagtcgccagccggtgcctgaccgcccggcgccccatctcccggggccgctgcctcgccggcagcctggaacacaaaacctgggccctagccctgcgccctgtgctcagcacttccactggtcttattttattgctgttttgtccaattaggtatcgcagcgtcctccacccggtgttgttttcaaatgcgagggcacccagggctttctgaatgcgtgtgtgtgtgtgtgtgtgtgtgtgtgctggctttaaataagtgactcagtggatagtgtatttctcttttcagaccaaatgggtcaccggctactgaaaaagaatccagacctctgaaagggttcgtgacaaattttttagaagttctcacgctcatctgttacgatgattttcttttcttttttctgttttaaaaaagttggctaatttgtgtttctatattcctctttaattttatttttattgggggtacaaatgtttttaaaggagggatttcgttagacccgaaactgtggggtggcttcctctctagcaaacttactatctctacgcctgtgattcccatctcccccaagaaaacaaacgaattaaatgaccagaaaactgtacctggagaaaatgaggtatatgttgcaggatccgggaccgcggcccttgcttgcttcatgaaaaatcggctggtctccaaactcgcgaaggaaaattcaaggcgcctcaactcctccttttaaattttttaataaagagcctagaaagggaactttccctgggcctgccggagccccagcctggctctcccaacttcccagcggccataagtgtttttctgcttccattcgggccccccgtcttcccgggcatctctgagctcctgccggatcaaggctgtggtcatcacctcattcatctctgctgcttggcctgagcctgcacatttggcctccttcttaaaacaggggctcctagagagtcccaaaatccattaaccattcccatatgtgggatcccttccctgatcacacaaagcagaagcctgagaaaaaaagcaataaagagtggcctcctggctctccttctcctcttccatcccttgtctgggaaaggggttcccaaccccagccccaccaagagcatattaagaagctttcttcctcccttcctttcctatctccccctcagatgctgtgatcctgactccttctgtctccacctcaaaatatttcctcttgcattttattgttattctgttatgcagggactgttaactactgttttattattattattcattatttattgttattaagattgtcgttagagatttgttcaccaccgttcaagggacagcagcctggcccagggggaagcctgcctctccctgtctgtctctctctcacacacacacacacacacacacacatacacacacacaccctaacacagtgcacactcacgcatatatgctcacaaatgcctgctgtgttcaggcccctgcacagcaatccgaagaggcaggcatcctaccccagcacgcaaacaacacactgcccacgcacaccagcattcaggcagaacaccacccccagaccaacgccaaaacccacacgcaccgagcttgcaaggaaaggaaaatacataaagaatcccttctctccaaaacctggaggggcgagtcaggcctctgtctcttccccccagtcgctttcgctttctcttttttttttctccttgtttacagcttcagagagctcaaggcccataaatcttgaggggtctacagagcgcagagcacatttgtatgcatcgttaggactcactaatacattactaagcccattaaggagagtgtatgcgcatggtttccggtgtgtattaacttatagttaaattctggaggaaagggcattgtgaattaacatataccaaatccatcatgggcttttgtcatatcagattagtcagtcatgggtttgggggagtaacttgcctgggtcggggtgtacccacccttcaaactttgtggagcaggcccgggggtcttgggaaacacgaaggcattcctatccagccccagtcattcggatcccccaggcctagcggctgcacacttgtgagatggcggagggactgcagacccaggtgcgggaggccagtgctagcgaagagaggtgggcaagggaggcccctccagcgtcctgctggggttgagttggggtgactcgtcccgtggccgctgggtcgtctggtttcccctttccgaaagaaatgagaggagaggcaagtggagtagctgaactttgattaaaccgtagagaagacagtgggaggagggaaaaaaaaaagatcggagaaggaggaggaggtggccgagagatcgaggaaaggaagtcctagaagctccggggaatttggaaatctctccaaggggctgaaagctggaagttgtatgaaggtgttcttttctcacaccccagctactccgccccagtcgaagaggctaattccgggcctcttataaaaataagaaagaaaaggtaaagaaaaagaaaatctaattatgtggcatgtttcagccaggtgttcctggttccaatgactcagaccctattggagccccgaggatctggataattgggcctgcctagacagagatgaaggatgccatttctaaaaggaggaaggggagaggaaagtccatctcttggggtcttgtagaaaatgccaaagaccaaccaagctaaattattgtgtccctgtagatctatttgcctatttacgtacagcaggctgtgggggtggggggtgagggaaggccgggaataaacgaccaggatggagcgggctggcaggagagaaaatgcgccccccactctttgcgggaacagccaacgggcctcctcagctcgcagctcaagcggccgcgcggcgggcctgtccggggccgggggccggggccggcctgggggaggggaggcgggggcgggaggggaggcggaggcgggccctccccgggcgctgtgaactttagctgggccgccgcctgtcagcgccagaaagcgttaaaggtgcagcagcccgcgccagcctccgcagccgcctttgtacgagtgatttatgacttcagtcttggttcaccaagagttcacacggctttcgctgctgttgaaggttaaaagatggtcttcgcttgacaagttggactattgaaaattccttcttcttcttcttttttttttattttagaagcgaagagcagaggctcaggagagaaaaacattggggagggggcgggggacaggggttgcaggtgggccaaaatggtaagtcaggaaggtttgtcttcctatatttaggattttttgttgttaggatttgcgtgcgtgttggggagagggtagagaataagagggagctaggcaagagatgtaaagatctctcatatttagaggccaaaggagtgaaaaaaaaacttgcttccacagttaattatctgggtaacttgggtcacaccccctaactgatcctcctctagagaccggaaatgggccaggtaagggagagagtttgggtaaagggtaaggtttgtgtgcttctcactgggtgtacttgatcatccaccttacctgggtaactactttttttttttttttttttttttttttggaaatggggtccagctctgtttcccaggctggagtgttgtggcaccatcatagttcactgaagcctcaaactcctgggctcaagtagtcctcccaccttagcctcttaagtatgtgagactgcaggcatgtgccacaccgccaggctgggtagctgcctttcaatgtgcttctgcacccacagatttggaaaagggcatttttaggcagcagtctttcaactctcttcatcctgtaggtttagcctgccatttacatttgatgcacatgaagaggctaatgggaaggaaatctatagaactggaattggaagtcctttcaaatcccaaattcccttggtctaagagccagtctctcttctttctagcattttgacaatggtcgtgccacagcagaggtggtggtcaaagatctcccaaagaccaggatctaaggcccctttgtgatctaaggctctgagtacttggagagacaaaactcactccttctttgtagattcagagagacagagagagagagagagagagagagagagagagagagggaatgaggagataccttgaagctgagggtctgcttggcttttcgaggttttttttttaagatatgtttttaaaaaattttctggagtgggaattgggattgtgtgcactgggaaggggaacagcagagagctgggtctggagttgggtgtgcctccctagccctattaaggccccatctccattaccaatgctaggtaaatgtcttcttaagagatagagccagcccctcaaatccagatctgggaaccaaaggcatccacgctagaaggggcactccctgcttctctttctacatagcattagagaggtattttcccaccatgtgaggacttagataagagaaggagaagagccagaaagatgtccacatctcgccgggacacctagcaccaggccctcctacaggggacctcatatgtaaatagcagaatggggagcaggacccatttaccgggcagtgatactcttctattagctctagagggtctcaactttcgctgcacattggaacccccagcgagtttttttgtttgctcatttttgtttttgagatggtgtcttgctcttgtcacccaggatagagtgcggtggcacatctcggctcactacaacctctgcctcctgggttcaagcaattatccctgcctcagcctcccgagtagctgggattacaggtgcttgccaccatgcccagctaatttttgtatttttaatagagacggggtttcaccatgtttgccaggcttgtgtcaaactcctcacctcaggtaatccgcccacctcggcctcccaacgtgctgggattacaggtgtgagccaccatgcccagccacaagttttttaaaatactgatgcctgggtcccacctccagagattccaatttggttggcctgtagtagggcctgggcatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcagttcccacctatgagtgagaatatgcagtgtttggttttttgttcttgcgatagtttactgagaatgatgatttccaatttcatccatgtccctacaaaggacacgaactcatcattttttatggctgcatagtattccatggtgtatatgagggatctagaactagaaataccatttgacccagccatcccattactgggtatatacccaaatgactataaatcatgctgctataaagacacatgcacacaaatgtttattgcggcattattcacaatagcaaagacttggaaccaacccaaatgtccaacaatgatagactggattaagaaaatgtggcacatatacaccatggcatctggatttttaaaactccccaggttgctaatgtgtagccagaggttgagatgcaggccctaggaaatgatacaagagataaggggaaggctgacacttctgccagagcaagagaggggagggatactcagctgagagctgcttctcaaccttggacatcccctcaccacaggcactgcttcagtccgggaggttttcacttagaattagcttctcttgagatcccagaatttcagagactctcacccttttcatttcctatagctattagaatttacaaaggggccacccccagaggagacagaggaattgacaaattgacctctaagaggctcatctcttatcagaaaagcatatggtccccagatcaccagtgatagaagcagaggcagatacctctagtagttggaaaatttgtagttacatagtaaatgcagtttctacctggttgctacaataataggccaagcgattaggatacaagtttccaggatcttttcctatatttccaaaaagataaatcacccctaggaacagaatctgcatattgtaattaactgataaatatttcatgcctggctcaaactttctcctcttctatttaatggccacaaacttgagcacagaggaaacagcagtgaggagagtggcggttggctgtaggggggaggttctaccttggcttcagggagggagaaactgtcttggttaattatttactgtcctcctgttcttttaagaaaacattgctcacctggagaaaatcaggtcccaggtggtaaagggtgtgacttgggcttgttggcctcagccctgacctcccccaggagaggccaggttttggtgaccctgggggtgctgggaactgcaggctttggagtcaagggcccagtgtttaaacaagagctctgttctgtcacttattaactggatagctttaggtaatttacgtaatttatgtgaaactcagtttcttcatctgtaaaacagacataatttttaccttgtagggtggcctatgctcagttggctctcaatgcatgataactattattatcaacagtaacaatgaataattaatagcccattggattgtactctttccctttctcaaccctgctccaatgtgtagggcacctaaactactgaatgcttactgtgagtatggtgaatgccttagctcagttaatcaacataattctttgaagggaatgtcttatcatccctacttatctgtgttttgcaaatgagggaacagggcatgcagaagttaaataccctgccaggtgtcacacaactaagtggttaagagcacaggctctgcagtctgactgtgtagtttcaaatttgggctctgccgcttaataatagactctccttgacttacgatgaggctgtgtcccgataaagctgtagcaagctgaaaatattgtaaggtggatatgcatttcatacacctaacccaccaaacatcatagttcagcctcgcttaccttaaagtgctcaggacacattcatcagcctacagttgggcaagatcatctagcacaaagcctattttataataaagtgttgaatagctcatgtattcaacatgagatatttattcatctcatgtattcaacatgagattcaacatgttataatgtactgtactgaaagtgaaaaacagagctgttgtatgagtattagaagtacagtatctaatgaatgcatatcacttcggcatcatcataaagctgagaaattgtaagtcaaagcatcataagtcgaggaccgtctgtgatcactgcaggatggaacataaactgcttaacctcgctaagcctcagtttcttcatctgtaagttggggatatgaatggtacctacctgaaaggtagttgtgagaattaagtgagaaatgcgtgtatagtgcctgtctcagtactggcatgtggtaagtgcctagtaaatgtgagttgtcagtaccatcatcatactacccagcaactcagtgccatggcgtctcctgctctttggtggtgtttgggaggtgagtgagtgtgacggtcctccaaaggtcacagagctgctcttttaactccccctgacagacacacacacttcagtatctaggactcgggagaaaggacactaagcagattatgactccatttcaggaattaaatcaaaactcaagactatctcaatttggcttctgactagagggaaaggttaaaagggagtgaggaggcggctgggtgtgcgttcagaattgcaattggttctggatcccacctcccagcccctccacagggccaggcccaaggagtatcccccaggggtggaggagtgaaggagccttagaacctgtgttatctgaatgtgggtgaggtggggagaacgtggtcaaggagttgggaaattatccagaaacattttccaaagggagatcttcccgcataccacctcagcctggctctggattgcaggggaaccccagaacggatggggtctgggggcttaagacaggtaggtggcctcagtagaggggagaaacagtcctgctggagacagtcgcctccctggagaagtacctgggctagtgttctctttaaagacgtctaagcagtcctggtatgctaaaaacattatgtgtatgtgtataaacatatattctgtgtgtgagtagccactcagctcttacttggcttcgcacatttggcccagattattctgagcattgtaaactaaaagtgaaattcggtttctacttgagagagcgtgattttcctcagtattatctcccgtgcccccaacactccaccaggctttaaaggccattatacagaagggagaactgagactccaggagatgggtggcttgttcagaatcacagaagcagcgtggatccaagaagggatctgttcccaaacagaaaccagtgtcttgggagagagagagcagaggaagcccgcacctctgccctaacctgaggctttgagcctcccgcaaagccgagtgagttgagagcgcccagaaggcagacgctgcggagggagagactcctgggctagccaaacagcagggcctcgggcaagagcgtcacctgcgcgtcctcattctgcgattactgtcaggggaccatccatcagcgccgccctggacgctgggccagactgcccgccgcccgcaccgaccgggtctctccagatcgcattagcattagcgtggggcgagggctcagtgcggcactggctgctgagggagaggcgtggcggggaggggggcggggcggggggacggggacatcgcggtggggccattgcagggcaggggagtggctgctttaggaccctcctccttttcttccaatctcccgcctctggcatctaaggtggatgaaaggggcactggaatgggcggcttttggggggcagggggtgcagaacactgaaggcatcagggaagggtagtgatgggggcagttatcagaagcagagaggaagaaatacctgtaaaggggaaagccagagaaattgtctggggaggggagagactgaaaatgggggtgcagagattgggggttagtggaagaaaaagacttaaagggaaaggaaaagagaagctgtagagggaaaaagaataggcaaggaattgacgagagagcagggaaacaggaaaccacagatcgtcaggggctgacaaaaccttagagacaatctactgcagcccctcattctacaaatgaagaaatggaggcccagagaggggaatcccttctccaaagacccactccacctgctggctgggcaggctcttgaccgcaggctcattcattcgacccatgtgttttgagcatctgctgtgtgctgggcactggtctgccgagatgatgcaggatcagctcctgccctccagaagctacagtctttcctcaggggcttggagaggctgagcatccaggaagctccctcacccccagccaggagggactccctgagccccacctctcctggccactgaaccttccttgccctctgctgttctgcttatctcctcatggagggtggccgttccctggaagatcttccctctccactttcctggggactccccaggtgtggagacaggtactcgacagtttggccaacttgttctatctcccacagccaacagcgtaggcctaaaagcaaagtccatattccttgctgggtttcacctctgggcatggacaaatcccacaggttggactgagatccaattgagctgtggtaaggaggattgaggctggacatgaagaagtacttccaggtcccacagtgtgggatcattttcctgctggggctttaaagtagctgtccttctgtgagcacagtgttggcaccatcttccagggaaggacttgtcttcctcagtctccagttagccttgtgcgaggcattatgctgggaatgttggggttccagatacctggtctctgaccatggggtttctgctctagacatgggtgaactgacatctccctggcatcctcccagtcactgccagctctgcaacatcatggaacccctgagtccttcacaactcccagatcatctcatccttcctccttgctctgggaagaccatgtctgagtagttccaaccaacctctcaccttaaacccagtccctgataatgagaagtacctccttagtctggacttgaccttccttgctgccatggtccatcagcaatgaccagggctgaagcagcacgttttttctataaacaccgctccctcccagtgatgctcacccaatcctcggtggtcaggcagggagtggggacagcttcctgccaagagctctggaaggcagctctgcctcctctgcctgaagcaagctcctgtatactctgagatggtggtgttcattttaaagaagggaccatctttcctccacagcccagcttacatttggagggagacaaatgtgagtttccaatcccagaatcttagccactgtaccaatctccatggatgcatgggattcaggaaaggagagaaatgagcagagtgaggacatggatagaatccatttcctaccccttgttccagcccaagtcccagggaaaggcccacagagggcaagagaggtggacattgaaaattccagactaaagaccaacagacagatttcagcattattccttcttgtaggcaaagtggtacctaaggatctaaccaaatgaaaaagcctgggaaataggctatttctgcaccccctgacccttcatgcagagcaggatatcggcttcagcccaggagcaatgctagaagttgagaggtttggagtagactgtgaagcagttcctccaagggcatgccagatgagggggttggagcacccagcccagaacagcatccaaggaaggaggccttggcagtaactttctgtctctgtattaacttcacatacattttcttgtgtgatcctcagtgccaggttcagcaccaggcacagaatacatgcttgctgtacaaatgcataagtgaagagccatgggaggaaggtcaggatcctcaattacagatgaagaaacagacacacagaaaggttaaatgacttgctcaaggtcacatatctcatcagagacagggccaagtttcagtggagagccactttagtggtagagggtggtagggaggagggaggcaggaagggagggaatgaaccatcagacaccacacggggggagaggagagctgtcatctttctctttgtgaaaagagattacttcctgggaaaggtggcatttaagaccacacagttttaaaaacgacccattgaaggttgatttgagcatatgcaaagttctgccaaaaacatggagaggtcaatgagtagacggggtcattgaggatcagaaaagaaagacaacactgagagtctggacagctaagccccagaattttgctagtcttaaatgctgggtgacatcaggccttccacacccctctctgagcctctagagaatggagatgccagacgtggagaagggtacacatgggcaagaggaggcaggtcattgccttcagggtagcaattggaggcatcaagttcccacttccctagacctattctttgttgttattattgttgttgctttcatctgattttaattgttttatgttttttgaataagaaatacacgtacatggttcaaaactcaaaaggcaccaaaagttatacagtgacaagtaagtctccccggaacctcagaactcccaggccacccatgtcctcactccgttagtactgcagtaaccactgaattgtataacctccaaaggtattttctgcttctcctggcttgtaccctgaggccaccacaaaaccgagttgagcactgatattctgaggagatgtggtaaacatgttttggcccctggactggtggggccttggaatactaaatactctcactttccactctgaaaagatggagaaacttgaggtcaggagagaggacatttctgcgtgcttagaagctcagaagcctcgcaggtgagaggatggagttgggagccaggcagaggcaggaaccctctccagggctctagtaccacactcccaccccagagcctcacagtgccctctgggttagcctggctcaggtatgcacccagttaggtcctgctcaagttttccagagaaaaaggcccagtgcttcccctccaccacctgtcacattgttgggaggcctttcttgatgtctcactctagttccttcgactttaggtgtggcccatggcttttgattctgccctcagtggagatggaacatgctcttggagatgatagcttccagggacccaggctcttcctcccacttgcatacacaattttccttcaggccctctaattccacctcaatcttttttccagacttagaagacacatgcctgttctttcagctacccccccccacctgaattcccagtctgcctccattcccaaccacctcattcttgccctgcacatccctttggcattattatccccaagtattctttggtcatgatgatggtaaaatcccaacctaaagccaagtcctccaccagattccagaggtaaatccagcctagtctctttgataactgaatctctccattttgggtgatgccctagcccgactcttgaacttgtgcccaacactcggactctcagatcctcacacatggcctgttgtgagataaggcacaagttcatcccaagcctgggatggcctcccctctgttctcttctccaaaccctcccctggtgaacctcatcctttgcatttactcactaagcaattattattgagtactattccaagttcttagaatacattggtgatcaaaacagagaaagaccccccacctgtgtggagtttacattctagcagagaaagacagataatgaacaatattcttactaaataagtaaattatatcatatattagaaaatgataattgttacagaaaaggaatagatcacgtacagaaggatcagcatggaggggaaatctgaggtttttagtatggttgtcaaggagagctcactgcgaatatggtatttgaacaaagacttagaggtgagagaggaagttagccccatagacatcttggcaagagtattccaagtagagggagtggctggtgctaaggccctgaggcaggaacatgcctggcaagtctgtgggagtgagcaagagtgggaggagatggcatcagagaggtaaggagggaacagatgatgttcggcctcgtaagtcaacttaaggactttgctttttattctgagtgaagtagagaggaaagacatgattggacttcagggtcttgttttgttttgagagacagtctcactctgtcacccaagctagagtgcagtggcacaatcttgactcactacaacttctgccacccaggttcaagtgattcttatgcctcagcctcccaagtagctgggattacaggcacctgccaccatgcccagctaatttttgtagttttagtagagatggggtttcaccatcttggccaggctggtcttgaactcccgacctcgtgatccacccaccttggcctcccaaagtgctgggattacagtcatgagccactgcacctggcctggacttcagtttttaaatagtctttttgtcttttgtgttgagaatagatcacagggggccaagggaagatgcagggagacttgttgaaaggtcattgcactaatccaagtgagaaatgtgtggtttggaccaggatggcagcagtgcatgtggtgagaaaggcccaaattctggatttggtgacagtttcctcttccttggcttccatccttttgctctctttgcttcctctcttcttttctaggttgtatgttttctctcttcttgaagactgagagctctctgtgggtggggctcaatctctgttcctgggatccagggcaggaccccaggcaaaggacagacaggccccgtgctgcctgggaacaggctgacaagccacgcagcttcacagccctccccaattacagggtccctgagccaaggggaagaggctgctgtttctaaagaggatgtgatcgacagttattgaaggtgcttagctgggggctccactctagtcttaatctgagccgccctcaaggaaatcataaccagctcttaaaaacatgttgagaccaaagctggtgtgtgtgtttgagcggagcttcagacagctacttaacactgggggcctctgggcttttgattcctccacttctagcctgccatctccccccagctggctggtgcttatcagccaagacgttgtttaaatcacactcatttcctataaccatttcatttgaaatgccatcctctgctccagaaattcatctatcaccagcctaggggtatagttgaggagccttggggtgatcactccccatctctacccctggccccagtcacccctcctcccatgacccatattctcaggtttcactctataagaactacttccactcggtgtgacagggcacttagtgccagaattatttataacattgagatggcaacagggcaatggagagcagcccaacccatggacactttctctttgaaagctcgatcaatggacctagatcactgtttactacttggtgtctcggcctctgccgtgtttcctgctggctttgggggatggggaaacaggggtctggaccaggtcaaggctgtcctcagagtttatgatgcttataagccaggcctccaataaagttatgccttcactgtacctctattccttggccaggcacttccctgcctcaggtgagctctcttcttggaaatgaaccattcttcgggctttttctcaaacaggagccctctgcctcccccaggaaagctggtattatgtccctaccacagtggcagagctaggacttgagctgaggaagtcatctgatatggatcagaatggggatgtagaagattctgggagttcttccgaggaagggcttgaattggccccacccagtctggagtggaggtagagggatggatgaattcacttcttaaggactgaaaacctttttaccatcctcttcctccccagccatagccaattactagttgtcctaatttgaaggctctgttgtctggactggaggatttttacccattttccagcccctctcccggtctcatttatttgggcagtgtcacattaaaggcattgtcagacttcctagtccttcccaaaggcctgacccaactccttcccaaatggtgaagcacttctgcctccctccctttacacctgtggacctaccacactggggaactcctaggtgagtcccagagaaagcccaggtgaaagactatgagcctgtcggaagggatcagggtagaacccaagttgggacaggcaggggaggcagtcccagtctttaggggggtcaagtaattcccctttacaagccaaatgaagaaaaaaagttctaaggggagcatatgactccataaaataaaggacataattgggagtgatatctaatttatctattgaatgcctcctacgtactcttttatcacttagatggacagaatataattggtgtgctgtgcgccatcaatctcagagcctgggcttcctgtgctggctacacatattactgtcagattatgacactgtaataccaagatcaatgacattttaaacgtgctccagttatgggcaattgctgacaataaaaacagtgacaaattgatgaaacttgggcagcgattatctggtgtcaaaaataaaccataaagaatctgatttccaaacagagagaggtgcctgggacaccagcttagggaggaaaggcccagcgagaagagaacttatcctgctcacatgatcttggccactcaggaagccacctgctctggaaaactccctctaggctgacctgcaagaccccagcaggaagatggagaggtggtctttggttaaggcttgggttccccttagagagaatcgtcatcactgagactctgggaagtgtctgtgtgtgactgccaaggtgggctccacacaaactcactgagatactggtgggttgtctttcatgtcctgcccacactgaggaattagggcagactggttgagtcatagaatcacacttagccaatgttaaagctaaaagagaccttgagagtctctcttcatggagggtcaggctctgtcctccaaactgtccctcagcagagggacctggatcttccctaacttgacccaggcattatttccccaggctaatccccttccccacccattgcagggaactccaggccttcaaccagcagaactattttggcgtacattaagaaggtgggcctcctccagctcctcttttttttttttttttttttttttagatggagcctcgctctgtcgcccaggctggagtgcagtgacaaaatctccactcactgcaagctctgcctcccaggttcatgccattctcctgcctcagcctgccgagtagctgggactatagacgcccgccaccacacctggctaatttttttgtgtttttagtagagatggggttgctccatgttggtcaggctggtcttgaactcctgacctcaggtaatccacccaccttggcctcccaaagtgctgggattacaggtgtgggccaccatgcctagcctccagctccttatttttagtggattaccttaatttgtagtattcctttcatacatttttctcactttaataatcacagttttaaaatatgaatactttagtagcattgttaatactactttatataataatactttagtagtatcgctaataccactattacaaggataactactattgggaagcatttattgtgcaactactatatgtaaactctgttccaggtgtttcatgtgtattatttttcatccccagagcagccctgtgaggtgggtattgttcttcacattttagaagtgaggaaacaggcttagagtcgtagtgatgtgcctaagatgacacagctgataagcagtggagcaagaaaggagcctgagatgtggctcaacattcatcttttttccattgcccctttcacagacctttatagtcccatttatagacagggctgagggcctccctaaagaacctatagctagtcaaaggcagagctagacctaagcctagcttttctgacccttctcgtattagacctgcaccgtatgtatttttttttaaagactggtcaagtgcagtagtgagaagggggaaggagcagaacaaggagtttgatctgtaactgactgtgaacaatcaattgagataaggcactaccttcggaacacccccgacactctttccagatgcaccacaacagtcctttccccaggtcaccaccactcactcagccaggggcttcagccttggcctctaagagtcagcagggggtcacagttggctttgaaaccaagcagacaggtgtttgaatccccactctgccaccttacagctgtgtggccttaggcaggtggttgtgagaatttaaatggcataagcatataaaagcatttggcgtagagtctggcacatagtagtgctcactaaatggtagtcattaaagatacaacctgggacagtggcagctagtttaacaaaccaccacaccccatagcacctctcacctgggtgcaagttccccaggccacactgcagtagctgctcgctgagggtgtccccggatatataagaagcctctctgagggccacagaggttttttgatggcagatggtttaaaacatcatttttatattaagttgtataaaatatactacgttataaaatgcaaagtttgcatcattttagagctaaaacttaaggccacaaaagaatctgctattttcttattaataaaaaatcctatttttatataatgcaaataatgaagatgaagtaacctattatttaattaaacatgtcttttttttaaaaaaaaaaaaaaaaaagaaataattggtccttgctaatggcccttcagggcaatcccccagactgctggggtccaagtttaccctcctgcctctaataacaaagggactttggcagaaaagtttgagaaaccctgtcaggaagagagcctacacaaggaccaggaaatctgacttcttcattctttagaagaacaaaacaaatagcaacattgtgttttctaccttcctagtgttttaccttcaagtttagcattaagaacatgaaatgttttgtgtaaattcgtgattcttatttctggttcctttctgtttaataattactagctgaatcattaatcatcaaccaagtgaatggtcacactttatagaaggctacaaggtggaacacaagattagttggattcttaagaaagaaactaaaagctgcttgcgacttagatgctcttaagttttatgactgtggtgggaatttgagcatccaggccttgcttctgatggtcctctcattccagtgccccagttctaatcctctgtgggtgccctcggtagtcacagccttggggctgcccagggctcaaggcgtccatgtttttaaagtgcccaaaaacggcttttgattcatcagaaactccacaggacacccacctaactggggctctgatacctaattcagcagcacccaccaccaagtctttctaagttttattttttttaatattacatgcaatatatgttaattataaataaatgtaataattcaggtaggtgaaaaggagaaggaaaaatggcccaagtagtttccccactgaggaagaaccctggttagcgaggcaagtcacgtgactttcggaatcatgttgaatctacacccatttaaggtggaagtctatatagcctgattctttgatggtttagagctctgctcagtttagagttcagggaggtggtatctacagggtgtattgctctgataaaaattagcagcctgcccaagttcaaggtatgaggggaccgatcacagattggtttgagaatcattatgttggccctttggtgactctaaggattagatccagagtacaaggggcccacacttccaagggatcccaccacaccttcaaatagcagactcatggaaaggggattcaaagattctccccctccagctacggcattgctttacaatatttaaaattccttgactaaagagcaagtctaaattgcaagtactcctaggacagggactggcttagatccatgacagctccctctctgaaagaagggcatgccttactccaccagaccaaacaaaactaaagtgacttctctgctacccccagagaggggcactggggatggtaaaagcatttctgtccctgcacccagggatgaagtagagaaatgccacttaaccatagccaggacccaaagaattgtgagtggaaagagtgacaaaaacagagaaggacagaactgtaagccaccgcacttcatttaggaagttagtgctagggtaacaggaaggatcgggtgggctttcaggggagtggaacctgttagagaaagaacaaaactgagtggagacgcaaggcaggagaccatttataggtgaattagcagcagagggtgggtggtggctgtgcctggggcaggggtggtggggtgaggaagtgggggtggcagtgactttgagggagctcttgcagaaggtagctttttgaggtgaagagccagagctctgggtcttaagagttggaaagcaggttatatttcacatccttccctgaacagagaaattgaatttggtcaagaataagtcctaagaagcagttgtgagcaccccacttttccatcttgttgatgaatatggagtgggagcaaagttgagtgtgggcatctgacaaggtctttatgatcctagatgcacttactataccttcctcctcctcctctgccttggctaatgggctgtgggtacccaccacacagagggctataagacactcgctgtggctgatggagaagctgggccctgccctcctggccttctgaggaaagtgattattgtttttggcttgtttttcaactatccctttgcccccagcaggactgaacctttccactcttaccatctctgggtcccttcagatcttttatagccttgaactatccgctacaagatttttttctgtcctaagaacggaagtctggtctgcttcctaacattaatcccttccacacagcacagcctcgtttcctctagatcagagagatggcttctggattcatctttccctgcaatccagcttctcctcctggggccctcataatggagactgggatcatcatccaggcttttgcactgggttaggaatttgggagtcatcctggatccatctgcccctgtcaacctttctctgtcaacagatatttactgggcatctccaacagccaggccctgttcatggtgctgaagaacagcatgtataaaacaaccctgccctcacagggcgatcaccagtgacctgtggtgtggagtctccttttacctctgtctcctccttcccactgtcaccatccttggtcctcctctgtcacctggaatactccacttggtaaccagcatgatcttctaacactagttttacccttgtcagcactttgccgaaaacctcaaataaagactttttttttttttttttttttttttttttttttttgagacggagtctcgctctgtcgcccaggccggactgcggactgcagtggcgcaatctcggctcactgcaagctccgcttcccgggttcacgccattctcctgcctcagcctccccagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccaaataaagacttttttaaaaatgtgcgatggaaaactaaagttataaattatatcataaccattggacctctttttaaaatgcactgaagccttataatgttatccatggatatatatctatgataaaaatagaaaaaatatatgatggtggtgcttctgaaagggaggggaacggtactggggaagggacaaagggaacttcaactttatctgtaatgacctgtttattttgaaaactcaagagcaaaattgacaaaattttaacagtaacttaacaaaacctcaagtctggatagtgagttcaagagtgttactttatatggacaggcagtgactcatgcctacaatcccagcactttgagaagccaaggcaggaggatctcttgagcccagccatcctcccaccttggtctcttgaagtttgagactagcctaggccgcatagtgagaccctgtctcttcaaaaaaaaaaaaaaaaaaaaattgaaagcaactcaggaggctgaggaggaaggattgcttgagtacgggaggtcaaggctgcagtgagctatgactgagccacttcactctaacctggatgataaagcaagactctgtctcaaaaaagaaaattaaaaaaagtgttgcctgtaatcccagcactttgggaggctgaggcaggtggatcacttgagctcaggagttcgagaccggcctggccaacatggcgaagccctgtctccaccaaaaatacaaaacattagccagatgtggtgggatcagtctgtagtcccagccactcaggaggctaaggcaggagaatcacttgaacccaggaagcgcaggttgcagtgagccaagatctcaccactgcactctagcctgggcgacagagtgagactccatctctaaaaaaaaaaaaaaaaaaaaaaaaaggagtgttacattagttgtctatatgtagatacacttgtcaaaatttaagccataaaaccctcagtgtccctcactgttcccacccccttagcctggcatactgggtctttcacaagcttgtgtcaacctcctctacagactcatctctacactgagggacttgcagtttccaagtcctctggccttgggacctttgcccatgctgttctcttctgaatgccctttcctgctttgctaatttgttcttgcccttctggattcagctcctgggaggccctgtggattgaagtcagatggctcaagtaggcagctggttaggacccaggagacagaaacgtgtctgaggaggacaacactttcttgtcctggtttctattcagctgcaactagagaaacagatcacctgtttcttgttcaaaactaggatcagtgagaggagggtggaaagagtaagatcctccacagtgccctcccacctcccagcctccccctacatagcctagccccaaggcagaaacttcccagcagaaaaaggaaaactgataacctcattccttggtctggctctgttaggattatcatctggtttcccctgctggtgttggaagaactgtgttggtgcaggccagtgctatcctgtgactagagggaagaagctctgcctgggcctgatttggccacaagctcctagtaagatgctgaaaaggaacacaaactctcggcccaggacaccctccccatgccatcccacacttgacttctgcgcaccttgtgagcagatcagatttggtgttgcttcttccacatcatcctcacatcccctttcacagactcggatagatcccctcatgggaacctatggatctatggcatatctatggatatgccaccccatggcaactgtcctttccccttcatagcatacatcaccctgaattatagctgcctgtttatgtatgtgtcttctgcaccaggtagtactctctgatggggcagggattgggtctgtcttgttcacagttgcatctccagcacctgcaactctgcctggctcagagtaagtgctcaatactttttgtttttgattgaatgatagaatgacgagtgaactctatttcccactagactgtgagcaccatgttgacagggaccatgccctgatcatctctggatccttagggcctatatagtgcttgccacataggaggtgctcagtagacacttatggatttgagtgaatggacttcagtttctccacttacaatctgagtaagaggaagatattctttgccctctctccctccttctccagccacattgggggttgtggttgatgctgtgaggtcgttcctgccttattcaacttcatgtccaaatcttctatggcaaaacacaacatggtggccaagtctcagagtccaggcatccctcccatagcccatagccaagtatgggagaagggtgcttcagggtctctctccattcactttagtctccagcattagccaagatcccactgtctaccctgaattcttcctgctattgcacaaggtttctttcatcttactgtattgtcagggaaaatatagccaagattatctgctcctcaacctgaagtaaaatatagattctgcctaattttagaaccggtgttagccaggtgtggtggctcatgcctataatcccagcattttagaaggccaaggcagcaggggaatcgcctgagtccaggagttcaagaccagctggagcaatatggcaaaaccccatctctacaaaaaaagcaaaaaaattagctgggtgtggtggcacacacctgtagtcccagctactcaggaggctgaggcagaggatcatttgatcccgggaagtggaggttgcagtgagccaagatcgtgccactgcactccaacttggatgacagagcacgatcctgtctcaaaataaaaataaagaataaaaccagtgtttccacatctggaactttcttttcaagtttatatcacctctccttccaaatcaggtctcccctcttccaggaagtactccttgattaagccaaaaatgttttaattttcaccacttgtcctattactctgcatccccacagcacttgtagtttgtacttattccctatcctgtttaagtgtgttcatcatcctaaccatactgcataagcaggcactattttaagtaggcttgatagattatcagaaattgacaagaaaaaatacacaccaagaagaaagtagaagaggatttttttcttttcttttctttttgctttatcatagaatttcttgtcttggtgcttacaagctgtgtagcacaatgagaggagaatgtgatttctgcaaaacatttcaggaagcacaaagaagtatctgtaaatacccaggaataatgaccatgtcttttatttgtattatttttctaattcctccactctatagggtttgcccaaagtccttgatttaagcccttgagtgttgattggctgacttagctttggattgtggtccactgagatcgctggatctttttaagctttagagttatgccctgccatgtggatgcaggtggaggaaggacttctcagtgtgacccatgagaggagtagctctcctgggccccaggccccaggctgcatgtgtatgggagggaggaggagaagcaaggaaaggaggagagacagaagtatatactgagctggtatttgggggaagggttggcgggttgggagaagggaagagaggagtctgggccaaggccagatgtgtctccctggggagtcctcagagcgggcagccggacgtcgctccatccttcccgcctgacggatgggtctgctgcgcaggcacaagctgtcgggccaggccctgccaaggcagaacagtggcgcttctgtgcgcgctgctccgctccgctcaggaggatggggcccgcccgggaagccagggagtgatggagaaagcagacgtcccagaacaggagccgcggggtcacagaagcacaactgcgtcccgaaacaaggagccacaggatgaggtgggaggggaccgggaatcaacgcgggggagcgtttgggggaagtgctggtcgaaagaagagaggcagaaggacgcgcgctgaaggagcctggggatgaagagctcgatgatttggccacaagccccctcacctttaagaacaaagcttcctgcattcagttgcagagttttgtttcccggtcagatgctcagagaccttccaacctgtcccccacccctcagccttgcccatctccacgggcatcttccgcgccctcgcccgggactcggagcccaccaccctccgcctccgcctggcctggcccgctagatccctgacgctccagttcggaatctgggatccgcaggctcccagatccgccgctggcccggctccgacccgcccgtcagccgcctccccctcagcgttaattaaaacttgcgagatggagaggctggcgcgggcggctccgtttaatttgcagcatctttcatgctgctgacgatcgtaaagggctttaatattgaaatatgggccattttcccagctccagccctcgccgcgcgctccccgcacccccacacccagccaccccgcgcttgatgaaagagcccctgcaaatccattaaggagagataattgaaaactccggggtaatatttaagaccgcgtgccgacgcggggtggagggcctgactgcgcccgctttgcccctcagtgctggtgcgtgccagtccctagcgctctaggcccaccaaagccccgcggacgcccagccaaggcccgccgtcttagcggtgcctcctcactccctgcactcaaagggctggctctgcgctaacctggctcttccgaagacttgcctggagacccgagttccaaaaggagccacagggcatgctgtgtgacagatgcattagggccagaatgcacgggggccaaagcatcttgtcccactccttcagcttcggtttgatgtaccagcatcaggcactgctcaagcttctgagcacagcatcccctctgcctgcaaacttttccctccagcactttctacttggggaattgctgttcctctttcaaaaccaacccagttccaccccaagtaatggtgcagtggggtatggaacgtgggtgggagtatagacacgccaagatcctggtgtgaccattgttgcagttgcatgatgaggacactatactgctctgttttcatatgttttcaatgttccacgacaaacatgtttagaaagcagctgaagcatcttcttttatgcctccctctcccataaatacagactacctgttatcttgtacattgatgttccttagcacatcgtgttgccattatctgtttaaagtctttctgcctactcagctgtgacatcttcaggacagggatcaggtctaatttcactccttagcccttgctccaggcccagtgcaaggcacataacatgcgctcagtaaacatcactgaataggctgctctctgggtacctagaagtctctagggcttaaggttaggatacaagcacacggaaggagggtagggcaaagcgtggaagaagggtggggtctgtgaggctgggttggggatcatgtctctctcccacaatgactggcttcaggatgttcccagaatgggaaaagggtagaggaccctgttctgcactgtgatttaggaatccttaggtctctacctgggacttttggggatgtttctccacttcactccatttggcttactctcccaatcaggttagacacacacacacacacacacacacacaccaccaccaccaccaccaccaccaccaccaccaccacacaccttagacagggaaagagtgggaaagagggaagcagaagagattatttgaagacctacttgtgcaaaaggcatgagtagttcaggcatttccatggatacccagctaaccccctaccacagggcctttcctacttacccctgttgcacagtcttccccaacactgtgtccaacacccatacaggggttatactcacaggatggcactatcgaggaagagggggctgttctgactcagcccccctaagcgcacattggccctgaagccacagttgcaatgatgccctctctatggccagaatgagatccaaaccattccaaagttccatttccaaataaggactcctcgttagaactacaaaacatcagagctggaggcaaccaaaagagcactgtgtcccctcttagtatctgtggggcaactaagacttagaaagggtctgtgatgtgccccaggtcacaaagccattggtaactgggcgggcggggtggctcacgcttgaaatcctagcactttgggaggccaaggcgggtggatcatttgaggtcaggagttcgagaccagcctggccaacgtggcgaaaccctgtctctactaaaaatacaaaaattaacgggcagtagtggagcatgcctgtaatcccagttactcaggaggctgaggcaggggaattgcttgagcctgggaggcagaggttgcagcaagctgagatcataccactgcactccagtctgggtgacagagtgcgaccctgtctcaggaaaaaaaaaaaagccatttgtaacaaaaccagtgctagaatcccagaaagttagtggtggagttggaattagaatcccaatctcttgacccacttaaatatatacaattggtattcgaagtgcttttcacaaacattatctcatttaattctctctctctcgataggatctcactgtgtcacccaggctggagtgcagtgacatgatcatggcccactgcagtctcaagctcctgggctcaagcaatgctcccacatcagcctcaggcacatgccaacacacctggctaatttttgtatttttgtagagacagggtttcagcatgttgcccaggctggtcttgaactcctgggctcaagaaatcctcctaccttggcctcccagagtgctgagattacaggcatgagccaccgtacctggcctcacttaattctcacaaacctatgagatagcgtcacaattcccatctacagatgagaaaaatgaggctcagggagagccatgatttgtccagtgtcatacacgggtgcaaaacagatccaggatttgaaccccagtttgactggctccaattccagtgccctttccactcacttctccagtatctccccctacaccccacccagccaagtcagaccagtttcccagacactcacccttcatccctggacatctccagccagaggtcttttttctccttagcccagcttcccccacccagggcaatgttctttgccccagatttggaggtgggggtgtggtagtctccgcggtggttctgggtacaggcctccatgaactgaagccatgcacagcctggcctcctttgcgtagccctactcctgttcgtggccacggaggcctcagccataaatccccaggtctcggctcataaccattagcaagcgattgggctcatcaggactcctttatgagactcgggtcaaataaaatggattgccggaggtcaggaacaagggatctccttgccttgccttgcttccgagatgctcccaccgcccagaggttggcagattctgtttgactcacagctgtaggtggaagtgggggcattgtcacagtgggataaagatgtatcccctggtactccacacccatggaaggaaaagcgcttggagatgcacatcctcatatagcccacagtcattagggctggaggaacacacacacagaggcacatatacacactcagacccccatctctgattcaaatccactcttcagcaaccaaccccccaaccccacccacctcacatcatctgatgtcctcacactccatccctcctgtgaggtatttcctgaaacactgcttctcaaacaccactgtgcatacaaatgacctgggacctggttaaaatgcagattctgactcagtagatctggggtggcacctgagctctgttttctaaccagcttccaggtaaggccagggctgcttctccaaagattttaagcagtggtcctcccacattagaagggcaggggctttcaaaatgtaaaagagataggagagtgcagtttgggaaagctcctctcccactcccatcccccaaatgctgctgtgcacacccaggtgactgaactgtttctagaatgctgttacctcactctttacatggctccctctcattcttcaaacctcagcccaagtgtcacttcctcagagaaactttctctgaccacccaatttattttattttattttattttattttattttattttattttatttattttgtttttttgagacggagttttgctcttattgcccaggctggagtgcaatggcacgatctcagctcatggcaatctccgcctcccgggttcaagcgattctcctgcctcagcctcccaagtagctgggattataggcatgcgccaccacgtctggctaatttttgtatttttagtagagacagggtttctccatgttggtgaggctggtctcaaactcctgacttcaggtgatccgcccgccccagccttccaaagcgctgggattacaggcgtgagccaccatgcctagctgaccacccaatttaaagggtccctgctccaccctgtctgtgattacccacttcacaacaggtctcaaaattgcatgtatctatttgctaacttgcttacttatttttttgtctgtttcactctctgaaatgtatggtccttgagttcagggattatgcctgttccatttattcatgaattcttggcaacctgtgcccagtgcatagtagatactcagtaaatattgctggataggccagtcacagtggctcatgcctgtaatcccaccactttgggaggctgaggggggcagatcatttgaggtcgggagttcgagaccagcctggccaatgtgatgaaacctcgtctctactaaaaatacaaaaattagctgggcatggtggcacaagcctgtaatcccagctactctggaggctgaggcaggagaatcacttgaacctgggagacacaggtggcagtgatccaagactgccactgcacttccacctgggtgacagagggagcctctgtctcaagaaaaataaaaaataaaaataaaaataaaaaaataaaagattatctgaaagagtatctgaatccaggactgaggctgtaggtaatctgagaaagtatcttggaggaaggaaaattggaggaaaagaacattgtgtgaaggacttaagaaaggtgactcaaggaaagtgggaaggcaagggtatccagataagattggccccattggtcctgggttgatatgacaggggtgaggaagggtcctggagggagagatcctgggggtagcagcagatgccgcagggtctcggaaaccatggcaggcactaagaagacacgtgggcttccctccacctcatggacaaggaccttcatttattcattctttcctacacttgacaaattcttactgagatcttattaggcgccaggcactgtgtttggtgctgaatattcaggaatgagcacaatgggtctggttcctaccctcctagagattacagtccagtgggagagactgacagtaaacatattaatatgttacagttgggccaagtctacaaaggatagggtatgataacatgtatgatgggtggttccctagggagaagtttccctagggagtgacagtcacccagagtgctgatgggtggaggtcttttttgccagccccctgccaagctttcgtcctggactttcctgcattcctctgcactgtccctttaagaggagcatctcttccctgagcaaaggcagttcgggcacacagcctgagcctgccaaggttgtgggccataaatcaacgctggcactcccttggcagtgggctctcctctgagctgcccagatggcaggcaagcctggggctccaggggcagccaggcactcaggaggggggaggcgggcaaggtgtggacacagctgggccccaggctcctgatggcagctgcccacttctgtctaagggccctaggccagggaaaatgccaaagtccttctattctagtcccagggaccttctgactcccaagtcagtctagcatggggctgttgagattattgttcccaccccagccagggaccagggcctcataggcatcctctgagaccaagggtcttggatgatctcttgggatcacagtctgctctaacattcaacctgaaagttctgcctgtggtttgaccttctttcctcttgctgtagccaaggtgtcttcttttaccctgcatgaaagatgaaagacagtagctccccatttagtgggggctttgggactgtgtgatatctccctccgccttcactttaagcctcccagaaaagcaggataaaaagatgcttcaaagtcagttggagagatggaactctgccctcttgggggttgccatccctctgccaccctcacaggtgctgtgacagagggaacatatgttgctcctaccccagaggatggagacaacatcttagcagccacagccccacagagctgggctcagcaggccttgacagaactgaaaaggcatcctctctcctgggcctgggcctggcctaagcctgggttgtgggcggaggggtggaagcaaagcctgtagaccccttccagaaaggaatcaacaggcttgactgctctccccacgctcactcccaaacagtagaacagtggaaaattcatgggttccagaacaatagagatttcctgggatgtccttgtcctcagattctctgtgagaagtcagagtttacaagtccttagagattctttctcacacactcatcatacagatgaggaaactgagatgcagagaagttcacccaggtctttttcaggttgtttttactacaccacatttgccacatgaacagaaactcccagagctaccactaagcaggatgtattagactctaaaggtagtagcatagatggaggttaggtaacaagtagaactttctcagaatagtaggtcacagaagaagatgagaagcaaagtaaagaaagtgcattctctaaaacagtggggtgggggtgggagggatggagccaaagaatcaggttagaattttgcaaaaagatagaaatatagagaacacaggagagggagctggcatagagcccagagcaaggacaactggggtgtggagcttctggggttcttcattcaggacccctagatttcatctgtcccaggcttctgggtatcaccagtagtttaaagtcaggactcatctgggctgattctcttggctttctccttgctctcccgggatggcttatctggctgccagagtcatttgccatctctgatttgtgtttaaattaaagttcccacaaacagaggtttaatgtgctgttaccaagaactcccaggccccctgcagctctgggaagttgaaggggctggggagaagaggtcagtctgtgtgcatcccatcaaagctgatcccactggcattggacctggagtggacagcccaactaagtgtctccgtccttgctgctccatccagaatggtgatgacagggggcagggcagggaaaagcatgctcacaaagggcctgggaccaacatgcccgttcaggggctcctgggtggctgttcaccctttttcaggatggtgaggagaaggcaggggaggtgggcaatgagaagagggcagggggtggaaaataaggagagagcaggaggctccattctttaacacttgtgtatggcgctcactgtgtgccagcactgttcctgggcacctcacaactacaaattcaaccttctacacaacctgtaaggcaggtgttgttatcattagccccatttttatagatggggaaacagaggcatgcccagtatcacacagccagtaagaggcagatccaaggagtcaagccagtgccatctagctccagattcccagtgctatgctgacacttaagccaaaatttatctgtcaccctcccaatcccttgatcacaaggtgaggcttctctttgccagagcaactgagacaaagtgaagctcccatcctgctccccagatctttacctctctgggccacagtcttctcatctgtaaaatgaggataagatactaggaggggttgagggtctgggaaggtttaatgagacagcttgtcagtgaccagcacagggtaggtccccagcagtggctgtttccttctctgtagtctaaccataagccttcctgctgtgccttcctgcactgcctcttaattctgctttcaaaggagctagtggcagtgaccctcgccccttaaagaaactctcaggagagcattgttcctcattcatttgtccaaattctctctcttcctctgggaaaccctgaaaaagagggataacaaagctgaactggagccccaacctgctctgtccccacctcctctgcacccaggtgagccagtcagggtggcaacagaaaataaatgacacattcgagagggtttcactgaagggtttagtgatgtggcagtttctaaaggcatagaccagatgaagaaaactaataagggctagtgtggcaccaggatagaaatatctctaccaaagcccaatgccaactgggctcacgggacacaggagagaggccactcagcaaaactgtgaccaaggaggaaacacaaccaccaccagagcttcaagcaggcaaaaaggggggctgacagggaatggaggaaacaaataccctgactcctctctcccccttctcagccgggaactctattggccgagagatcagggggcccatgtgacacagtctgcagaggtcagcctccctgggcagagcagcacagagaacacagtggggcaaacataaaaccatccccgtcccatcccacccgtgagtccctgcttgataccaaagcctcctctctgctgctttattgccaccactgtcactgcctgcagccaaacagtgactgacagggaaggagagtcaagactcccacaagcaaatactccagctcacaaggaaggtgggatccaggcagagggcagcttgagggaagagggctgtgtctgaagggcagcagagcagggactgcccactcccagcatggagagacaaagagaaggactgcactgggggtgaggatgtcaaacgatgatagtaaatgactctctttcctcagcatatgatacaaatcactgtggatctcccttcctcctcccctctctagaccgggagcccttgtggggaagggattttgtcttgttcttccttgatatctagcacagtgcctcttaggggcataatcagaatttattgaataaataagcaaatagatatgtaaatgaatgaacaaacccatttgcagctcatatgcacagccctgggccctggtcagggagcactgttgaatgaatggcatgcagcattcctacagaagttttatttcaatcagttccatcacctaccacctcaggtttcctttcagccactgagtcacgggccacacagcccacatttgcctccacgctggccagaggctgtgctttgatagcacccactcaaatgtacagtgacctcatctagctcctcctgatggaggaatgaggggagtagcaagtgacttcctttctcacagcagcctttctgtgagctctttcttttttttttttttttttttttttgagacggagtctcgctctgtcgcccaggctggagtgcagtggcgcgatctcggctcactgcaagctccgcctcccgggttcacgccattctcctgcctcagcctcccgcgtagctgggactacagacgcccgccaccacgcccggctaatttttttgtgtttttttagtagagacggggtttcactgtgttagccaggatggtctcgatctcctgacctcgtgatccgcccgcctcggcctcccaaagtgctgggattacaggcgtgagccaccgcgcccggcctgtgagctctttcttgagagaaatcttgatccatggcaaaccgtctgtggtattctcggctgtagcccttggtgggagatggggggagggaatgacagtgccaaggatgcagctgaaggatcgtcaccctgggagccacagctctggcttactttttccaatgggccataaagactgagggaggcaggcggaagcaggggcaccagactaacaaactagagtttcaagtgtagtccccaggcgatgcccaccttgcgaagtggttacagatgctggggctgggctcaagatgcctgttctaccacatgctggctgtacaaccttgggtaagatacttgattaccatgcctcagtttctgcatcttaaaaaatgtgaataacagtaatgcctacttcacatggtggtgaaaaagtagatgagttaatagttatgagatacagccaggcctggtggcatgggcccatagtcctgctactcagaaggctgaggtggaaggattgcttgcacccaggagttcaagaccagcctgggtaacatagcaagactgctcccccactttttattttgagatggagtttcactcttgttgcccaggctggagtgcaatggcatgatctcagctcactgcaacctccacctcctggattcaagtgattctcttgcctcagtctccggattccagggatgaaccaccacacccagctaatttttgtgttttgcatttttagtagagatggggtttcaccatgttggtcaggctggtctcgaactcctgacctcaggtgatctgtccacctcggcgtcccaaagtgctgggattacaggtgtgagccactgcgcctggctgcaagacacccatctctctaaaaatgaaagttttgaactatttaggagagtacatgatccatggtaagctctatataaattttgttacataaaattaaggttctagtcccataaacttttttctgtaataagctgctcagccttagataaatctcatatttgctgtgagaagtgaacaaatgcatgtgaaaactgtaatgtgtttataatttttattatttgtcatcaagatcatgtaagagacctgatttagtagagggtgaagggatgcgaaagaggctgtcagtcatcaacttttgattatctgccttgttaaggtccccttcttgtcaacataatcagctctttggcttgttcaagtcttttgttgacaatatccaggcctctcatggttcctcccacacacaacgggctgcacagcaagggctggaaggaaaaagcctttgaaggcaaaacgggtccttcccttccttagccttgaagcgggaataaccactagacagaaggctgtgagggaggactcaggcacttccactgtggctgctttgcctttgggcaggaggggaaactgatcagctccctctgtggtagggccgcaggaagagatgttggcatttgttatgaagtgctaggcataaaaacacatacatggccgggtgcagtggctcacgcctgtaatcccagcactttgggaggtcggggcgggcggatcacaaggtcaagagtttgggaccagcctggccaacatggcgaaaccccgtctctactaaaaatacaaaaattagccaggagtggtggtgggcacctgtaatcccagctactcaggaggctgaggcaggagaatcacttgaacccaggaggtggaggttgcattgagctgaaatcatgccattgcactccagccttggcaacaagagccaaactccatcccaaaaacaaacaaacaacaacaacaacaaaaacagaaaacaaaaaacaacaaaaaaacccatacacacatacttatcccagtgtccagagcaaatgttctgccacttactgctatgggtgtgatttcagatagctacttaaaccctgagttgcggtttttctcatcttcaaaatggaaatattgatgcctaattcaaagggtgaaaattaatgaactatagaaaccccttggtgtatgtctggtccaataaatggtagctctttttagctaacattttgtaatatctgcccactatctcctccaagggatggagaagtaatgctgacttccagactaggaaaggtagcggtagcagaaagtgatttacaactcgacatttttcacattttctttccagagcacatagtaagttcttgttggttcattcattcattgaacagtgtttagaagtttgaacaagcttgaacaacttgccatcattttgttcacttgtattcatcttactctcaccactagaactgcaaggtccatgagggcagaggcagtgtctgttgctgggtgagtgactggattgacctcaaagcatgtctgaagactgaaatgggccaggcaaggagatggacactggaggcctggattctgggctcagtcatacctccaagaacataactttccctcgaccctggagtcttcacagaccttccttccactgtgaggcactggataatcacttgagaccagactcagggaactcctccctcatgggaagacattcattcatccactccatgtctctgaagccccaagagaaggatctgaatcccctagtctgaagagtcagcaagtttccaacacagcaatcatgataaaaagggagaattgataaaggagggagcagccccaactcagtaacaacagagggaggaaaattccagctagtacatatacttaatatgaaagcagacatgtgccaagaccctgctttcatggatattaggtgttcccaaatataagaaacacccattcttgcccacaggcctcactggatactatccaagatgtctagacaataagaggaaagagagaatcataatatccaaaaggtggaaaaaacccaaatgttcaccaatagatgaacggataaacaaagtgtgatatatccatacaatggaatattagtcagccttgaaaaggaatgaagtactgataaatgccacaacatggatgaaccttgaaaacactatgctcaatgaaagaagctagtcacagtaggtctcttattatatgatgccattcatatgaaagtccggaatagggaaatctacagagactgaaagtacattagtattgttaagggcaagaaggaatatggggggatagggaggtgatagctaaaggttacaagatctctttttgaggtgatgaaaatgttctaaaattaactatggtgatggtttggcatacctgtgaatatactaaaaccattgaattgtacatttcaaatggtgaattgtatgacacatgaattatacctcaagaaggttgttttttaaaaagacagcgtaaggggtagggggaagttgagatgaagcaggaaaactgtgatcagaaacaaagctcaggggctgtctggcctggctgccccaagtcaaagcctgcatttcatacaggcaatgttagggtagcccccaagccatgattcagaaagataaattgaccccagaagatatagggctgggtcccttctcccctgacagctccctttctgtgttttttctggcacaagaaactctgtcatcttgtataaataggagaaatttatgacagttttccctcttcttctccctggtgggctactaggaaaggtcccgggggaggagggagcctgaaattccaaaaatataaatgtggaaagactggagggggttgaagagtctctttgcctgccttgactctggccccagctctcctttccctttgcatgtttgaccatctgggtgatgcagagggtagagagctggtgcagcccgttctctctgcaagcccaaaagagatgggtcccaaagcagatatccgacaggaggggcacaagggaaatcaagaaaataggcttggctgtcccatgaaataattggaggagacacagaccacttgccctccttcctggatttggctatttttgtacttccctgtttgttgaggcagcctgatacagtgggaagagaactcgtcctagatttagaaagattgacagagaaactaagtgtgtgaccttaagcaagtcatatcttctctccgggcctcacctgtaaaaagagggaggggactgaatttatcaggggttttcaaatgagtttaactctggggtccttccttcaaataaaaccgtatgtagtgacccaacatgaacacgagtagtagcctgctgagcttcttgaaggtaggaatgggagtcagggccctgtggtgactggtgagaggcttgtccaagcacaagatgatctccatggcctttccagccctgtcctcaggagggatttgcccccatggtgaaaaggctcagttctgtacacccagtgggcttgaaatccagctccaccccctcttgtgtgtccctcagcacataacttaccttccttgaacctgtttcctcttgtttaaattggaatagtaacacatatctcagaggattgtcacatagattacactaaataatgtgcatagagtcctttgcatactatctggcccaataaatattattatagttattccgtgatctgatgtaatcagttttttattttgagacagaatctcattttgtagcccagactggtgcacagtggcatgatctcgggtcactgcaacctccgcctcctgggttcaagcaattctcctgtctcagcctcccaagtagctgggattacaggagtgtgccactgtgtccagctaatttttgtattttttagtagagatggggttttaccatgttggccagactggtctcgaactcctggcctcaagtgatccacctgcctcagccccacacagtgctgggattacaggcatgagccatggcacctggcctgatataatcttcttaatttgaaatatctggtgtgagaaggtgaattggaaaggatgacagcaaaacttctataacacaaaggcccccaaacacagtagcatatagaaaacagaagtttatttctcacttagtctgggaggaagttgttccagatagcaggcagctctgttcctcctagtcagtcagggacgtgtgttcctttcatacctttgctttgtcttctcttagggatgtcttttcagttgcctggtcaaacctgtctcaggcacatctgcccagctcatgaaagagagaacacaaaggagaatttacccaatccgtcaggctttgaggacatgctcacctcacattcccctgtgtctacacctggcaataagagcagctgggaaatggagtgtccagctgggtgtccctccaccctcgtgcagcaaggaaagaagagattttagtggacaatgggcagtcttaatccagggctcaaacccacacctgagctgtcctcttcctcttctcttcccaaaggaagggaaataaagtctacagcccagaaaacaatgtgaccacccatcccctacccaatcaggtccctgccatttatcccaagatcagctgtctttcttgggaaagtggcttggaagcctctctccagaaagaccacccttctgtccatcttcttcacatgggtggatttgagaaaagtttctgtccccactgcctgcctgccactccctgtctcagtttcagctcacgctctagcccttcgttcccagtcaccaagaatgactacaaatgcgggggaacaggaggacttgaaacagtcatggaaattgagactggggcacagaagccatgctcagaggcagcgtaggtgagggttctgatgccaggaaatccagctactactgtgtaacctaaagcggggattaagctctcagaacttcaatgaactcttttggaaatagggataagaaacccacttgtcagggctgttgtgaacatcaaatgtgatcatgtatgtacctagtacatagtatgccttcaataaatggtaaggcaaacccaaggcaaattgaattcatgtccattactctgacccagcctttgcataaattgttttttcttctccttccttgtcaatgcatggctccctccctcttctttacttcctatcctcattcccctaccatctgaaccctgatgtggaatctcttttctcaggaaatcttccatgattgaaacattcctgcttggccacttcccactccaatactctatcttcgcccatcttccatctaccccatggtcctggcccaagtttacacgtgtcccatttctcccttcaaaaagcatgcagcaatggaagggctttaagtttgccatcaagcagatcagagttcacatgccaactctgccaagttctagctttaggactttgtcagatcacttcccctctttgaatctctgtcttcccaaccctctggtgaggtcaagtgtgtgtgggctggtacataaaggatatttaatctcctctgctctacccaacctcccccaactcacactcccaggactaactctctactaaagggagttatcagaccaagaaagtaattctcccattaccagccccaccccaaccctgctgagggaaaaagaagtgacttcgagtctatgggtcttggagggaccaccaacccaagagctagagcagaggaaggacttggatatcccagattccagggttataggatctctccccaagccctcatatgcagccccagttgcaggactagcttcagggataggagtgaaagagttgatctgattccagtcttagcctgtaagtagtagctcacctgtgcctctattttcaaccttcctagatcagaagagcaacaatatcagtgacaactaatgcttacatagtgtttcctatgggatgggcattgttccaggctcttcgtacatataactcatttaatcctgacagcagcctttgagctaggtactattaaccccattttacagacaaggaaactaaagcacaaggggttaagtaacttgcctaggtcatacaactcacataaggcatgactgagattcaaaaccaggccgtctagctccagaatccatcctgttaaccactctgccataaaaagagctaacatttactggcaggttctatgtgtcaagcactgtggaaaacacatggcatgtatttcctctaattccaaataaccccctgagataagttctattattggtatccctgttttacaggtcaagaaactaaggcagagagaaaagttaagcaacttgccctgagtcacacagctagatattaatagtttcagaactcctagctgttttgcctcaaatcccacctccccacccctgctcaaagcccctccccttctaggtgggttgttttagttcctatcaccagttcttcacaaatcggctttaccccccacagcctacaacccttgttctccaaaactcctgttgacctccgtccctttcccttcccactttctccctagaccctctgctccccacaaagtcccccaaaccattctgtccctctccctctgctccccacccaccctcccccacaactcctgctaaaacagatgaatttcaccaaaaaagaccatcagaccttccccaagcaggcccccactgtgcctgattgcacacccccaggggaggcaccacagtggctaagctggagagccagaaataaaatcctcattctacttccctgccccttcttcccatcactcatctgggaatccagggcgaagaagggagctaaagtgcagagcattcatttaatattaacaaattgaaatgaattcttttaatgccaattaacttggagcggccccttattaatagtaatttagattcatacttgggagaagcagggatgagggctgggccaaatgtgcccagaatgtcaatgtgactggggaactgaaaggggaggggtggcagttttacttctgcccagttgggttctgtttccctgagagaaatggacagtcactggaggcggatctttgggaaacataaattactcttgtaagtttatttttgttacttcaaggaatctgaatagtttgacgccatgtcacaccattttaagagtttattttcacagtaatgctaaaaagaagaatttcctcagagctgggatttacttcaaactctctcctaagccaaaccttactgaccaaagggacaagtccccaggccagctctctacccttctttgttcagagctagagccagagatcaatatgggcttccccagtccctgccccttctaccttacccaaaactaaaaggaagaatcaacactgtgtgtctctctgagaagtctccctcaggagataaaagacccaaagggctgacccctaagctaacagcttacatttaaggaagaaaaacaatctgcctgcacttttcttagaatttagggaaaaaatgagaatttaaaattcaatttcatgtatcagagttctccagaatacagccaagtggaaagaacttagtcccaaatgaaaaagttgagcagaaattcttctctcactcgttttgccggcttggaggtcagactggaggtgtcctgaactagaaccagagcataggttctgacccaagaaggacactgtctacttcccaggcatccctccttggctgggaggagaggggaggatgagtccattggaagctgagaattgtggaagctggggatgggagttttgagatggaggaggcaggcgtgtgaaggaggtcagggaaaggcaagtaaatctactaatcattgcagtttataaaataaaaaccttaaaaatggtttaacatgcaaaaggttaaattttaaaaagaggccaggttttaaagaaggtaaaatacctcaaatttagacataataaaaatgaggaaaatactcaaaacatttcaagcaaattgttcttcagaagaggagaggttggaattaatcaagagacctttgttacacacacatcccccaagagtttcccaaacaataaattcatttacaaaacaaaataggaatcaacacaaaacctcatccacatacagagaaaaataaattgtggtgattctgtaacagctgaaaaactagtgagggaggagaaaaatgaataaactctaaatccattaggtgatatttataaatagcaaaattggaggatggaatggagaaaagagttgaacttatcattaaagaagtaacacatgtgaaaacataaggtgtaactcatccccaaagaaaagtaaactctccataaagtagcaagtatagaaatttattgaaaaggaggaaagtaccactcacccccccaatataagcgtattaatttgaattaaaattttctccaaatccgagataggttacgcaaaagaatacaaaaagattatttttctttcaactaagaggaaaaacaaaatccgatttaaattcactaatgggacaagaagggaggctgtggtttgcaggtgctagtaaacgggatgagggttgtgaagagtttgaggggtagaggaccagcttacctcgctttggagccgcagcggccaacaggagtgggcaaaggaccctgccagtgcctgagtgataggggaaataaggaataggggattcgggtgcccctagacgaatgaggaggatggaaagactgggggtgcccatctcccctcctctgcccgcctccctccctccggtacccaggcctagagagctactgaaagttacaaattgcttccattattagctcatcccgggcggcctggtcattggccagcccctggccacgtggtccctcgtaccaatcgatcgaatttctagtcgcaattctctgtctgtccctcagctctggggagaaagtgggggctgtggcgtgggggctgaggtccagtttggggcggggtgggagaggagtccttgagtatcctgtcccagggccaaacccccaggagtccaatcttcaagacatccttgagccgacttccgccgatggagggggatcttcagggtgcctgctgggttctcaggactcctcttcagatcctagttttgacccctccgggttagaaaggatgggctcagcacatctggtgaggcaggcaggtcgtcgctgcagcacagaatgatcccatggccctcaaggcgtggtgtcagctgaaagttcactgatctgtgagccctctgcctccctcctccgttgaaagagcagtggcgtgccccacttctaaaagccctggggctcctgcaagcggacaccgctttccaggacaggtgcaaacagggatggtgcgaagccgaggtggagacaatgcgatcacgcgtggcactggcgtatcccacagcagatggtgtgaatgtgtgtcaccggaggcatatggggtgatggcaaaaccaacaatggtgtccaggcatgtgcccggtggaaagggggaacaagtggcctttccctgagtgccaagggaactcaaagaagacctgggaacctggacggggcctttgcctcagtccaagccacattttgaaatgcctgccagaggagcacagaggtttctgcaacattcaccctaccccgaagcctccaccgcccaggtagccctgatgcaacttccctgcaaccggccccaaccccatccccaggcccagcccagttcctttggtttcctgacattcgttacagacaaaagattcagggaatcagtccacctatgagcagaggagaggatatccctcatttgtgagacaggacgtgcaaaggaaatgggacaccacctgtcttagaagacaaggccagtcatgatcacctagcgctcattctaggcaatccacccaccgatgaggtgaaacaaggagaccaaagaagcttccctgtctgagacacgcatggaagccaagtgttccaggcttatcagacctgcccaatccagcagaaacaggtttggagagagaaagagtcatgtcgcggatctccagaaagtgtctccctgatggactgggaagcgatcttcgtagaatttattcagccagatcaagaggcaactaggcccctcagaaacaggggagacagagcaagagggaggacagagcacaggccagagcccaggcaggttacagaaccttgccaccgccacaggcataaggggaggggtgcgaaacgcatgacttgtccagagaggccagcattccagggacagggattgttgccgtctcccattcccggcttcctcttcagaattgtatcgtggtgtggcttcattgctcagagaagagccgtgcaggggtacaaccatcttcttggaggtgtgtctgctcctctcctgccggacaatgagctgctgtggggttttgtcctgggttggagtgtggtcctcttgatcctagaaaagaggccgctcaggatggggatgagacttcgattgctccgggaccgacgcatctcctcacgtgatcgaggacttcacaaacccaaagtggaaccgccgtgaaaacgatggacaaccggccacgggacccagacagagacacagaaagaggctcaacaaagactggccgacatgcaaaaaatcgcattttggcaaacagagcacattcgtccaaagacacacacacacacagacatgcacacacaaacacacacacacacagaccaacagagagagggaaagaaacacacagagggtgagagacagagagagaagagagaatgggagacacacacacacacacagtcctacagtggtggcacagaaacacacattcccaggcaacccctgaggttaactaatagtggaaaatatgtatctaagaatacacttggaacagaaatgtgaaaaaccgaaagtaagagatattatgaaggagcaaatataaaatgacccagtgctaaagaggccacaaagaaaattgtagaagaaaatgacaagaggcattgtgccttaatgagtttgtgcttctatataagaaaatacactaggctgggtaatttctgaagaacagaaatgtatttctcacagttccataggctagaagtccaagatcaaggtgccagcaggattggtgtctggtgagggcctggtctctgcatccaagatggtaccttgtgcactgtgtcttcaggaggagaggcactgtgtcctcacatggcagaaggcggaagggtaaaacaggggaagcccactccctccagtccttgtgtaaggatcctacacccatttgtgaagactctcccttcatgactgaatcactacctaaaagccctacttcctaatcctatgacatttgtgattaattttagggggacacattcagagcatagcaccctatattcaatttcttaaaaattattttgttgttttgcttttctgtttttcaaatggcttaagtgcacaaaattggattaatcataatccttggctcatagtacaccttggctcctatttcacccttgtctgtgcctgggcctctgtgtaaatgtatttgaacaatatggtaatcacttgtcaacttacaacacaaccaaagaactagggttctgaccctaacatctgctcctcctctgtcctttttcctgattttcacccttcagcccgagagtaactattaccctgaatttatgtttaggattctcttcctttaaaaaaaacacattgttttattgcatacatatgattaccctaaatgacatgttacttagtttttaagggtataatttatttacccattctcctattaatttacccattctcctattaatgaacatttggcttatttccagatttttcctattatgaatggcattacgtgaggatttttttttttttttttactacatcttgtacatatgggcaagagtttctccagggcctatggtagagaaattactttgccataacatatgagaatgctcaaatttataagataatccaaattgctttccaaagtggttgttctaatttaaacgctcacctcctgtattagttcgagatgatcttgttgatccacagtctctccatatatggtgatatggtttggctgtgtccacacccaaatcgcagcttgaattctatctcccagaattcccacatgttatgggagggacccagggtgaggtaattgaatcacggaggccagtctttcctgtgctattctcatgatagtgaataagtctcatgagatctgatgggtttatcaggagtttctgctttggcttcctcctcattttctcttgctgctgccatgtaagaagtgccttttacctcctgccatgactctgaggcctcccccaccatgtgggactgtaaatccaattacagttctttttctttacacctctttttcttctcagacttgggtatgtctttatcagcagtgtgaaaacagactaatacagtaaattgataccagtggagtggggtgctcctgaaaagatacccaaaaatgtgcaagcaactttgaaacttggtaacaggcagaggttggaacagtttggagggctcagaagaacactggaaaatgtgggaaaatttggaacctcctagagacttgctgaatgactttgacaaaaatgctgatagtgttttgaacaataaggtccaggcagaggtggtctcagatggagatgaggaacttgttgtgaactggagcaaaggtaactctcggtatgttttagcaaagagaatggcagcattttgcccctgtcctagagatttgtagaactttgaacttgagagtgataatttagggtatctgctggaagaaatttctaagcagtaaagcattcaagaggtgacttgggtgatgttaaaggcctttggttttataaaggaagcagagcatacagttttggaaaatttgcagcctgacaatgtgatagagaagaaaatcccattttctgaggataaattcaagctgtctgcagaaatttgcataagtaacaagaagctgaatgttaatcccaaaaacaatggggaaaatgtctacaggacatgtcataggtcatcacagcagcccctcccatcacaagcctgggacctaggaggataaaatggatttctgtgctgggccaggttgactgtgctgtgtgtagcctagggccttgtttctctgcgtttcagcccctccaaccatggctgaaagaggaaaacatagaactcaggccatggccttgagagtgcaagcaccaagccttggcagcttccatgttgtgttcagcctgcacatgcatagaagtcaagaactgaagtttggaaacctccacctagatttcagaggatgtttgaaaacacctggatgtccaagcagaagtttgctgcaggggtggtgctctgatggagaacctctgctagggctgtgcagaagagaaatgtggggtcagagcccctatacagagtccttactggggcacttcctagtggagctgtgaggagagggccactctcctccagaccccagaatggtagattcactgacagcttgcaccatgagcctggaaaagctgtggacactcaacgtcagcccatgaaaacagccacgaggtgggctataccctgcaaagccacagaggcagaactgcccaaggctgtggaagcccacctcttggatcagcatgaccttgatgtgaaacatggagtcaaaggagatcatttcggaactttaaaatttgactaccttgctggattttggacttgcatggggcctgtaacccctttgttttggcaaatttctcccatttggaacggctgtatttactcaatgacctgtacccccattgtatctaggaagtaactagcttgatttggattttacagggtcataggcagaagagacttgccttgtctcagatgagactttggacagtggacatttgggttaatactgaaattagttaagactttgggggactgttgggaaggcatgatcggttttgaagtgtgaggacatgagatttggaggggccaggagcagaataatatggtttgactatgtccctacccacatctcaacttcaattgtattgctcaggattcccatgtgttcggggagggaaccgggggaggtagttgaatctttagagccggtctttcccatgctattctcgtgatagtgaataaatctcacaagatctgatgggtttatcagtggttttgtcttttgcttcttttgcctccttctcatattctcttgccactgccatgtaagaagtgctgttcatccaccaccataactctgaggcctcctcagccatgtggaacccttaatgcaattaagcctctttttcttccctgtctcggttatgtctttatcagcagtgtgaatatggactaatacattttgtattgtcaaacttcttaatatttgtggagagaatagatgtgtagtatcttgtgcatttccctgattactaatgaggttgagaaaatttttatgttttgcaggctttctcttttgtgaaatccctattaatgcattttcccaattttctgttgggttgctatttttaaaattagaaataactgtcatcaatccaaaagcttacacatggcagatcccttcacaccagttcacagtacaaagtaactccttgcttgtagaaaacattattattatcattattatttttgagatggaatttgacttttgtagcccaggctggagtgtgatggtgtgatctcggctcactgcaacctctgcctcccaggttcaaaggattctcctgcctcagcctcccaagcagctgggattaccagtgcacaccacgatggcctgctaattttttgtatttttgtagagacagggattcaccatgttggccaggctggtctcgaactcctgaccttaggtgatccacttgcatcgaccttccaaagtgttggaattacaggcaggagccaccacacccagactagaaaacattattcaatagcaaacagtagcagtatgcttgggggttttaggattgattattttcaaatctctagaaaagctcaatgcattaccttaggctataatctcagggcagagtctcatctgttaatgtggggctggtctaagggtccttccacctctcagatttatggtttccgatgttgaactgctccctgtcacccacccatcctcggttttgtttgtttgtttttacagagacgaggtctcactatattgaccaggctggtcttgaactcctggccttaagcgatcctcctgccttggcctcccaaagtgctggagttacagatgtgagcctctgtgctcagtccatccttggctgttcaagtgtagaggtaagtagtagatgccaagtttacctccaggtaagaaggggcagatgccccagggcagaatcataaccataatcaggcctcccactgcatgagacattatgttctgaagcttaaacctggacaaaggtctgaccagtagcactgtgttcatgaatgtcaggtcaaaaatttaaaactgggactatccagaagaacctggtagatgcaggtgcagtccacagtccaatggtcagccttgataacaggccacctgtactttctctttatcatggagtccttgatgtaaaaattgatgacactttcttgcttctggtgtgcttccctttcttcttcattttccataagtagtttcctccatcccgcctcccaacaggccacagtcaattcaggacattttaaccatgaaaatgagtctccataacacgaatttagaggccagacagggtggatcacgcctgtaatcccagcactctgtgaggctgaagtgggggaatggcttgagcttaggagcttcagaccagcctgggcaacatggtgaaaccctgtctctaacaataaataaataaataaataaaaataagccatgtatggtggtgcatgctactagtcccagctactcaggaggctgaggtgggaggattgtggggccaaggaggtcaagtatggagtgggccaagatcatgccactgcaatccagcctgggtaatggagtgagaccttatatcaagaaaaagaaaaagatttaaaggacaggctgactttcttgttacaagccaatgctcatttgctattccataaatcctagggcacctcttaagaattatgctaaatctacactacccaagctctataaatggaacaacaacacttggatgatatcagagctgtttactgcatgggttactgagtattttaatcccactgttgagacctacagctcagaaaaaaagattgatttcaaatacttcagctttttgacagtgtacctggtgactaaaaagctctaatggagatgtacagggaaatgcatgctggtttcatgcctgccaatacaacatctattctgtagtccatggattgaggcatcattttgactttcaagtcttattatttgagaaatatatttcataaggctgttactgccacaggtcatgattcctttgatggatctgggcaaagtcaattcggaaccttctggaaaggattcactatgatagatgccactaaggacattcatgattcaccagaggaggtaaaaatagcagcattaataggagtctggaagaagttgattctgaccctcataaatgactttgaggggttcacgaccttagcagaggaagtaaccacagttgtggtgaagatagcaagaaaactagaattacaagtggagcctgaagatgtgagtgaattgctgcaatcttttttttttttttttttttgagatggagttttgctttgttgcccaggctggagtgcaatggcgcaatctcggctcaccacaacctccgcctcctgggttcaattgattctcctgcctcagcctcctgagtagctggcattataggcatgtgccactgcatccggctaattttgtatttttagtagacaaggagttttaccatgttggttagggtggtctcaaactcccaactgcagataatccatctgcctcagcctcccaaagtgctgggattacaggcatgaaccaccgcacccggccaaattgctgcaatcttaatggaaataaatggaattagatggaaaaaagttcagtctggggctcaggatcggctctccctttactacgacattcacgtgcagcgcaccaaggaatcagagaattctacactcgactttgaccttgtgggttattatggcaatatatttatcataatatactgtgaatatttatcaaagtaggagaatagaacatatttaactatttgttagcttcatttataactcataattatttagacgtaatgcaaatgtgggctggaattcatgttctgattttttgtggccttgagctaaggaaaagggacccagggaaatgggctttatatgcttggatggcttcatggaatccccaacttccttagcttctgtgacaactcaagattgttactaaaatccactttgtattatctttaaaaaccaagggatatcatttctgcttatataatatatattataatacatattatattatgataaaatatataatataatataattaatataataatatacaatatataatattatataatataattaatataataatatacaatatataatattatatattattatataatgttatataatatataatttatattatataataatacatatataacatatataaaatactatattattgttgcttgttatgaatgaggaaagaaagtggtttcttgcgatggaatctactcctggtgaaaatgctgtgaacattgtggaaagaacaacaaaggacttagaatatcccataaacttagttgataaaagagtggcagggtttgagagaattggttccaattttgatataaattctactgtaggtagaatgctaccaaactgcatagcatgctacagtgaaatcttttgtgaaaggaagagtcagtcaatgcagtaaacttcattgtcatcttattttaagaaattgccactccctctccagccctcagcaaccaccacctcgatcagtcactagctatcaacattgagacaagaccatccagcagcaaaatgatgatgacttactgaaggcccagatgatggttagcagtttttggcaatcacgtattttcaaagtaaggtatatacattatattttagacataatgctattgcacacttaattgactacagtaacttaaacataacttttttttttgagatggagtctggctctgttgcccaggttggagtgcagtggtgcaatcttggctcattgcaaactctgcctcccaggttcaaacaattctcctgcctcagcctcctgagtagctgggactacaggtgcgcaccaccatttttgtatttccggtagacacagggtttcgccatgttagccaggctggtcttgaacttctgacctcaggtgatgcacccacctcggcctcccagtgtgctgggattacaggcgtgagccaccatgcctggcaacataacatttatatgcaccagaaagcaaaaaatatcgtgtgacttgcaaaaaatttcgtgtgacttgcgctgttgtgacattcaccttattgtgttacctagaaccaaacctgcaatatctccaaggtgtgcctgtatccctagaagcagagctggagtaaggacttcggtgtgggtggtttatttggaaagtgattccaagaagcaagagtcagaagtgggaagagtgagccaggcaagaaagaaaagccaaaataatggcatgctattgaggctcctgccatgcagttttttctgcaggaccttccgagaggctccggaaagttatccagaaatgcccacctgaaacatgagcctggagcatttgtccacctgtcccacactggttgaggtcttcccctgaggctgttaacctgcaagtgtttctgggctgtatttgtgctcaggcaaaatcgtacaataatggagattccctagggcagaaagtgtatcttgagtttgctggcagcacaagagaagcctgtgcttccatggaacttctcacggtgtctgagactgaatgaaaggtgagctgagaaaacatgacgcaggcgccattgcactaagcaatcatagccatcgatctgggcaagaggacccctgccctgaatcctgcacttgagaaggtgcctctctggccctccactgactgtaccctggcccactcagagcttcaccctctcttctagggcacatgctgggcactcagggacctggcgaaatgtgcctgagcctgcatggcctcttccctgggtccatttcaaagtgcaaactgtgcttgtccaaatggtgcccaaggatctgctttctgaaggggtgagaattgtggatggagcttgcatggggcctagggagttccccacacaagggtttgcaaagcttctcaagtgaggacagggctacctacgatgaaagaaaaaagtttagcctggggctgatgatcagctctccctttactaccacattcctgtgcagagcaccaagaaatcagagaattctacactcaactttgaccttgtgggttattatggcagtatatttatcgaaataggagaatagaacatatttaactatttgttagcttcatttataactcataattatttagacataatgcaaatgtgggctggaatttacgttctgattttttgtggccttgagctaaggaaaagggacccaaggaaatgggctttatatgcttggatggctttgtggaatccccaacttcattagcttctgtggtgactcaagattgttactaaaatccactttgtattatctttaaaaaccaaggaatattatgtagatcagtagttagaaggtacttgactcaaaatatgtatgaaccaaaggatataaatgactaaaagcagaaggattattacctgaagtggtggaaggttgatctcaggatatgacctgtgagatccttcctgctggctcagtgctggctgaacggggggtaggagagcaccaggaacaacacacatctgggacaggagggaatccggggaggaaggaaagagaaataggcctttttatttttattgatacatgacaattatacatatttgtagggtacatgtgatattttgatacatgcatacaatgtgtagtgatcaaatcaggataatttgcatatccatcacctcaaacatttatcatttatttgtgttgagaacattccacatctttcctctactcattttgaaatatataagttattgttaatgatcatcaccctactgtgctattgaacactagaaatttttctgttccttccatctaactgtatttttgtgtccattaaccaacttctgggaagggcaaaagagtgggtggatgaaaagggccctttttaaggaaaagtaaatcttacaagaagggaagacatcttaggaggaaaaataaaaaggtggaccatgggcttagagtagggactgcagaaattgaatggcaaagaaaaaaccaacttagcaatgtgaaaatacatctcaatgtcattcttttcgcaggtccagtgtctgattcttttgggaagctggatatgaagtcagaatctttctttgagtcatacattttcatgattatgattattattgaatgatagctgacaattattgagagcaattattgaggacaattattgagctttcacaagcccttttcaaaggtctttacatatattttctccacttctaactgttagatattcttattattcccattttgtagatgagggatacacaggcataaagcctatgtggaggcagagagcagctacgtaacctgaccatggcccaacagcaaacaaatgatggggccacatgcaaatccaggcagaatccttctattatatgaagctcaatgttttcttgtttgcagcttgttatgaatacatctatttgcaaatgggttttgaagctactttaaaacattttgtggctgtgcgtggtggctggcacctgtaatcccagcattatgggagaccaaggtgggcagattgcctgagctcaggagtttgagaccaacctggccaacatggtgaaaccctgtgcctactaaaaatacaaaaaaattagccaggtgtgttggtgtgcacctgtaatcccagctactctggagggtgaggcaggagaatcacttgaacccaggagaggaaggttgcagtaagctgagatcatgccactgaactccagcctgggcaacagagtgagattctgtctccaaataaaaaataaataagattgaattttgagctcctgaccatgtccctagattgtactcatatgtattttgatgtctaataagatttattctcagtgcattttttaagtgaaagtatttattgagcatctactgtatatcatgtgctgaaataggcaccagtggtgcagggaacatatggcacagtgtctgacctcaggtaactttcactctcatacatatgtattaggacaccaacacatgtgtgaatataagatagtatgatagatattgcaacaagtaattatttactgtaaacctattttataggattttaaacttaaactactttcaccctatttccaaaaaaaagtattgcataactttaaatagattctcagtttgaaatcatcatacaaactgcagtagcatctgctggtgaaatactgctttgtatctattagaatagtccaaacaattgtgagacaactgcattattagagctgtaaaagttattgtctagaaatctcagagaagaagaggaagttctatggtagatgaataagatgacatctaaactgttctcttcagctactgaagttctgtggatatctcacagcacaaagttcaagtgtatgcccacagctcctcatgccacaagatgtgacacctttccaatctctttttgcaaaagtttccaattatgtctcttttaagagtactttttatacccacatattccagattttgtggtgcacgcaaagacaagatgggaaggggcttccatttattgatgccagctgctccatggaccaggccctgcccatgcatccatgttggttcttttatccccacatcagccatagcccataagcattaactgccattgcacagatgaggaaattgaaagtctaagagaatatgcaatctacccagagtcatgcagcttgtgtatgtaagggttggaatgaaaatccaatctgtgtgagtcccaagtccccttccaccatatggtttccatttcattttgcaatcagattggctgggatatgtctgccctaaaagacagtaagtaggaatatttgtctctataccttaacctgacatccatgggcttgctttttgtatttggaggtgtcataacattataataataatttgattttatttgtacagtggatattatactactcagtctagagatttatgacatcccagtctaaactggatgatagcaatgaagcttcttcaaggagacaagtatgagtaataaggtagtaataagctgaatttctatggagttgctacttctgaattaaaactagttgagattaagtagatattcaaaaatattgctataatcttcacttgaataatacaaacatttattatttttacatatttatttatttatggaacatagatgtaattttaaaacaatattttcaaattatattaaaatatattaaaaacataatacattatcacccaatagagtttttcaaagtaactcagtgttagtttaaaatgtgaaattcaatcaacataattcaccatagaatacagtgtgtatgtcagtataatatatatatcaaaattggaaagcagtaaatttatctttgttttgtaataagatgaaattaaaattttaatgaatttcaactttcattttagatttcggagggtacctttgcaggtttattacatgggtgtattgtgtgatgctgagatttggggtatgaatgaaagtgtgagtgcctgttttgaacttgcaccgagagcaatctcccctgatcagcagagggtaaactaacttgaattacacttgaattttttagtagagcaggtcacaaagggcaaattgtagtccagaggcaaaagtgctcagtggtctaaaatgagcctgccatatcactgagggtacaggtcttcacagaaatatatttcagaaagacgtcaaacccttgtttaaagataaatgtaagctgggtgtggaggcacacgtctataattccagctactcaggaggctgaggcaggaggatcccttgagttcaggagtttaagaccagcctggacaacataggaagatcccatctcaattttttaaaatgagaaaaaaatagataaacttaagcatattaaaattttaaagagtttatttaagcaaacagagattcatggatcaggcagctccaaactgaaagtggttggaggatctactggaggtgtttgtaaggaaggcttttacagggtgaatatagaagtaaagtagagaaattatttgattggcaaaaatgtgggcagttgcattatttgaactatcctggtggtaggtctctcattacccagctaatactcagcaggccacctgtgggtgggctaagcttgtttcattttgtctatgcaggaaccctggccatgggagctatctcagcctaatgctctcccattacaaaattttacaccttctttctgtatcagggtaagtggggatcttccccaggagggttcttaccaccctgtttccctcagcaaaatgaaactgtcccttttgcctctgtaggcaatcttctgaacaaggcattcctaatattcttatctcatcttattttatcttatcctcttctctgtaccttgtttacatgcttctggaacacttgtgtgtcttgcacccatctcctccattatttaggcaatcctaacagaaggccactaggatggattggaagagaactgctggcatattgagccctctctctttgtatctggaactttcataattaccttagttctccatgccaattttgcacttatctttgttctccacttcaaaatacatttacctctgacagcagctgagttcataaaagggaacttgtccagtggtacttatgaggcaggagacatgatatagttaaaattataaactataatcactatatagttatatattatatataatcactatatcactccagggttgaagtgatactcctgcctcagcctcctgagtagctgggattacaggcatgtgccaccacactcgaataatcgtatatgttttaaaataggaatagattttctcagctaaacggaagggaaatgctaaggaaagagtgagattttacttgataattatgtttctgaatgaatcagccaattaataaaatgaaaacaggccaggacagtggtgcatgccagtcatcccagcaatttgggaggccaaggtgggcagatcacttgagtccaagagtttgagacaagcctgagcaacatatcaaaaccccatctctacaaaaaatacaaaaattagccaggtgtggtggctcatgcctgtagtccctgctacttgggaggctgaggtaggaggatcacctgagcctggagatgtagaggctgcaatgagctgtgatcatgccactgcacttccagcctgggtgacacagtgagaccctgtcccaaagaaactaaactaaaatgaaatgaaaacaaacacaagacaaaaattgatggacttattttaacacttagcatgatgaacacacatagataacaatactaacccaatgggtttttgtcagtcaaactcatggtcactagtctaaagaaaataggaataatgactgtgaattaacaaccatttacaacattagaaatacaaaatacaaattatcgtcagatatatcagactcacaattatttgaccttttaagaattcatcctgctctccataatgaataagaaaatactgataactcttttttcccttaacttaatcctttgtgctcctgaatctctgaatttgtgtttacatcttaacactcttttttgtaattattttctgcagcttttttctcttcacttgaggcatctcctatattctctttacacttttccacaaatgactcaatttttttcgtaagcttcattgatgagttccatgtatgtgatgatagtgtaatgataaattatccatgtggtttccctccagtcttgttcattattcaagtgactctccttggtctagcaacaggctaggaggtaactatgacattttgttcaggttaagcaggaagaagaaaacaaaatctacattctcttttttatattttaaacacaagccaacaaataatttggaaagacccatgattagacagggaggattttatgctccttcaagagtaattgagattgtttaattgtatggaggaatgagcatatctcaaggggaattgagaaggtataatatttggatgacagaatcattaagaactggctttgcaccctggctacaccattgcacataggaaatattagggtgcaggggtgcatgcctgtaatcccagcattttaggaggctgaggcaggtggatcacctgaggtcaggagttcaagaccagcctgacaaacgtggtgaaaccccatctctactaaatacaaaaaattagctgggtgtggtggcacatgcttctaatcccagctacttgggaggctgaggcaggagaatcacttgaacttgggaggtggaggttgcagtgagctgagatagtgtcattgcactccagcctgggcaacaagagcgaaattctgtctcaaaaaaaaaaaaaaaaaaaaaaaaaaatcacggccccaccaactttttcacataggatgattaaggattccagagcccatgctacctctaggggctcctacccctgccacaccacacatatatcttgacagggcctgttatagagaagaaaaggcccagtaaattaatatcacaatcattgccacatacccaccaaaagactcagattaaaattttgacgaaattaagtgtcaagaagaatgcgaagatttgggaattatcagacattgtaagactgtcagttgctgtgttaacattgggatgaaacccataataactggtaaaactgaagatatgtttaccctgtaaccgtgatttcacctcttggtttatactgtacataaatacacactaatggtaaccaaatagaaatacaaacatgttcacaacagcatcatttgtaactgatgaaaatgaacacaacccacatgtccaccaacaatgaagggatacacactggtgtactgtagttttatttatttttatttttttatttattttgtgtatataaatataaatttatatatattttttgagacagagtcttgcttagtcgcccaggttggagtgcagtggtgcgatctcggctcactgcaaactccgccccctgggttcaagcaattctcctgtctcagcctccccagtaggtgggattacaggcatgtgccgccactcctggtaaattgttgtatttctggtagagatggggtttcaccttgttggtaaggctggtctgaaactcctgttctgaggtgatccacctatctcggactcccaaagtgctgggattacaggtggcaggcactgcgcttgggcttttttttttttttttttttttttttgagactatcactctattgcccaggttggagtacagggcgtgatcttggctcactgcgacctccatcacctcccaggttcaactgattctcctgccttagcctctcaaataattgggattacaggcacacaccaccacacctggctaatttttttttttaacagagtctaattctgtcacccaggatggagtgcagtggtgaaaacttggctcactgcaacctctgcctcccagattcaagtgattctccagcctcagcctcctgagtagctgagactacaggcatgtgccaccacacttggctaattttttctatttttagtagagatgtggtttcactgtgtttgccaggattgtctccatctcctgaccttgtgatccacctgccttggcctcccaaagtgctgagattacagtcattagccaccacgtggcctaatttttgtagttttaatagagatggagtttcaccatgttggctagggtggtctggaactcctgacctcaagtgatctgcctgcctcggcctcccaaagtgctgggattataggtgtgagccatcatgcctggctggtgtactgttttaatagaatgcagaaacaatgctaagtgtgaatcttaaatacttaatattgagtaaaaggtgccagatgcaccaggatacagacttttactccaattatgtaagagaaaaaccaggcaaaatcagactttactttaggcatataaaaaatgcataataaggccaggcattgagctcaggagttctaaaccagcctgaccaacatgcaaaaccccatctctactacaaatacaaaaattatccaggcatggaggcacatggcccatgcctgtaatcccagctacttgggacgttgagtcatgagaatcgcttgaatctgggaggcggaggttgcagtgagtcaagatcatgccactacactccagcctgggcaacagagtaaggctccatctccaaaacagaaaaaaatatataaaatacataataaaattataaagagaaccaaggagaggatggcagatatccacaggtaatgtggatatctgttatatctgttactaataaggggaaggaagactttaggatcagttaggggcatacagaggacttctcggtggtgatagtgctctatttcttcacctggatagatatcacacagatgtttatttaataattgatgtatccatacctttgtttgcatattttaaaataagaatgaaatagaggaaaggaaggtgaatggaaagagatttctccattcatcaaaattttaaagtcatgtttttcctcaggttcttctccaagctcagtctgaaatgacgaaagcagccaagcatggtggctcacgcctgtaatctcagcattttgggaggctgaggcagatggatcacctgtggtcaggagctaagaccagcctggccaacatggtaaaacctcatctctactaaaaatacaaaaattagctaggcgtggtggtgggcacctataatcccagctactcgggaggctacagtgagctgagatcacaccacttgactcaaaagagcgaaactctgtctcaaaacaaaacagcaacaacaatgacaagggaaacaggaaaacatcctcaataatagaggacttaccaaattgggtgcagccactcatactgtgtcttgatttgtagataaagaaaatgatgaccctccctaggtactgatttagagtgacatttctgtgaaaatagagaaatacttacatatccatagaacacatatatgcatttaaaattgtatatgagcatgacatatacatacatatttgtgtgcatgacacctgcatccttgtatgtttaaatacgatctggcaattgcattctttggtatatacccaaatatttgaaaacttatatccactcaaatcctgcacatgaatgttatagcagcttatacacaactgacaaagattggaagtaaccaagatatcctgcaatagagaagtggataaactaactctgaaacattcatacaatggaatattcttcaggaataaaaagagatgaactaccaaggcatgaaaagacatggaggaatcttaaacatgtatttctaagtgaaagaagccaatacaaaaaggccacatagtatagagttccaattatatggaatactagaaaagggaaaactaggcagatggaattataaaaagttcagtggttgccagaggcttgagcagagggaaggatgaataggtggagcacagaagatttttagggcagtgaaacttttctgtgtgaccctataattgtggatatatgttcttaagcatttgtcaaagcccataaatggtagaacacagagagtgaatcttaatattagccatgaacttaataatatcaatattggctcatcaagcataacaaattaccacactaacaagatgataatagaggaagtgtgtgtactatggtgtgaggtggatattagagctcaatataccttctgctctatttttgtgtatacctacaactgttctaaaaattaagtcagttatttatttatttatttatttatttatttatttatttatttatttttattgagatggagtctcactctgtcacccaggctggagtgcaatggcccgatctcggctcatggcaacctccgcctcccaggttcaagcgattctcctgcctcagcctcctgagtagttgggattacaggcaccagccaccacgcctggctaattttttgtatttttagttgagacggggattcactgtgtcagccaggatggtcttgatctgctgacctcatgatccacctgccttggccttccaaagtgcttggattacaggcatgagccactgcgcctggccttatttatctttttgagacagggtttagctctgtcactcaggctggagtgcagtggtgcaatcatggctcaatgcagccccaacctccagggctcaagtaaccctcccacctcagccttctgagtagctgggaccacaggcatgtgccaccatgcccagcacatttcttagacctctgaaaagatgctcaacaccgtatgtcactaggggattcaaattaaaacaacgatgtgataccattacacatctcttagactggcttgaatgcaaacaccaacaccaaatgctggtgaagatacggagcgacaggaactcatctctatttctgctgagaatgcaaagtgggtcagccactgtggaaggcagttttgcaagttcctgccagactaaacatacgcttaccatacgatccggcaaaaaaatgaaattttaaaaatatattttatatacttgaaacatatacatttaaataaatatatattttatatatattttaaaataatatatatttttattttttgtagagacagtctctacagaccatagcctgcagattctattaattttaaaagcattttaaactcttgaacaagaaattatttgaagagtgaaaaataaaatgatagagtattgattggtaaattccaaatgttatatattacataatctggattaattttaaattccaaaaagtgcaactttaaaaaatattttaaaaatttcctaatctgaggtcaatactagttcaacacattacattcaagagctgatttcagaggagacataaggtcaacaagttcttaggttttgactttgttttctgactatctgtgtttgtgaatggtgaatttttagattttgttcctttcttcttagggtattgactaatattttattaagccggagagacagtaaattagaattatctgtttgtccattttatctgttataagtatttcctccaaattcacttatctaaagtttttggtttatttagtcaggtgcagtggctcagcctgtaatctcagcacttttggaggctgaggtgggggatcgcttgagttcgggggttcaagatcagcctggccaacatggcaaaacccagtgcctactaccatacaaaaattatttgggtggtgggtgttttggctcactcctataatcctagcactttgagaggccaaggtgggcagatcacctgaggtcgggagtaaagaaacagagagtaaagattttctgaaaccaaaaagtctgagaacagctgctcaatatattcattcaacaactatttgtctccttaccatgtgcatggtacagttctaggctctagggataaatagcattgaacaaaattgacaatatctcctgctctcatcaagtttacattctagtggacataatgtaagaacagagatgatttgtcaaaaagcagtccgggcacagtggctcatgcctgtaatcccaacactttgggaggccgaggcagggagatcacttgaggtcaggggttcgagatcagcctggccaatatggtgaaaacctgcctccactaaacatacaaaaattagccagggctgggtgtggtggctcacccctgtaatcccaacactttgggagtccgaggtggtttggatcacctgaggtaaggagttcaagaccagcctggccaacatggtgaagccccgtctctactaaaacacacacacacaaaaaaaaatgttagccaggcatggtggcagatgcctataatcccagctacttgggaggctgaggcaggagaatcacttgaacctggggggcggaggttgcagtgagccaagatcacaccaatgcactccagcctgggtgacagagcgagactccatctcaaaaaaaaaaaaaaaaaagttttaagtgctatggaaaaaaaagggaagtggtaaatagtttcaatttcagataggatgatctctgacaaggcaagaatcatgttaagacatgaagaaaattaatacaatgatccttacaggtatatggagggagagcttcttttctttccttttctgttttatttatttatttatttatttatttatttattttttagacagagtttcaccgttttgcccaggctgcagtgcaatggcaccatctcagctcattgcaacccccatctcccgggttcaagtgattctcctgcctcagctactcccccaagtgaaaggtgaccaagagagccattgaaaatagtgagagtggccgggtgcggtcccagcactttgggaggccaagatgggtggatcatgaggtcaggcattcgagaccaacctggctgagagggtgaaaccccgtctctactaaaaatacaaaaattagccaggcgtggtggcgtgcccctgtaatcccagctactctggaggctgaggcaggagaatcacttgaatctgggaggtagaggttgcagtgagcccagatcatgccactgcactctagcctgggtgacagagcaatattctgtctaaaaaaaaaaaaaaaaaaaagaaaagaaaaggaaagaaaaagaaaatggtgagagcaccatgtttgaaaagtggtccaggcactggggtaaggggtgagtgtcagccaagtcatcagctatcagaacaggaagccatcaggtaatatatcaagttgatatattgagaaggagcaggatctacctattatataatatagagataagcactcagatatatagattagaaatagtttagaaaatttagacatttgattattcgggaagtagatctgggagtattggagaaacagggtcggggagtagactgcatggaaagctctttcttagtttgtgatttttcatttatgcacataggtttcttacataacatggaaaattcaattaaagaagaaacaacattgtgttctgaggtcccaaaggtgtagtgattaattagaaagactcacaaaatcgagtgaagctgttttactcatagtttattacaacgaaaagatacagattaaaatcagcagcagaaaaaggtgcacagggcagagtccaggagagacaaagcacaagcttccagttgtcctctcccagtgacatcgtgtggacagtgcttaattcacccagcgatatttggcaaacagtatagaatatactccccaacaaaaagcttacctgagccttggtgttgagcattttactggaggttggtcacatggacaagagcacccatttggatgacattagtttctccgtctccacccttcccaaggtcaagctgagactgcatggtccaaggtccccataataaatcacgttgttaactcccagataggcaggagagtccgaggacttagaggttatttcctgggaactaggatagagtcacaccattctttggagtatgccaggtttgggcaattcaggcctactaagtttccttgactgcacacaagtgatagtatgtaggaaatgagtagttgcatatattgctggtgaaaatacagtgttatataaccctttggaaagaaatcaagtgtgtagcacataaacatcatatttggtttgtttttgtttttgtctgagacagggtctcactctgtcacccacactggggtgcaatggcatgatcacaactcactgcagcctcgacctcccaggctccagctatcctcccacctcagtctcctgagtagctgggaccacaggcacctgcaagtacacccagctaatttttgtgttttttgtacagatagggtttcaccatgttgcccaggctgatttcaaactcctgggttcaaacaatcccctacctcagctccccaaagtgctaggattacaggagtgagagccactgcacccaacctatatttgtatatacattaaattgtatatgttagactgggcacggtggctcacacctgtaattccagcattttgggaggccaaggtgggtggatcacttgaggtcaggagttcgagagcagcctggccaacatggtaaaaacccatctccactaaaaaaacaaagttagctggacatggtggcagatgcctgtattcccagctactcaggaggctgaggcaggagaaccaagcagtggaagttgcagtgagccgagatcatgacactgcactccagcctggatgagagagcaaaactctatctcaaaaaacaaaacaaaaaaattgtatatgttattgtatgtatgtgtatatattaagttgtatatacccatattaaatatatatacatatattacactttacacacatacacttgtttcctcatgcaatttgtttcagcagaagtaaaaactaacaaagttataagtaaaagaatatttacagaagcactatttttggtggcaaaagtactttaatatcttaaatgctcatataatgaaagatactttaactcttacaaagaatgtgtcagcattttatctactataaaggtatcctaatatctttatacctaaagtgatatatgtggccaatttttatattaaaaaaggagaatgctttataattaaagaaaaaagaaagaaacgttatataatagccctcccttatctgcaggagatgtgtttaagacccgcagtggatgcctgaaacttgggtagcattgacccaattgctttcaatcagaacacatttctgtttgatttccactcacaaatttaatgcctttttcatcttaactaagcacttatcacacatatggctgtactttttagagcttggggtgcaacaaacaagactaacagaaatttctttttccttcttacattttcaccgctagaggatttgttcttaccatcgatcttagcaacctgagcacacgacttctctctttttctttctttcttcctttctttctctttctttctttctctctttctttctttcttctttctttctttctttatctttctttcatttttctttttttctatttattttatgtatttacttatttattgagatggaatctcagtctgtcatccaggttggagggcagtaatgcgatattggctcactgcaaacttctcctcccgggttcaagagattctcgtgcctccgcctcccaagtagctgggattaaggccctcaccaccgtgcccaaataatttttgtattttttgtagtgatggggtttcaccacgttggccaggttagtctcgaactcctaacctcaaaagatccacccgcttcagtctcccaaagtgctggggttacaggcatgagccaccacgcctggcctgtatattctgttgtttgctggccaatacttacatgaatcttggagaacatcatggaaagttgctcatcatcttgttaactggttatttcaagagtggaactggagggggaatactgcctttcctgtgtatttatttgtaatgtttcattttcattatgaacatgtattattttaatatgtttaaatattaataaagacaggtaaatatatgtaattttaattcaagctgaaatcctcaaggaaatcacatataattaaatagatggaggaaagaaaacatttaaaatccctgaaggaaaaggagggaagtccgggcaaggaggctcatgcctatgtcagcattttgggagaccaaagcaggcggatcatttggggtcagaagttcgagaccagtttagccaacatggtgaaaccctgtctctactgaaaatacaaaaattagccaggcatgatggcatgcgcctgtaatcccagctacttggaaggttgaggtgggagaatcgcttgaacctgggaggcagaggttgcaatgaaccgagattgtgacactgtggttcagtctgggtgacacagcaagactctgtgtcaatcaatcaataaaaggagggggaaaaacacaagtaaaaaataagtgactcaaaagtagcaattcaccataatgcctaaatttgtgggattggcggggtgtgatggctcccgcctgtaatcccagcactttgagaggccaaggtgggtcgatcacctggtcaggagttcgagaccagcctgaccaatattgtgaaaccctgcctctactaaaaataaaaaatttagcaaggtgtggtggcggacacctgtagtcccaactactagggaggctgaaacaggagaatcacttgaacctgggaatcagaggttgcagtgagctgagattgccacactgcactccagcctgggtgacagagcgagactcccttcaaataaataaataaataaataaataaataaataaataaataaataaaaacactttgtgggaccaattccaattgagtccaggggagcacacactggcaacaaacatcctccatcaggtcccttcagggtcgagagagtgcatctggaacagactgggaaactccagcaggcaaagtaaggtgtcaggaatagacaccacctgacacattctccatgttccctccacccacccctctccccaccagtcttccatcgggctccaattctgcactctccccaataacctcagattgaaacattgcaaggaagacaccgatactcaaagtcacaggcttaggaatctgagctacaaagaaaaatgagtccctgctcccccaactgcatggtactcccctcagcactgctgccctgcacctgccccctcctccataatttgaactgtcctcacagaagctggagagatggcccgcctgtcaggaaagagaggaccagcatgtggcaaatgcctggggtatgtaggagcagatggtgagattagcacaaggatgtaagaaacaagtggctctcagaccaaagaagactctgcgggagacagaacattaagccttcatagaggcgtgcgctggacagcagctccccagttactgaaacaattatctgagaaaggctctgagctgacccgaaacgcccttggatcccatggcaacgcctcagcgtctggcagtaataggcttctgtacccagaatctctaggtctggaggtcccaactccaccagcctctcacagcccagaggtacctcccattggcgcctgatgggtttgggaggctgttcttccagctgtgacagatccagcctaggagcgctcctgggtcttctcagttgtttcttcccgcacacctgccactcgaagccacaacccacttgcacgccaccttgaggacaccttaaaatgaccgtctagatctgaacctcgctgagggaatggtcagttttactcccattagatggcttggcccaaaggacctagcaaccacccagacaaaaatttcttcctaaaagctgcatgtgtctgtggtctctaagaggcaaaactaaaccctaaagaaaaagctaacccacccccacctccactgcaaaacaaaaacaaaaacaaaacccaccaccaacccacccttcatgtgaggagtccttgagaagggcctccccagccaggacaaggcaagggaatctgtgcacttggccagacccagaacacacagtgtcagggacctgacagtcacactctgaccccatagaatttccaccactgacacacagatcaggatgtgtcagcctgagagatgactccacaaatctggctttcacatattgattccacacacatcccatcactgacaccagattccctcatcactgaccctaaatacccacaatcattgattccatggacctcatcactatcccaaagaccacccatcactaatctacagatcgtcatctctcacctcagggacctcacagattccccatccctgattccaggatctatagaacttcatctcttacccccacagacctattaataaaaggatacattcataggagactgtgttgacccttttacacacccattgcctgtgtgtgccgattaatggacttaggtaaactttagcgttttggtaggcaacgcaatttttcaatgccttttctttctttttcttgtacatctttaaaggccttactccagtaagtgtgcattgcagtttattaatgcctatcccttaatgagtccttgtcatgcatttttgttattaatcataattcacaattcttataattcagagacaccagagattcacataagaagaatggcattgagtttttatttatttatttgtttttttctgtagattatcaaattcattcatttgtatcaagtcactaagtgtatactttgttttctaaaaaaaaaaattccaataattttttttttaagacaggctatcgctctgtcacccagactggagtgcagtggtataatcatggccactgtaacctcagcctcctgggctcaagtgatcctccctcagcctatgtagtaagctgagaccacaggcatgcaccaatatgcccacctaattaaaattttttttgtagatatgtgtgtctcactatgttgcagagactggtcttgaactcctgggctcaactcattctcccaccttggcctcccaaagtgttgagattacaggtgtgagccactgtactcagctgataaaatcttaaaaagaggaaaatactttggggcctaatgtaaaatttccactgagatgatgcgtcagaaattaaggtagaataagatggccctagggcatcaaaacaacggaaactaaatcttgggctgggtgcggtggctcacgcctgtaatcccagcaattttgggaaccaaggtgggggactcacttgaggtcagaagtttgagaccagtctagccaccatggtgaaacgctgtctctactaaaaatacaaaaattatcctggaggttgcactgagccaagattgtgccaatgcactccagtctggacaacagagggagattctgtctcaaaaaaaaaaaaaatagaagaagaagaaacaaaatcttaatttcttcatcaaatgtaaaaactatggactggactctggaggaataatacacaaaaagacacataggcgcttttttttttgaagttttattgagaaatattgataacataccacagaagccactgatttaaagtgtaaaattcaatgtttttcagtatatttgcactgttatgcaaacatcaccacaataaattttagatcattttcattaccctgaagtaaacaccatatccctccatttccccccaactcccctaaccctgggccaccacaaatctactttctgcttctatgtattggtctattttggacattttatttaaatggaattacataacatgtggtcctttgtgaccggcttctttcacttagcataatattttcaaggtttattcaatcttgcatgtgcaaagggggcactttacataaggataaacctgggatggggggtacttactgattgatttggaaacttccctccaaaattgtaaagggtttcaaatagaggaaaaacctattcaggctaaaatcctgttttcagcagtttgtaatgtggggttttattgcaaagaatggcaagatttttaggcttattttctgaaaattctccctgtgtttggggaacagtcacagaatgtggaggaatgggcttctaggctctgtggctggagattcgcgtccaggagaactcaggtccgagggtaggcagagaaaaacagtgtaagagtgccaacagaatgctttgaaatggaaaattttaaatgttccctccaaaaggagtcccagataaccacacaaaagaggactttgctgggcaggtccattgcaattgttcaataacaagacacagacagactgggaaagaaggaagtttatttctgcagccacttacagggagaagcgccaggtaattcaccagatcaactcaaagttacaagttttttttttctagtgcttatatacgtcttaagctccacgtgggattgcacctacaagtaggagtgtttcattcaatcaacatcttatctttaactcgggtctagcgtctggaaagatttctctagagtcttggaaagtttctgaatcttaagacaggccgaggtgaatgtgtaccaatgctatcattattcgatcagactttagggtctgagaaaacccaggtggggtctcaatgggtttgttttcacattccatccctgatactcaggcacaagtttctccgtttctttaacgttaacttatgcattcatcaaaattatagtaaagggttagtagaaactgttctggttgctattggaaacctggcctgccacactgccataggaactgaagcccactacagaacattgaaaatgcctgcaaacactgactttactgaccagtcaattaaattgcagaaaagcaagctcacgctgcctccctgatcctccagaattgctagttagaaacgtgcacattgtcctaggttcagttttgcaaagatggagcctggcagtgaaagcatttgtttgagttcatgcattaaggtttgctttgtctatttcttttatatttatttatttgttttttttttttttttttttttttttttttttgagacagagtttcaatcctcttgcccaagctggagtgcaatgtggcggtcgccgctcactgcaacttccgcctcctgtgttgaaacggttctcatgcctcagcctcccaagtagctaggattacaggcatgctccaccatgcccggctaatttttgcatttttagtagagatggggtttcaccatgtaggccaggatggccttgaaatcttgagctcaggcaatccacccgcctcagcatccaaagtgctgtgattacaggcatgagcaccctcagccggcctattttattttaagatggagtctcgctctgtcgcccaggctggagcgcagtggcacgagctcggctcactgcaacctctgcctctgggattcaagcgattcttgtgcctccgccttacaaatagctgggattacacgcgcccaccaccatgcctggttaattgtttatttatagtagagacagggtttcaccatgttgaccagactggtctcgaacttctgacctcaagtgatccgcccgcctcggccactaaaagtgctggaattacaggcgtgagccaccatgcccggccccatttcctttattttatttattatttcgagaaggagttttgctcttgccatccaggctggagtgcagtggtgcgatctcggctcactgcaaccttcacctcctgggttcaagcgattctcctgcatcagcctccggagtagctgggattacaggcgcatgccaccacgcccagctacatttcctttattttattttttataatttactagcctgtttgttgataacaagactggcagtgcacaagtttgtgtctcggtgctcaccgggaggcgggcatggaccaggtgggagggtctccagcacctggtacaactctccaagaaagtgcaggaaacggcactaagggtggtagtaaagttttggtttggcgaggcgcgtaggcgttccagcgcagaaatgcgcaggaaaggttttgctgtgcttgtagggaggtcatccccaagctcttcttattggctttcagtgagacgaggtcgcgcactgcactccagcccgggctacagagtgagactctgtatccaaaaaaaaaaaaatagtgaatgaatatctattgatgcatgaagtggctgcattaaaggaaaactagccaagaaaatacaaggcaaaaaaaagtcaaggatcagtatgaaaaataaatatattttaaaagatttgtttttaaagcaacaacacgggtttaaattttaaagtgaaagaagtagctccaagatagaggaaacaggatggcttctgaagaagggaatgttattctttgaaatggaaagaaattatgacaagagggtagcacagactgaagaggtggaggtaaaagggggttctcggccagacacagtggctcacacctgtaataccagcactttcggaggccaaggcaggtggatcacctgaggtcaggagttcgaggccagcctagccaacatggtgaaatgccgtctctactaaaaatacaaaaattagctgggcatggtggcaggtgcctataatgccagttcctttagaggctgaggcaggagaatcgcttcaacctgggtgcggaggttgcagtgagccaaaatcgcatcactgttctccagcctgggtgactgagcaagactctctctcaaattaaaaaaaaaatttaaaaaagagtgtgtttgttgggggggggggtggtatcttgacttttctccatgtgtcttaggccacaactcttacgtgggaccttgcagaagagattccccaaccaatacctttacggcgctgcctccctgatgggctgggttctaaacagcagtgccttccccatctgctcagtccttactcacctgggcaccatcctcccggtacgtcccttgaaaccatccagggctctttcccttgctccagtaaggaaatcacatcaggctttgggatagagagacctgtttataagaaaagaagtaaggtggccaggcaggcatagtggctcactcctgtaatcccagcactttgggaggccaaaacaggtggattgcttgaggtcaggagttcaagaccagcctgaccaacatggtgaaaccccgtctctactaaaaacacaaaaattggccaggtgtggtggcgggtgcctgtaatcccagctactcaggaggctgagacatgagaatcgcttgaacctgagatgaaggttggagtgaaccgagatcgtgccattgcactccatcctgggtgatagagtgagaattcatctcaaaaaagaaagaaagaaaaagaaagaaagaaagaaagaaagaaagaaagaaagaaagaaagaaagaaagaaagaaagaaggaaggaaggaaggaaggaaggaaggaaggaaagaaagaaagaaaaagagagaaagaaagaaaagtaagacatactcgtgctgttcctgaattcaaagttagtcccttagtagtcacgaaggactagaggaaggtgtaaaggtctgaagcatggagaagatggagggaccccaaagagctgcccatctattaatctacaaaacacaaaacaattccctaagcagcaggtgaaaagtcacccagacaagtggaagctacacccaaaattcatgagttatttggggatagacatccttacctagtgagaccaggctgctatagttctccatcattacatctctgtatcagtccttctgagcagcgtccaggcactcccattcctcctgagagaagtctatagacagatcctggaacatgcccaacccctgaaatgacaaacccaggcagcactgttgaaattaaaggaaagatttttaagatgaaggaagagatggaagggtgctgaagcatggagagaatacagtgagcagaccagctaggctgagagtggggaagagtaaaaaaattagtgtaacttcaacaaagtacctccatgttcatgaatattcctgttgtggccagcaaacctccttcatagaaagggacattcccagtattccatggttagagctgggaatgaataaatacattgatatatgatttcccaaataaatgaaatagagttgaaaagcacacagcaagctgtaggcctggcaaggcttcaagaatattacagtaaacatctgatatgcaagttactatttacaacaaaagcttaataaataggcacttcccccttaccattttctttcttgttttttttttctcttgtttcatttttttgtttttgtttttgttttcactttgagacagggtctcgttctgttgcccaggctggagtgcagtggcaaaatcacagctcactgcagcctcaacctcccaggctcaggtgttcctcccacctcagcctctgtattagctttgactataggcatgcgccaccatacccagctaatttgttttgtatttttagtagaaacgaggttttgccatttgggcaggctactctcaaactcctgagctcaagcaatccacctgtttggcctcccaaagtgctgggattacagggatgagccaccacacccagccttgtctcttttcttaaaggaagactgtatctttcaaaaatatctacaaaaagtttgaaaacctctattggccgggcacagtggctcacacctgcaaacccagcactttggtaggccaaggcggatggatcgcctgaggtcaggagttcaagaccagactgaccaacatggagagaccattttagtctctactaaaaatataaaattagctgggtgtggtggcacatgtctgtaatcccagctacttgggaggctgaggcaggagaatcgcttgaacctgggaggtggaggttgcagtgagccgagattgcaccactgcactccagcctgggcaataagagtgaaactctgtctcaaaagaaaaacaacaacaacaacaacaacaaaacctctattgcactttgataattagtacttccataaaatagtatagatagtactttgataattaaatgtacattggctgggtgtggtaacccacacctgtaatcaaagcactttgggaggccaaggcaggtgaattgcttcagctcaggagttcaagatcaacctgggcaacatggcaaaaccctacctctacaaaaacatatgtcatatacaaattagccagatgtagtgggacatgcctctagtcccagctacttgggaggctgaggtgggaggattgcttgagcctaggaggttaaggctgtggtgagctctgatcctgccactgcactccagcctaggcaccagagcaagatcctgtctcaaaaaaaaaaaaaaaaaaaaaaaaggccaggtgtggtggctcatgcctgtaatcccagaactttgggaggctgagtaggacagatcatgaggtcaagggatcaaaaccatcctggactacatggtgaaactctgactctattaaaaatacaaaaattagctgggcatggtggtgcaagcctgtagtcccagctgcttgggaggctgaggcaggggaattgcttgaacccagatggtggagattgcagtgagccaaggtcgtgccactgcactccagcctggtcatcatgactgcgtctcaaaaaaaaaaaaaaaaaaagagtggtatcatggtaggaataaactgcacacaggtcagacaaaagttacaaggccatctgctagtataaacaagtttcctgtgagacacctggtcatgggtcagatacttgagcattaggctgtggtccagaaaaaagaaatttctggtgaaaggctactctaaagacccacaggcccctcccctagagccccattagagtgaggtagagtttatagccattctcctgagagacctcaagacccaattagaagaaaactataacatttgttatatagacggcattttccaaagactagttcaaagatgaaagatatagtcttcctttggatataaaacaaaatctcaagatacaccaaaactgttttgcttttactgaataatttttgtgcatatgtgtttagctgcaagtggctaacaagctgtgattttctttcctttcctttcccttttttttttttcttgagacagccttgctctgtcaaccaggctgaagtgcagtggcctgattttggctcactgcaacctcagcctcccatagctgggattacaggtgcctgccaccacacccacctaatttttgtatttttagtagagatggggtttcactgtgttgccgaggctggtctcgaaatcgtggcctcaagtgatccatccacattggctcccaaagtactaggattacaggcatgagccaccatgcctggccaactctgattttttaacttgtctcgtgtattaggttcatactaggaaaaaaacaggtcagagccattggagccacgtgtacagatgtgcagtagctctgctagcaacactgctgcttgcttcagctcttaagacagatgaatttagcacgtgtctgcccttgctctagctgtctctgattcaccccaacagatgcacaatcatgccactccgttagattcactttggatatcccattattagattaaaaccagcaggccaaaaagataacttgaggaaatgatttcacatccacagtgttctcatagggccagtatcatttagacatgtcaggaccgtggttgcaggggaaagaatgaagtgtcatccttaactggccatctaatgtcatcagcatgaacaggaggactttataggatattatctgatgttttctgaatattaccttacaaatgctgctttatttatagcttaagagcagggaccctgtcttttaaagctttatacatcctcaagtaaaggtttttcatattaaatccattaataatatctaaaggccgacctggaaattccatttctaagtattcatccaaagtaaagattttttttctttttttgagatggagtttcgctcttgttgcccaggctggagtgcagtggtgtgatctcggctcactgcaacctctgcctcctgggttcatgtgattctcctgcctcatactcccgagtagctgggattaaaggcacgcaccaccacgcccagctaattttgtatttttaggagagatggagtttctccatgttagtcaggctggtctcaaactcctgacctcaggggatcaacccaccttggcctcccaaaatgctgggattacaggtgtgagccaccatgtcctgccaagaattttttttttttttgagacaagtctcaatctgttacccaggctacagagcagtgaggtgatcacagctcactgcaacctctgcctcctgggttcaagtgatttttgtgactcagccatcaaagtagcttggaatacaggcacacaccaccatacccggctaattttttttggtatttttggtagagagcaggtttcaccatgttggccaggctggcctcaaactcctggcctcaagcaaggccactttgggaggccaaggtgggcagatcacctgaggtcaggagttcaagaccagcctggccaacatggtgaaaccctgtctctaactaaaatacaaaaggtagccaggcgtggtggcaggtgcctgtaataccagctactcgggaggcagaggcaggagaatcacttcagtctgggaggcagaggttgcagtgagccaagactgtgtcactgcactccagcctgggcaacagagtgagactctctatcaaaatataaataaatataaaaatacaaaaaagccgggcacagtggctcatgcctgtaatcccagcactttgggaggccaagacaggcagatgacttgagatcaggtgttccagaccagcctgtccaacatggcaaatccctgtctctactaaaatacaaaaattagtcgggtgtggtggatcactctctaatcccagctacttgggaggctgaagcaggagaatcgcttgaacctgggaggcagaatttgcagtgagcagagttcatgccattgtattccagcctgggcaacaagagcgaaactgcatctcaaagaaaaaaaaaagaaagaatacaaaaaattagcggggtgtagtagcgcatgactgtaatctaggctactgtggaggctgaggcaggagaattgcctgaacctggaagatgaagattacagtgatgagactgcaccactgcactccagcctgggtcacaagagccaagagcgagaatccatctaaaaaaaaaaagaatttctatttgggggacaaaataaaagaaatggagtgaaagggatgtaaagaaattgaaagtcaacaggctaataatgccaataaataatgatggagcaaagaaatcagtattggccaaataaaaccaatgtgttttttaatattttttcaaaatttagacaaagctttccagtacactgagacacttctaatatcaagactttaatattgcctgagtacagtggcttatgcctataatcccagcattttgggatgccaaggcaggaggatcgcttgagcccagaagttcaagtcaagcctgggaaatatagggagacatagtctctgcaaaaataaaataaaataaaataaaataaaataaaataaaataaaataaaataaaataataaaataaataaaataaaataaaataaacaaaataaaataaaataaaataaaataaaataaataaaatgaaataaaataaaataataagccaggcatggtggtatacatctgtgagctgtgacaaccccactgcactctaggatgggtaacagagcaagaaagaccctgtctcaacaaaaaaactagaatatagaataaatgacatttgggtaagtggaatattaggtgttcaataaacacaggttattccctccctatctccacagaatcatcaatttttttaaaggagaagttttgattagaacctaaaaatatcaatacttctctttccaaaaaaggaaggaggatttaaatataacaatttcttggttatttctatttattttcattgttgcttaatattattcagtaatgaaaatgcaattgctctctttcaaacatagttttaactagttgcacaaaatgccaccttgtagtctgaagtacttcaaatttccctatctatgaaagctaaatttggatattatcatctcaaggatattataatctctgtgtttaaatctatctagggttctaccttttctgtaagccttagtgaatctcactatagtcctccttccctttaaaaatgcagtgataggccgggtgcagtggctcttccctgtaatcccagcactttgggaggctcagctgggaagattgttggagctcaggagttcaagaccagactgggcaacatggcaaaaccccatctgtgcaaaaattacaaatattagcctggcatggtgccatatgcctataatccagctacttgggaggctgaggagggaggatcccttcagccccagaggtcaaggctgcagtatgccctgatcctgccactgcacttttggaggccaaggcaggtggatcgcctgagatcaggagttcgtgaccagcctggccaatatggtgaaaccctgtctctactaaaaatacaaaaattggtcaggtgtggtggtgggcacctctaatcccaactattcaggaggctgagacaggagaatcacttgaacccgggaggcggaggctgcagtgagccaagattgcaccactgcagttcagcctgggcaaggcagagtgagactctgtcaaaaaaaaaaaaagaaagaaagaaagaaagaaaaagaaaaaaagaaaaagaaaatcagtgataggtgagacagctcatgcctgtaatcatagaactttagaggcagaggtgggaggatcacttgaactcaggagttcaagaccagcccagataacatagtgagtcttcttatctactgaaaattatttttaattatgccacagtgctagtgtgtgcctctggtttcagcttatttggcaggctgaggtagaaggatcacttgagcatcggagatgaaggctacaatgagctgagatggtaccactgcactccagcctgggagagagagtgagactctacctcaaaaataaaaataaatacataaataaaaattcagcgatggagttgatggatttgaggttgaggacccccaatgtgaacccatttggaaaaaactcaacctgtgttcttcctctgcttcacaccaaaaccacaacaatctacccagaagacttctgtggcctcaaaatatgagatttcttcctatcagcaagcaaggaatcagttctgcagcagacaacagctgggtatccaccaattcgattctgacactatctaccatgagatagtgtcaccccaccgattgagagctcagcccccaaaactgcccccctttcagacaccagtcacaagtcctagcctctggaacttctgactgacagatttaatttggggttcctacgatcccctctttgggtttgattaatttgctagaataaaatggctcacaaacctcagggaaacacatttactgtttgattacaaggatattccaaaggatatagatgaagagatgcctagcgtgaggtatgggggaaggggcacagagattccatcccctccctgggcacgaccctccaggaacctccatgtgttcagctctctggaagctctccgaatccactccttttgggtttgtaaggtggcctcattacataggcatgattgattaaaccattagccacttgtcatcaacttaatcctcagtcccctccactccccaggggtgggagggtaggggctgaaagtcccagccctctaatcctgccttggtctttctgatgaccagcccacatcctgaagctatcggtcaatccctaacatataaaaagccaaagtctgggtgcagtggctcatgcctgtaatcccaacactttgggagcccaaggcaggcagatcacttgaggtcaggagttcgagaccagactggccaatatggtgaaaccccatctctactaaaaaagaaaacaaagacaaaaattagccggccatggtggcacatgcctgtagtctacttgggaggctgaggcagaagaattgcttgaacccaggaggcagaggttgcagtgagtggagattgcaccactgcactgcagcctgggttacagagcaagactctgtttcaaaaaaaaaaaaaaaaaaaaaaaaaaaagcaagcccttaggacattccaaggattttaggagttgtataccaggaaatagggacaaagaccaaatctgtatttgacaaaaatcacagaaccgtatgagtttttaattcaatacagacatggaaactggcccaagcatttactcacagatgactgggtgaatcactggtcctatgggtacaaattattgatcaaacccccaatctcattcctacccctaaaatatagcaaagtgcaagatcttattacctatttggactgagattaacaccatcccttaaattgcatggctttcaatcccagggctatggcatgtgatgccacatagaatatgcatgaatcttctctccagcaattgagttgttaggataaaggctcttgtctttgccttctttccctcacagccaagaatgttaaggaacgtggacacaaaggatgaggttggaacagaagtttaatatgcaaaagaagaaagctctccccagcggaggggggacccgaaagagggttgccaactaggaggctgaatctgggggttttgtgaactgggaaggggaagaatgtgctcactagtctgtgagctgtcttggagaaagcacaacttcgcttggcccgggaccttagcttgggaccaaccagaggctgaagtgaaattttggcccaagaacaatcaggggctgaagtgaaagtttggcccaggaccaatcaggggctgaagtgatgattcatagaggcttggctcacagtccaaagcatgtccagaaaaggaaagtggtcaccagagcctgttagtccaagctgcaccgatttgtaagcccccaccgtttcacagaccctggtcagagggaaacattccactggggtttgggctgcgagaaacatcctccccaaccgcctgacttccttatcacatcctgctggggaaaggcccaagaaacatccttatcaacattctcccaggcaacaagctatactgcccagatccctcctgcccaggcctataattactccagcctgtaagcggcagtgggctctggcatttagttggtcccctccatagagccgccaactctctctctttctttaaccttcaccttcccttcaaaatctaacagagcccaccatatacatgcccacaaaaaagcgactatttcctggaagcccgctggtcacacaaaggacaaaggcatttctatgttgggcctcggtcccttatcaatgcagctgaggaatgtctttaggacaaccccctttgctagttttccttctctgtgcctgcagcctgatttttcaggctgtttctctgttgaaaggagttttaccaaggacccgctctaactccctaaagggttttttctctcaaggggacacacaaatttccaatcgcacacatgcctccctatatccacttaccctctgcctcacagccaatcacactctcctctctcacacagaccacggggccacacaagttgcacctgcacagccacagacctgcaactcatgcacacacagtactgcacacacacgcaaagtcacacacccaccctgggacacgcagcccccactacacagtcaccggttgtccacatccgcacacacaacgcggctcgtccaggacacacacatccactccgagcgcgcacagtcacaagcgcccacctgatcacccagagtcagcaccacacagccacagtcacagaccacgaagacccacggcaaccatcgcaatcacacacgcaaactcctctcctcagccctccacacacaaaaggaccagagccggattcctcatcctcagctttctctagttccgctcggggccggcctggccaagttactccggactccaaggcgtggcagcagctaattgggcacagcgaaagattctgccacctggctaagaggaagccaaaatctcgcgagacatggtattggcccgcagaatcctccgggaaatgtagtccagagcccgactgctcccctactaaaaatataaaaattagccgggcctggtgggcgcctgtaatctcagcttcttggaaggctggggcagcagaatcgcttgaacccgggaggtggaggttgcagtgagccgggatcgcgccgttgcactccagcctgggtgacagagcgagactccgtctcaaaaaataagtaagcagacatgtctgctgcccacatgaggtttacattctagtctggagaaaaaaaaagattttaaattaaaaggggaagatgaagtaattttatattgtgataaatactatgaaatatatcaataggtggtataggcagtaacttgagggatacttcccgtagcattgataggacgggtgtctgagagataaccctcgagttttggtggtgaggagccagcagtgtggaagggtattccaagcagaggcacagttacactgaagaccctgaaaaatcagagagcgcttggagcgttccggaaacagaaagcagcctggtgtgactgaagcttagcaagtgagtggggaattagtttagatttaggatgtagaagtcagcattttccgattcatatgagaaaatgatagtgctgagattacaggcgtgagccactgcacccagccccaaaccaagtttttatagcagcaagaatagatactctggtatggtcagcgtctaaagattttacaaacaatatctcttcttttagtttgcagtcattattgaaataacaaacatgtcctattgtcaggccttactctcagtaactgatttcattgatctgaataggaaacttacttgattaatcagctactctttggtattacctgacatctcattaatgcatctttgaattgaattattgctcaataggagtgattgtgaaatagtggtaatgtgttacatcactattgaagttaccgtctctcatgtgagtcttgtgacagtttcagcaagtacaaagcactatggggttttacaatgatttctgtaatcttttctttttttctttttttttttttttgagacagagtctcgctgtgttagccaggctggagtgcagtggcatgatctcacctcactgcaagctccgtctccaggactcaagtgattcttctgcctcagcttcccgagtagctgggattacaggcgtgtgccaccacgcccggctaactttgtatttttagtagagacggggtttcaccatgttggccagaccggtctcaaactcccgacctcaggtgatgcgcctgcctcggcctcccaaattgctgggattacaggcatgagtcaccacgcctggcctatttctgcaattttataaggcaattatttcatcataatttgtttgcttatcctttttttttttttttataccgagtgttgctctatagtccaggctggagcatggtgctgcaatctcggctcactgcatcctccacctctcaggttgaagcgagtctcctgcctcagcctcccgagtacctggaattacaggtgcacacagcatgccaggctagtttttgtgtttttagtggagacaagatttcaccatattacccaggctggtctccaactcctgggctcatgtgatacacccacctcggcctcccaaagtgttgggattacaggtgtgagccacctcaccccacggcttgtccttcttaaataagaagtaacagtgttacagttcaaaattctattttaaactttttaaatattctgtttcttgactttatcaggatgtttcttttattgatgatccacaaatcttgatttcatagccgtttgtaaaaacaaacaaaaaacaaacaaaaactattatttataagaaaaaagctgttttgagttaaatggggttttcaataaaactgtaagctaggctgggcgcggtggctcacacctgtaatcctagcactttgggaggctgaggtgggtggattgcctgaactcaggatttcaagaccagcctgggcaacagggtgaaaccccgtctttactaaaatacaaaaaattacctgggtgtgggggcaagtacctgtagtccctgctacacgggaggctgagacaggagacttgctagaacccaggaggtggaggttgcagtgagccaagatcatgtctgcattccagcctgggcaacagagtgagtctccatctctaaaaacaaaaacaaacaaacaaaaaaacaaaaccagttggccagatattcattcattccgatgtagtcaacacttttcattttcaacacttaacacaattaatgctaggttgaattactttcataatataaactattttacataattcccaaagcactgaggatcaatcataaatactatccacaaggcagccaatagacagacacacacagaccacctctcatataactttgggatagagcattcaatcaagaaaaagtcttccaggtatagccatcaatttgccatcattttgtagcactgatcttgcaaagattttttttttttttgaggtggaggctcgctctgtcacgcaggatgaagggcggtggcacgatccactcactgcaacctctgcctcctgggttcaagcgattttcgtgcttcagcctcccatgtagctgggattacaggcaggtgccaccacttctgggtaattgttttgtatttttagttgacacagggttttactatgttggccaggctggtttgaactcctgaatttcagtgatccaccttccttggcctctcaaagtgctgagattacaggtgtgagccaccgtgcatggcctgatcttgcttggatttttttatcttccataaaatgattaatgctgcccatcatatttgagagaaattaaataccaaggtgtaaaattttgtgcaataggccaggcatggtggcttatacttgtaattccagcactttgggaggccgaggcaggcagatcacttgagatcagtagttctagaccagcctggccaacatggtgaaactccgtctctacaaaaaatacaaaaattagctgaccgtggtagtgtgtgccagtaatcccagctacttgggagactgaggcaggagaatcgcttgaacccaggaggcagaggttgcagtgagcagagattgcaccactgcactccagcttgggtgacagagtgaggctccctctccggaaaaaaaaaaaaaaaattgtggaaggccacaaaccattgcaacaactataattcattttaccttcaataaccaatgttcaccctcttaggggcaatatcactcccaccaaaaatgcttggccaggcacagaggctcatgcctgtaattccagcactttgggaggccaaggcgggcagatccactgaggtcaggagttccagacaagcctggccaacatggtgaaaccccgtctctactaaaaatacaaaaattaaccaggcatggtggcacgcacctgtagtgccaactactcaggaggttgaggcaggagaatcacttgaacctgggaggtggaggttgcattgagctgagattatgccactgctctccagcctaggtgacagagtgagaccctgtctcaaaaaaaaaaagaatgcttccagtaaggctaaataaatatacaaattaggcatgtggcatgtgtgttagtatacgtacaatatatttcctagttctgcccactaagagggcctagaagcaatgacacacccatagcaatgagcacacgtgtcaccccgatcttggcgattttgtttttgtttggtttttaaaaatagagatgggggtctcactgcattgcccaagcttgtctcaaactcttggcctcaagggatcctcctgcctcagcctcccaaagtgttgagattacagacctgagccacctcacccagcccaagattttggtgctttgtaaataatacttttcaatgaaagaagccaaggatctttaaataaatggtttattccacgtctgggtcagggaaaataccagatgaatcaaaacactttatgtgccagaaagttggtaattagtcccacaccccaaccccctgataaaggcatgctataaatagaacacaggagccaacctaaagaaacgcccaaggccaatttttttttttttttcttgacgcagttttactcttgtcacccaggctggaatgcagtggtgtgatcttggctcattgcaacctccatctcctgggttcaagcgattctcccgcctcagcctcccgagtaggtggaattacaggtgcctgccaccacgcccagctaattttttgtacttttagtagagacggggtttcagcaggttggccaggctgctctcaaactcctgacctcaggtgatctccatgcctcggcctcccaaattgctaagattacaggcatcagccattgcacctggcataagttcgtattgttttcagtatcacaaccacatacatgttcaattgcacatatactatgttctctacaaatgtgcagtttggacctgcctcatcttggtactctacaacaagagcattgcattgtcacacatgtagacaatgaattgactcagaatcacaaatacttgtactggggacctgtagggagaagtcaagccctaggaagagtaccaggtcatcatctgggaaaggaaatattaggagtatttggggtgtgaatagtactgtattgaattccaattcatttcaaaatatatttcacagattatcacaaaccaggaaataagttgtgtgtatttttctttgttttgttttgtttgtttgtttgtttgtttgtttgttagagagagttttactcttgttgcccaggctgcagtgcaatgccacgatcttggctcacctcaacctccacctccccaaaacctctgcctcccaggttcaagcaattctcttgcctcagcctcccaagtagctgggattacaggcatgtgccaccatgcctggctaattttgtatttttagtagagatggagtttccccatttttttttttttgagacagattctcactctattgcccaggctggagtgcagtggtgagatctcagctcactgcaacctctgcctcctgggttgaagcgattctcctgcctcagcctcccaagtagctaggatcacaggtgcctgccaccgtgcctggataatttttgtattttttagtagagttggggataagccatcttggccaggctggtgttgaattcttgaccttgtgatccacctgcctcagcctccaaaagtgctgggattacaggcgtgagccaccgagcctgaccagtttgggttttttgagacggtcttactctgtcatccaggctggagtgcagtggcatgatctcggctcactgcaacctctgcctcctggattcaggtgattctcctgcctcagcctcctgagtagctgggattataggcgcatgccaccaatcacggcttttttttttttttgtatttttggtagagatggggtttcactgggttggccaggatggcctcgatctcctgacctcgtgatctgcccgcctcggtctctcaaagtggtagaattacaggcatgagcaagcatgcccagtgaactgtgaccattttgaaagccatgatttatgggaatagcagttatttctctttgtgtaaataaacagaggccaccaaaataagaacaaagagaggcttatgcatacagaacttgctacagagtaagggatccatttgtttatgttgtctatagattctggatattattaggcctttgttggatacatcgtttgtgagtatcttctcccattctgtagtttgtttactctgttgatagtttgtcttgttgtgtttatgcttttattttactttaatttttttttttttgaggcagtcttgctctgtcacccaggctggagtgcagtggtgcgatctcagctcactgcaacctctgcctcctaggttcaagcaattctcctgcctcagcctcctgaatagctgggattacaggtgtgtgccaccaccacctaatttttgtatttttattagagacagggtttcaccatgttggtcaggctggtctcaaactcctgaccttgtgatctgcccaacctggcctcccagcttctggcttaattaggtaccacttgtctacttttgtttttgctgcaattgcttttttggaatcttagccaaaaattatttgccaaggccgatgttgagaagagtgtttcctaggttgtcttccaggatttttatagtttgaggtcttatatttaaatctttaatccatttggagttaatttttgtatatggtgaaaggtagggggcccacactcagtcttctgcatgtgggtagccagttatcccagaatcatttgttgaatagggagtcctttcttcattgctcacttttgttgactatgtcaaagatcacatggttataggtgtgtgaatttatttctgggttttctaacctattccattggtctatgtgctgtatttgtaccactactatgctattttggttactgtagcctagtagtatagtttgaagtggcatatatgatgcccatcagcagtggattggataacgaaaatgtggtaattatacaccatggaatactacatagccgtagagaaagaaaccatgtcccttgaagcaacatggatgcagctggagtccattatcctaaacaaattaatgcagcatcaggtaaccaaatacccatggtctcacttataagtgggagctaaacattgagtacacatggacacacagatgggatcaatagacaccagggtctgcttgagtggggaggatggcatgaggctatgggtcaaaaaactattgggtactctggttactacctgggtgacaacatcatttgtacaccaaactccagtggcatgcaatttacccgtgtaacaagcctgcacatgtatcccttaaacctaaaaacagaaaaaattaaaaataaataaataaatgaggtataagtctaattgttgaatgttgtgaatagtaaccaacagagccattgaaaatagtgagagtggccgggtcggtggctcacacctgtaatcccaacacttttggaggccaaggtgggtggatcacaagatcaggagtttgagaccagcctggccaagatggcgaaaccccgctgctactaaaaatacaaaaattagctgggcatggtggctcatgcctgtaatcccagctactcatgaggctgaggcagcagaatcacttgaacctgggaggtggaggttgcagtgagctgagattgcaccactgcactctagcctgggcgacagagcaagactctgtctcaaaaaaaaaaaaaaaaaaagaagaagaaaagaaaagaaaaagaaaatagtgagagcaccatataaggaaagtggttcaggcactgtggtaaggggtgagtgtcagccaagtcatcagctatcagaacacgaagccatcaggtaatatatcaagttgatacattaagaaggaggggccgggcacggtggctcatgcctgtaatcccagcactttgggaggccaaggcaggcggatcacgaggtcaggagatcaagaccatcctggctaacacggtgaaaccccgtctctactaaaaaaaaaaaaaaaaaaattagccaggcctggcggtgggtgcctgtagtcccagctgctggggaggctgaggcagcagaatggagtgaacccgggaggtggagcttgcagtgagccaagattgtgccactgcactccagcctgagtgacatagcaagactctgtctcagaaaaacaaacaaacaaacaaacaaacaaacaaaacagaaggaggaggatctacctattatataacagagataagcactcagatatatggattataaatagtttagaaaatttaaatatttgattattcagaaagtagacttgggactattggagaaacagggtggggagtagactgcatggagagctctttcttagtgtgggattttcaattatgcacataggtttcttacataacatggaaaattcaattaagaaacaacattgtgttttggggtcccaaaagttcagtgattgattagaaggactcacaaaactgagtcaagctgttatactcatagttatagtttattacaacaaaaggatacagattaaaatcagcagcagaaaaaggtgcatagggcagagtccaggagaaaccaagcacaagcttccagttgtcctctgccagtggtatcatgtgaacagtgcttaattcacccaacgatatgtggcagaaagtacagaaaatactccccaacaagaagcttacctgagtcttggggttgagggttttactggaggttggtctcatggaaaagagcacccatttggatgaccttagtttcctgtctccacccttcccaaggtcaagctgacactgcatggtccaaggtccccacaataaatcacattgttaactcccacataggcaggagattccaaggacttagaggttatttcccaggagccgggctagagtcacaccattctttggagtatgccaggtttgggcaattcaggcctactaagtttccttgactgcacccaagtgatagtgagtatgtaggaaatgagtagtcgcatatattgctggtgaaattagtgttatataaccctttggaaagaaatcaagtgtgtagtgcataaacattatatttggtctgatttgtttttgtctaagacagggtctcactctgtcacccatgctggagtgcagtggcatgatcacaactcactgcagcctcgaacacctgggctccagctatcctcccacctcagtctcctgagtagctgagagcacaggcacgtgccaccacacccaactaatttgtgtgttttttgtacagacagggtttcaccatgatgcccatgctggtttcaaactcctgggttcaaagaatcccctacctcagctccccaaagtgctaggattacaggagtgagccactgcacccaacctatatttgtatatacattaaattgtatatgttaggccaggcgcggtggctcacaagtgtaattccagcaccttgggagggcaaggtcagtggaccacttgaggtcaggagttcgagagcagcctggccaacatggtgaaaacccatctccaccaaaaagacaaagatagctggacttggtggcagatgcctgtattcccagctactcaggaggctgaggcaggagaatcacttgaatccaagatgtggaggttgcagtgagctgaaatcacaccactgcattccaacctgggtgacggagcaaaactccacctcaaaaaacaaccaaaaatttgggtatgttattgtatgtatgtgtatatacacatattaaatatatatacatatattacattttatacacatacatttgtttcctcacgctatttgtttcagcagaagtaaaaattaataaaggtataagtaaaagaatatttacagaagcactatttttggtggcaaaagtactttagcattttatatgctgatataatggaagatactttaactcttacaaataatgagttagctttttatctactataaagatatcctaatatctttatacctaaagtgatatcaatggcaaattgttatatgaaaaaggagaatgctttataattgaagaaaaaaagaaagaaacgttatatagtagccctcccttatctgcaggagatgtgttctaagacccgcagtggatgcctgaaccttggctatccaaggctatccaatgctatcattgacccaattgctgtcaatcagaacacatttctgtctatgatttccatgcacaaatttaatgcctttttcatcttaactaagtacttatcacacatgtggctgtatttttagagcttggggtgcaacaaacaagactaacagaaatttctttttccttcttacattttcaccgctagaggatttgttcttaccatcgatcctagcaacctgagcacatgacttctttttctttctatttttttttctttctttctttctttcttggttgcttgcttgcttggttgcttgcttgcttgcttgctttcttgcttcctttctctgtctttttttctctctttcttccttttttctttgtttctttcatctttttttctttctttctttctgtttatttatttatttattgagatggaatctcactctgtcgcccaggtgggagtgaagtaatgcgatttcggctccttgtaaccttcatctcccaggttcaagtgattctcatgcctccacctcccaagtagctgggaatacaagcgtctgccaccacgcccagataatttttgtgttttttgtagtgatggggattcactatgttggccaggctagtcttgaactcctgacctcaaatgatccacccagttcagtctcccaaagtactgggattacttgcatgagccactgcacctgagctgtatatgccattgtatgattgcaaataattatatgaatcttggagaacatcatggaaagatgttcatcatcttgttaactggttatttcaagagtggaactggaaggggaatactgcctttcctgtgtatttgtttgtaatgtttcattttcattatgaacatgtattattttaatatgtttaaatattaataaacacaggcaaaaatatgtaattttaattcaagctgaaatcgtcaaggcaatcatacataacagatggagcaaataaaacatttaaaatccctgaatgaaaaggaggggaggccgggcatggtggctcacgcctacaatcccagcactttgggaggccgaaccaggcagatcactttgggtcagaagtttgagactgccttggccaattgagaccccttgactcgattggaattggtcccacaaactttttttttttgagggagtctcgcactgtcacccagggtggagtgcaatggggcaatctcggctcactgcaacctctgctcctgggttcaagaaattatcctgcctcagcctccctagtagctcagacttcaggcaatgaaactaaagaaagtcaggggatggctaaaggatggaggatacctgggctgggggaggagggagaatgcgacgggtgaacacagacaggcttccaaagtggtgtccaggttgtatttcttcactaggtggtgggcacacaggcatgcatttttccttatctttaaattgtacatatttcatacacttctccatatgtattatacatttcaaaatagtacatcttttaaaaaatcacagtggttaatgcaatcagtacaggtgccaggcacataccagagactccaggtgacggcatgctctcctcttgggctcctcatctagggctgaaagtttatttctcacccctgctgccagcacccgccatgccagcccatgtctctaagtgctgaggggaaggtgtatgaacagagacagatacggccgtggaggaacccggagggagggccctccacttggtgaggacagattgtgaggctggtcagtgctgaagctgagtatcttgcttactagagcaaaggggaactgtgcttataggaccatctctcagagcaaaacaaattaagtctcttgggaagcctggcattgaggattgtccagctttcagaagtgagagtgttcagcctgacttcaggggcacaaggttcttgctgcctgggcctgttctgtagtgtggggctgtccctgactggccagctttcagaagcatgcagcattgtcattgacttattggggtttcatgccaccacagccaaaaagcagtttgtttttgtccttgagtttggactatagattgttattctctccaggcaaaggcaggaagcacacgggaacaggtagtgccaggtggctgcaggcaggtggtctggctggagctcagtgcagaagcacaagacggtggtgaggagtgaggcagacccaggggactgaaacaccactggaaagaaggttccacccagagcagtgggggccacagagtgatcctgaggggagatatacacagagatgcgtttgaggaaaagcagagaccagtgggaatgctggtgctctccgccagaggagaggcgacggtgatcgggacgagatagagacaccgaggcggtgaagatggagaggccatgtgaaggtggaagggacagaatttggtgacaagcgtccagactgacgcccaggtttccacttggggagaccacaaggtggcagggtgaattccaatgccaggtctccggggagagcacactcaggaggaagatgagagtccgggtccctgtgggatggacgtggagccctccaggggcattgaactctatagatctgccagtcaggggcagaggggtccagggcagaggagacagagatctgggcaccacccacgaaggcacagtgggcaggggatggagccctctggagggagccagcgcaacggtgcgagaaggagcttgcaaaggaagcagagcagcagccaggacaagggaaggcacccgcgaggaacttgcctgcagaccccagggttgagtaggctttaaggaggagtgcatggggagcgttgggccgctcacagactgaacacacagaggctggcgtggatgcctgtggcctctgcccttgcaacaacctctgtcttgggtcaggtttcctggaagcagagctgagatggaattcctgtggaggtgattatggagggagtgctcctaggaaaggagagtgggggtagagagccggtgcagagacctgagcaaggctatgactgcttcagcctggttggatgaaggggagttcaggagcactgcacctcacggctgtccctgccttgaggccaggaccattttgtgtctcctctccctcccctcatcaatcaggcactgggttgtgggggagggtgtgaccttctgggtgaggcagttttcccacttggcctagggcaatgagcctccgctatcctcaggcggccaccattgcctgaagacaagtgagaccccatgtgcttgggcaaaaccaaccccttcccagctcccagcattcagggagggtctttgagtaagaccaccctaagctgcctcctctgctggcaaactccctgtcactgctttccccactgtctgccactgtagaccccaggatgaagctcattatgctgcttctccctctgtatggaaagttcgagtccccccaggccaccccttgccccagacagctctgtataaccccttctcagaccccttcccccatccccagttccctcaaacccttccactctcgagctcctgaccagccatgagcaatgtcccccatatcctaaactttttgtaaaccaaaaataaaattctgagggccccccagccatctgaatggacctcctcctctgccagggcactcttataatgtaatctgaaagactggttcaggccatgatgggaagtggggatcggacttgcatgattatcgctccagcattaacatcaacacactttagtctgataagaaacattttacaggctctctgaagcctgccacctgaaggcttcctctgcaaataagaactttggtttccacaatcctttatcttaacccaaacattttctttctattgatcccaggtctttaaatcaactcaaccaattgtcactcagaaaatttttaaatctgcctatagcctggaagtcccccctcacccaccccccgccttctagttctcttgcttttctgaaccaatttatttcttaaatgtattagattgaggtctcatgtctccctaaaatgtgtaaaatgaagttgcaccctgaccaccttggacatatgttctcaggacctcccgggggctgcatcatgggccatgatcactcaggtttggttcagaataactctcttcaaatattttacagagtttgactcttttttgtcaacactttgagcatccccttgactgtgctgtaactggagatggacacccgctcgcccctcaaggaccgcatcgctctccagcactcctcctcttcttataacttttggtgatttccgtttccagggggtgatccctgcaaaaccctggcctgctctcctttcatggtcttgacctcaaaactaccccagccctcctctcccatggccacaccctagatattgtggcccataaccataaagtcttctctctccacgaagacaattccgagtggccaaccagcagcaggagtattgccatcttggataagcactggtcagcatgaccaaaacccacaaataacatctcagaccagaaacattccaaacccctccctcaccagaggcttgccagccccgagataacctcccctccggccagagatatgtcagccccaaagctgcgttttgtgtttctttcctctttctttaacacttacactcctgattgtgtccagctgacttctgcagtgcctcacctaaacattccttcaatggctgggcttacactccactgatccctccacattttcactgtggtcacccctctgtcctccctcctccctcccaggtattatggtgggcaccaaacattctcagcagcatatgccagttcctccaagtcttctcttcattagaccaacgtccccaggcccccagttttccccaacaggatatggaccacagatcagccatgtcctagcatcttcacctggtgcttctgtccatctgtccatgtcttcttgtccctggaaagcatgttctctgagagcagagattgtgtttcctgcatctctgtctcctgttgcccagcacagaattggtgctcaatgaagatttgtccatccagatgaagaatggatgggtggctggatgggtaggcagatggatgatgagtgggtagatgggtaggtggatgggtggggacagatggatggatggagatagatggatgatgaatggtggatggatgagtggggggatagatggatggggatggatggataatgaatgaattggtaagtggatgggtgggtggatggatggatgggtggatgagtgggtggatggatggatgggaatagatggatgctgaatgggtgggtgggttgatggatggatggggatagatggatgatgaatggatgggtgggtgggtggatagatggataatgaatgcattggtaggtggatgggtggatggatggatgggtagatggggtggatagatggatgggtagatggggtgaatggatggatgggtaagtggatggatggatgggaatagatgatgaatggatgagtgggtggatgggtagatggatggggatggattgataatgaatgaattgataggtgggtgggtgggtggatggatgtatgggtggatggatggatgggtaggtggatgggtagatggggatagatggatgatgaatggatgagtgggtgggtggatggatggggagggattgataatgaatgaattgataggtggatgagtgggtggatggatggatggatggggatggatggataatgtaagaattggtaggtgaatggatggatggggtagatggataatgaatggattggtaggtggatggataatgaatggattgataggtagatacatggatggatgtacaggaatgaatggataatgaatggattggtaggtggatagatggatgagtggatagatggatcgataatgattgatggatggatggatggggatggatggatagataaatggattggtaggtgaatggacaaaaggatggatggatgagtgggtagctggatggggaatgagtgggtaggtgggagaatggatgatggatggatggatggatggatggatggatggataaatggagggatgcatgatgaatttctcccttgttcccagcctagtcctagaatatgttgcctcttctcaaaaataaggtaccacaaagcctctggtgacggtggagcaaaggaatagatggtgaatgtctcatacccacttcggatccagaacaggcctaggagagactcaggtgggatctgctgctgaggaagggggttggggctgaagttggaggaggagggcagctctaaaccacctgttcctggctctaggcctctcaggccagacagcccccacacgtttctgcagatgcccgcatcatggtcctgaggggatgggggctggcctggagcctttcccccgtggtgtgtggctatagcggggacatgaagggggtgtgttggggacgtagtgaccactcccttctaccgtcagagatcctgcttccccctgccccctgcccctcctcggctgcccttcataaccccccacccactccccacctgccatctcctgtgcttgtgcggatccaggaagcacctacctgggcacagagatcatcgctcggtgcctcgcccctacacaagggcgattaacttctctgttatgaactcctacttagtaattctgacatgaaactcccactaggataaaacttggcgcagaacagcaattactgaaaacacatttttaaaaaggttgatgttttgtaagagttcatcctcctccactcctcagcctccctcaaggagacacatatttagatcttctctgtgtgagtctaacttggagactgtgagttgcagtttaaaaggggctctggggccaggtgcggtggcacacacttgtggtctcagctactcaagaggctgagatgtgaggaacgcttgagcccaggagttcaagaccagcctgagcaacatagggagatgggatctacccaaaacacttaacaataaggctggcatggtggcatatgcctgtggtcccagctacttggaggctgaggcaggagaatcatttaagcctgggagatcgaggctgcagtgaggtatggtttcaactgctgtgctccagcctgggagacagggcaatactgtgtctctaaaaaataaaaaataaaaataaaaaaataaagggctctgagcccagccctctggccagggcctggtgcagtggcagaggcttgggtccctgccaggtctcctgaaacgtctccagggtctgctggggcagccacctgggtgctcagttgctctgttaaacagcaaaattcccaagtcctcatctcaatgagccactgaggccgatgaagagggcctgtctcatttaggacatgagtggccaggcgggtgccacaggcccttttcctggtgacaacaaagccattgcatggctccaggaaggccacatcatttcccaggcttcgtaggcacctgcggggcggaaacagttcagcagggccctcctgatcacaaggacgaggtcataccggctgctgcacggcagggctgcactctgccagggagcgtcctgtgagggaggggctgcactgccactttactgatgaggaagttaaggttcagagagatgaggtcatttgttagaggccagacagcctcctcagcccatttctaaggttgtttctgtggtatttgccataaagccataggttcattgatttgttcttaagtagttctgagcccttcctgcatatcaggcagggacaaacaggaaagtccctgcctttggcaagtgcgggggaaatgaaatgattctgctcagcctcatccattggtctgaacaatcacgtctcatgaccgcagggacacggcttcccctgaacgcggatcctagaggccaggcagaagcagcatgggtttccactcacacggtaggcggctgtgcaatttcgtctggagtccccagacccctcctcatccttcccagggttgctctgaggccattccttgtcatctaggaggggtctacataaaagcatttataaacacctccaaatgggagccaggcgtgcccacctttggagcacttttctctactgcaaatttatctactgctcgtgaaatctctggatttaactctgatgaaagactggaggctgaaggagaacttcaatatcatatattttaaaggttgattcacagtttggagcaagaattaaagaaccacgaacttcaaggtaaaacgggcaacggcgttggggcaagcctctctgcatctgcgtgtccagcctctcctgcgtgccagaagttcccaggcaggagtgtggtgggacatccggctggggtaaggacaggcaccctcccactgtgtcagggcccagagagtgggtggagaagctctgcaagagacctgtgcaagggcgccttgcaggagcctgcagtccccacaggtgtgtttgtggataacacttggggagccctggccttttggggtcacggagggcttggcctctcacctcagagctgcagagaagccgcttctacatcaggacatcagaagctggaacaggatggccggcgaggggcctcttgttggggtcacagagatgggtcgcagagatggcccgtgtggaaggttggattctcaccccacctctgcccctagatgtcctggtgaccctcccctctgtagtcttggttttttgcaaaacagttatgacctcctgccatactgggtactttgcttatgtattgtgtttactctttactgtgtgtctctcctgctaaggtctacgaagaagggtctttgtgggtggggttcttagaggcatcccaagtaccagaagcagtccctggactaaggggctcaataaatattttttatttattattttttctttttgagatggagtctcgctctcttgaccaggctggagtacagtggcacaatcttggctcactgcagccttcgcctcctgggttcaagtgatttccggctaatttttgtatttttagtagtgacggggtatcaccatgttggccaggctggtcacaaactcctgacctcaagtgatccacccgcctcagcctcccaacatgctgggattatagacatgagccaccatgcctggccaaatatttgtcaaattgaatttgtatttccatacaaattttagtctggataaagtgcttcatgcctgtaatccaagcactttgagaggctgaggcgggtggatggcttgagcccaggagtttgagaccagcatggaaaacatagagaaaccccatctcaatataagaagaagaagaaaaagaaaaaaaaaatcaaaaacgaaaacaacacaaattttagagtaagtattttaagttccacaaaaacctggttaggatttggatagcaatttctttagttctacaaatcaatttggaaaaaattaattaatttgggaagaattcattttgagtcttctaatccatgaacatggtatctccatttgtttagaccatctttaatgcctactaataacatttctgtatagtgaccttgcacattattcttagattcttgatattttgtgctattatgtctttttataaattttatttttccaacattgttgctaatatatagtaagaaaatggaatcttgcctatagattttgaacccaacaactttgctaaactcctctgaatcctcagaatttccctgtggattatgtaggctcttctgcatacacaaccatatcatctgtgaataaagacagttttgttttcttcttcacaaactttacccgactcactgtgcagtctgccacatccaggctgatattgaatagcagtggcactaataggattctttgcccccttgccaatcttgtaaagaaagctttcaacattttcctgttagctctgttggcagctctgactttttccatagatggccttcatcagcttaacaatgggtcttttcttcccagagggctgagcttttccttaagaacagacagtgagtgtcatcaaacactaggctgcatctgttgagatggtcatacgacttgtgtcttttcctgtgtttgtgtgtgaactctctgggtgtctgagggttcttgtgactttcacagaagaacacaatttaccctccggtgtgggaaggggaaggaggcagaggaagaaagaccccaagtccccctcatccccactgaccttcctgctggcttcgtccttgatctgtgcctccttagatcctgcgtttgagtacttgcggtcatgatgacagggccaacctcctgaccagggctgttagcacctcccctgctgcccagagtccctgctccaaaccacttccttcatcttccgtacccccagccaatatttccctgcccagtgtcaacccaggcccagaaccagaccacaagggacagccccgaaacccagaatcagacaaatcagcccgtcccaagctgtctcccctgctctgcccggctttcacagggaagccaacacaggctgtggcttggcctttccctagctcctttctgcctcctggtctgcctgcggcttccccctgccgccctgcggggcctgccacgtctctcatttctagcgaatgtttcaagagcgatgttagactttcctttcaatagagttgacctctgttaggcacctttatggattaagacctgggcatagatggtttcttcggcatcacgacctgaaggtgcttgggagagacggtgaggaggagaatgcaccctgccatgctctgcaccgcacatggatgcggatttcaccatgttggccaggctggtctgaaacacacggagcccaagcgcccggtggactctctgacggtcctcgggcgtgtgcctttgtaagcagagtattcagctctcatcagggcctcgccagagcagaaatggtctgttgataaatgcatcgtatacaattataaatgtgcacccagcattgctgcttcctcttttttttttgatatagggacttgctctgtcgcccaggctgcagtgcagtagggcagtcacagctcactgcggcctcaacctcccaggctcaagcaatccttccgcctcagcctcctaagtagctggaactacacatccagcttttttttttttttttttgtagacacaggatctcaccatgttggccaggctggtcttaaactcctgggctcaagtgatccgcccaccttgggctcccaaagtactggcattacaggtgggagccactatgcctggcctgcttccttttgcaaacaggaatcttgtaaatagaattgatcagaacttgttgtttaacgtacacagacctctagctgtactgcaaagctgtgtgcacatgtgttaagtcatctgttctatgtgttctaattataaataagaaaaaacaaatttcaatcaaccatgctggaggaagagcaattatgtttctattccttctatcataggtgatgtaaaattctcaaacaatgagatagataaaaagtacgcagccaaaaagttcaagaagaagtgttatggagatggagcaggcccttcgtaaaaacacgatgttggttttctggattttgtatgtttgcttttttttttcctcatcctaaagaaatattcactgtcatacctaattttgtttttgtaagtttgtattctttctttatagggaggcctcacaaaacccggatcagactcgcccactgccctgtgtctgccctcccgaccgcctctcctgcccagcagggatgagggtggcagtggtgctgtgtggagggtggcgggaggacctggaagactgcgaccagtgagccgggaggccttgggacagcctctctctgaatcatcctgtgcactgccgggtgtgacagaggctcctagaatcctgtctcaagtggccgccttcacagagggagtcactgacgtccctgctcagcgcagccctggcatgtgggggtccctctactcatgagaaacccccacccaatcaccgtgaggtgtgtgacccatgctcacatccaggggccactcattcattcaggaaacattggccgagccctcagcagggggcggtgctggatgccgggatgtagagagtggggtgggacaaggacttggttgtgagacgtcccagtccggggaaggactaagagaaggtgacatggacagtctagactacccgtcattggttctccactgggggcagtattggcaatgtttaggtataaatttgttgtcacaatgaatgctaccaacgtctagtgggtggaggccgggggtgcggctcagcatcctaccaggtgtcggacggcccccaccaccgagtgccagccccgagggcagcccagggtgccccagtggtgaggagccccggtgtggagtgcagggttcgtttggaccacggctgtagaggcctaggggagctcccgccatcaggatggccgggcatcagggctctgtgagggggaagggggcatcagtgcagcggcaggcaggggttcgacgggctgagtcctgcgacgtgttgcatccacaccagtgtctggggccagcaccaccgctcagtctctgaacccacttatttcgcccaatattgcttgagtgggaagttccaccttccccagtcggctgcttatctcgtctttccaatgcagttaggaagggaaaatattttctccccattttacagatgaagaaatggggcctggcgaggagcaaagcccagaactgctgcccaccaccctccctgcctggtgctttcctgggaacatgtgggagcccctgcctggaccttgggacctcccatctgtaattgcaggccctggtctgcctgtatggatgtggaatgtgtcactcgggatcctggagtcctcctgagcttgtccagcagggctgcattcactgatgtgctgacagaggcctaggctcggacctctaggaatatccaaggcatctcattatgcagaaaaccaccctcatgaggtcctggaggcctctctccatcttcctgggggtgatgcaatagagtgtaacttccatgctgccgagacaggccatgaggggttgcccccgttggaggggcagagtggtatttgtggggtggtaggaatcattcaatgcccagctgcaaccccccgggctcacagcacactcttaaggccagtgctaccagctcccttgggtggatagaggagctacggctcagaagcatgcccacagctcccccaggaccctgaggccagcctgtggcagggcctgtgatttgaacccctctacaaggcttcaaatcagtgctgtttgtcctggcctcataaaacctggctgcccagttgggattggtgtcatctgccttgctgaactgggcactccttgggaagagggtgggtgctgcgagaaggcggtggatcctggctgtgcaaccttcgcaggtggctgaacctctctgtgtctcagtttgctcatctgcaaagggggctgggattcctgcctacatgcatgtgctcaagagggaaagccagccaggcatggtggctcatgcctgtaatcccagcactttgggaggctgaggtgggcagatcacttgaggtcaggagttcaagaccagcctggcctaaatggcaaaaccccatctctactaaaaaaaaaaataaaaataaaaaaatagctggacgtggtggcgggtgcctgtaatcccagctactggggaggctgaggcaggagaatcacttgaatccgggaggcaagggttgcagtgagctgagatcccaccattgcactccagcctgggtgacaagagtgaaactccacctcaaaataaataaataaataaataaataaataaagtaaaagagggaatgctgagagctgggcgtggcctgtggctctgtagctacgcaggaggctgagtcaggaggattgctttaggccagagattccaggctgcagtgagctatgatcatgcctgtgaacagccgctatattctagcctgggaaacacagtgagaccctgtctctgaaaaaataaaatatttaaaaaagagtgaatggtaggtcagggtcttctgtagtggggtgggtctgggcaggggtggaggcccagccagagtcactggggtcagggagggactggtaacaagaatgcacagccctgaccagggaagcacccagggagctttccccgtgaaggggggacctggcctcgccctggcctcaccccggctgtgagttggaaccagcatggagggaagccaggcccggtgcactctgcccagggggatgtagtttggccagtgggggctgccatcagaggctgtccttactgtgggatcgctgtggatgctttcccttctgaagcctggaaccttgggtccccatgccctccagctctgtgtctcctttgtgggcatcaggaagacacattccctggcctcctttgcagtggctggctgtggaaggaggtgcctggggtcaggtgggtgtaggtgggtacgtggcatcacgaggacatatttttttagagggaattacattctttcttccaattttttattataaaagttttccaattgaaaccacccacaccccaagcctggggccggcctcccatcactgccttctcagccctgggggaggcctccttctttctgcatggcctctgggcccatctgagcattcctcttccctgatgggagaaacgcctggtgggggagaagtggaagtgggtgtccaggcaagtctcaaatcccaatggctgacccggaatcccctctgcacacctctcctcctggtgcccggagggggtgcccactctgctgccagggatttcctgagtagctgctccgaccacagccagggaagagtccttgcaggaactctgcgggctgggcctgccctccccagccttggcatcttcttgttggtgtctgagtttgagtctgttctgtgggctctgtgggaggtgggcccagcttctcaccatgcaggacccctcacccagagcctgaaacccgctttgactaacatgcctctgggttccttcactggccctgcccagtcgcatcccatgggaagaaggactggctgctcggggttctcagaccctagcctgggaaaaccagtctgagggcagggataacccttggccctgcctctgattgggccctgagttaggtggggttcttccctgctgggggtcctggaggcatgggagggttttggggttctgtgtgagagaggcctcagtcccttcagttctcacagatcccccaaggctgtgtgtctgatccattgctttacataagagaggaattggagccaggcaaagcccaggattaaaatgggtggtggaggggggaagctgtgatttgaatgtgtccctctaaaaacacgtgttggaaactcagtcctcaatgcaacagtgttgggaggtagggcctaaggggaggtgtttaggatgatccatggatgatccatgcaggtaacaaaaggcctcgaggctgggtatgtgttctctcactctctcacactctcttgccatgtgatgccttctgccatgtgatgacacagcaggaaggccctcaccagatgcagcccctgaaacttggacttcccagcctccagaatcatgagccgaatcatcttctattttttattttttattttttttgagacagagtcttgccccgtcgcccaggctggagtgcagtggcatgatctctactcactgcaagctctgcctccctggttcatgccattctcctgcctcagcctcccaaagagctgggattacaagtgcccgccaccacaactggctaatttttgtgtttttagtagagacgggatttcaccatgttggccaggctggtctcgaactcctgacctcaagtgctccacccaccttggcctcccaaagtgctgggattacaggcatgagccaccacacccggccttttttgtcttcttataaggaggtaagttgtattgaatcagggcccactccaatcaggtgtgactgcgtcttcacttgattatatctgcaaaggccctatttccaaaaaggttgcattcataggtaccaggggttgaggctttaacatatcttttaaaatttttattatttttttgagacagagtcttgctctgtcgcgcaggctggagtgcagtggcgcgatctcggctcactgcaacctccacctcctgggttcaagaaattctcttgcctcagccccccgagtagctacaattacaggcgcccccacccaccccaccatgcccggctaatttttgtatttttattagagctagggtttcaccatgttggccaggctggtctcaaactcctgatctcaagtgatccacttacctcagtttcccaaagtgtaacatacctttttgggggacagaattctacccacaaattctagataaggaggcattgcttcttttttcttctggtattgaatgtcactttggagaagtctgatgtcaagttggttttctttgctttataagatacttggtctttctgtctggctgcctaaaggattatttctttatctttaaagtccagtgactttacaaaggcatgttttgtgttgactgttctgggccaacacacacaagtatacagcttgcacttttacaggcaggtgcaagtctgcctgcatttcaataaagaggtcttgaatgatagtttcaatccttgttcagcaggtgctgtggtgcacacctgtgctcccagctactcaggaggcctcctttttaatctctttcctctttctttccatttgctcactttttccttttttacgtgattttcatggtgtctgtgctctcatattacctgtaacttcatttcttcatttctgaaatggttctgtctttttcttcagtttccttcctgaattctgtcatgtcctaccacagactcggctgctgtttggccacctcttccctgcattcttattctgtgcttattctcctctgttcttatcctgtgctgtagtctccctttggagctgaagttcttgttggaatattagatcattattttcatctggtttgtggcagtatttgtctgatgagatttcttcatttgtaggaaaatagcactgcttttatttttttttttttattttttaagactgcagcttgctctgtgacccaggctggagtgcagtggcacaatcgtaactcactagagccttgacctacagcctgcactcgagcaattctgctgcctctgcctcctgagcagctggggactacaggtgcgtgccaccatgcctgcctgggtttctttttctatttttttgagagagggtctccctctgtcacccgggctggagtgcagtggcgcaatctcagctcactgcaatttctacctcctgggctcaagcgattctcccatctcagccttctgaatagctgggactacaggtgcacactatcgtgcccgggaatttcttcgttttttttttgtttgtttgtttgtttgtttgttttttgtagagacaaggtttcacgatgttgtccaggctagtcttgaactgctgggctcaagttacctgcccacctcggtctcccaaagtattgggactataggcgtaagccaccatgcctggcctttttttttttaagttaggcacttaggtctccttatgttggccaggctgatcttgaactcctggcctcactcaatcctcccgcctctgtctttcccacaaagtgctggtgttactggaaaagggggggctctgatccagaccccaagagaggtctctttgatctcatgcgagaaagaatttggagcgagttcacagagtaaagtgagagcaagtttatcaggaaagtaaagggatgaagaggaactgaggtctcctccccgcccttttgagaccttataaggtaacctccagacattgccatggcatctgtaaactgtcatggtgctggtgggggtgtcttttagcagcaaatgcattctaattggcatataatgagccgtgaggacaatcagaggtcactctcgtggccgccttggttttggtgggctttggccggcttctttactgcaacctgctttatcagcaaggtcttcatgacctgtatcttgtgccgacctcctatctcatcctgtgacttagaatgcctaaactcctgggaatgcagcccggcaggtctcagcctcattttacccagctcctgttcaagatggagttgctctggttccaacgcctctggcattgggatttcaggcgtgagccactgtgcctggccagcattgcttttggaagtggagagcgtgcccatttttgttactcgtttatttgaataggatggctgttccggccaggaggtgctgggccacggctcctgggaggaccatgtgctgccgcacatgtgcctcccgggtctgtcctctgtccctggctgctcgggtcagcctggcctccggttctctccctttctgtcccttttgcaccctggctccctctctaggctgcggtgcagtgaggacgctgctcagggctggaggctggcgggaggttgggtgtgatgcgaggctgtgttgccggctgttctggggatgctgacaacattagcgtggctcatgtttatcgtgggtctagctcctcttgtacagacatggtcctcttcccttcctccacgaaagcagaaccctgatgcgtggcggggcatgtagctggccggaatgaaaacctgcatctcccagcttcctccctgatgctaagtggagctgagctgctaagtcgtggccagtgggttaaaggcagaagtgctgtaggagacttccaggaagatggctaaaaacaagctgactcagctgggacttctgggatgggcccttttctgccctgtacttttccagcttccttccacctgtcctgtggtcttgatggctggagcaccagcagccaccttggaccatggagtggctttgaggctagacaccatgcgtggaggatgaggagcaggacagccaggatctgggtccctgaggacatcgaggagctgccacctcaccctcaatcagtcatccccagattctcccttcagaaagaaatcagcttctttcttgtttatgcttcttttgctgggattgtcatatgcagcgaaaccaaactgtggagtcccgatcagctgatagaaatgaggaaggggttccctcctctgcacaactccatggcaccacaggccctagctggcaagaacatgaactagggtgggggagagccattgttctaagaaatggataaccacaagcagcctgcttgcacaacctcctgttaccaaatacctagctctgcacgttagctccagcagcatgaccctgtctgcatggggcctctccagcgtgaccctgtctgcatggggcctctccagcgtgaccctgtctgcatggggcctctccagcgtgaccctgtctgcatggggcctctccagcgtgaccctgtctgcatggggcctctccagcgtgaccctgtctgcatggggcctctccagcgtgaccctgtctgcatggggcctctccagcgtgaccctgtctgcatggggcctctccagcgtgaccctgtctgcatggggcctctccagcgtgaccctgtctgcatggggcctttccagcgtgaccctgtctgcctgttgcctctccagcatgaccctgtctgcatgtggcctctccagcacgaccctgtttgcatgtcgcctctccagtgtgaccgtttccacatgtagcctctccagcgtgaccctgtctgcatgcggcctctccagagtgaccctgtctgcatgtggcctctccagcatgaccccgtctgcatgtggcctctccagagtgaccctgtctgcatgtcacctctccagcatgaccgtatccacatgtggcctctccagcatgactctgtttgcatgtggcctctccagcatgaccctgtctgcatgtcgcctctccaatgtgaccctatcaaacttccccctggcctctgcccctggggaggtggccttctctctgccatgctgcctgctgttctcttgcaaggtgtcttcagactttctttacccatgactgtctcggtaaattcttttaccacccgtgacaccagccccagccagttgcacctgcaacactggctgcagtggattccttgttgttgatactccacataaccttgctaggtgtcatatatgatcattctttaacagaggggcaagctgaggctcagagaggttaaggcacttgctcaaggtcacacagcagagaggttgtgggtaagccaggctgctggcttagaacactgccatggcatttctcagatcacctcgctcagggactcctggcagttccccctgtgtcatagcggtgagtctgtccaggacgagccactccaggctaccgagggccagctggagggcctgcagacacttgctgtggagtcaaggtccacaccatcagctggaagagaggtctcaggaggggcattagtgtttgtcctcgctgtgattgcaccaactgacaaatcagctgtgggacaatggaaaacacagcagcagcttgttactgagaagggaggactcagggtggacctgacccctctgcagatggcttggtgagaacgtggcctgccctgttggctcctccctctgggtattggaattgctgggcagccagaggcttacctgggcttactggcacccagggaggagaagccctgagctgtgcggctgctgaggaaggctgtctgcaggggagagcccaagcgctgaaggaggccagtgggctcagcctgatgtctccattctccttcctacagcaaccagggttctttggaaagggtcaattgccccaccttaccaggtagggatgcaggagggagagcgagccattcctctaacgtcagtgaccatgtcttggttccaaaaccccttaagccttgggttgtctatcagcaaaaagagaagggatgtgctcagggggtcttcgtggagatcctctgctcccctcaccttgaatgtggagagggcccaagactccctagggaaggcagttgatacagactccaggtgtgccctgctctctcctcggcaccactctgcagcaccacaggcagtctggggtgcagataacatctctctgggcacagctttgcaccagggcatgctgggggtagagccacacttgcatggcctgtggatccctgcagcctggggattgggctgctattcccactgcagggagggaggtggttggaggtaggggctgctcctacctaggtacttctggcctcaccagaagaagggggagggtttgcacattgagtggcacctgctccatctttgtccctgtatttacatcattattctgaaggccaagagattagacctgccggagctccatgcacagaccctgggcaggtgcatgtgggcttctggcttcctggtgtgcacagccccttctctcccttctggactgtggcagtgtactagggacattgtagccactgtgtaaagtctcccgctttctgggacagttttattcactcatgtgtgttgagagctcgttttgtgctggggtccctggggagaacgctgggttcactcatagttccacaacaagggacctgtggcctttgttgtggacaggggccaagagcatgtagagaaggcactgaatgctccttggcttccaggggaaagatcaggactggaaggatgtgggaactgcccaaagctacaggatctgctgtctcaatggctgagcagggtgcagagtgcatgcggctgtttgttctgtggcactggtaaccttggcacttctccaggtgtgaaggacagcatgggagtgagcctgtgaagttataggcagagtccaggcagccccaagcctgggtgggttgtagctgtcagagtggcagcaggtggacagaggggatgggctcggggggaggcggggggacccgcttgaatgggagtcagcctgggggcatctcaatccctctgatgcctggtttgggtccccagcactacttagcccaccccactgagcctgtctgtgcctggcctggcactggtgatgcagggactgagtcaggcagggcctgacccagagagcccatgggcagacagtcttggtgctgcatgcccgggcttaaaccaataagcctgattctgaatgtccacaagctcttggctggtggggccacaggactgggacccaagcctcctagcgacatggctgaggccatctgtcatgggtccttctctcaggccacctggttccctgtgactcacttggtgttgaccaggtgcatggatgcagagctgagcagacagtccctgtgtccccagtctggttgggggtgcaggggtctggagcccatgtgagcctggtgagagcctgggaaggaaccactttttccatggcagagctgagtgcaaagcacgctgttgcactgctctggtggtggcattttactctgtaacctattcatccacatactcatgtatttctccacccacccattcatctacttatccacccattcacccatccatccacttatccatccacccatctacacatccatccatccacccacccacccatccacccgcccatccatacatacatccacccatccatcacttatttgttcatctatccatccattcccccatctctccatccacctactcacccatccatccaccatccatccatctattcatgcatccatccactcatccatccatccatgcatccatccatccatccatccattcacccacccacccatccacctattgacccatccatccacccatccatctacccatacttccatctatccacatacctgcccatgcacccactcatccatccacccacccactcacctatccacccatccacccatccatgcatccatccatcaatccacccacccacccatccatgcatccatccatccatccacccacccacccgcctcgtccctccgtctgaaggtctttacagaacagctgtgaagctgagatgctggggacccagtggttactcaggacagtcatggacactgccatctaggctgtgcttcctggcaggcaggagcagcgaacaggaccctttgcagatagtggtgtctgctgtaaaggagagaaaacagtgagagtaaaagagttgaagagttactggggtctcctgggactcttttccattctgagtcctgagcccaccgagaagtaaggcatgaaggcaggtgctggaaacccaaaacccttctaacaatgccaacccctccatcaggttgtaaaccaaagggtatctgagacaggtctcaataaatttaaaatacttattttgccaaggtgaagtaagggcctgtgacacagcctcaggaggttttgacgacatgtgcccaaggtggtcagggtacagtttgcttttatttttattttattttattttattgagatagagtctcactctgttgctcaggctggagtgcagtggtgtgatctcggctcactgcaacctccgtctcccgggttcaagcaattctctgccccagcctccccagtacctaggattataggcgcatggtaccatgcatggctaagtttttgtatttttagtagagacggggtttcaccatcttggccaggctggtctcgagctcctgacctcgtcatccacccacctcggtctcccaaagtgctgggattacaggcatgagccaccatgctttcttttatacattttagggggacatgagacatcaatcaatatgtgtaagatgtacatttgtttggtcaggtaaggcggggcagcttgacaacttgcgggggtgggggacttccaggtcataagtaggtaagagacaaactgttgcattctttcgagaccttgatcggcctcccactgaaacacaatttagtctggctcagggaatctgtatttttatatcaacaatagggcagaggaagccatcagatatggatttgtctcaggggagcagagggatggctttgggtcctgtctgtcatttgtctacgaggaatttccttctgggcaaattttgagggaggtggtggctttttagtctccgtagccatcttattcaggagtggactgggaggcaggtttgcctgagcagtacccagcttgactcttcccttggcttggtaattttggggcctgagatggattttcctttcacagggtgtagcaggcttagtgccagggcccagaagacttttaggcatcaggaaagtggtttaatgccttctaaaatcagaataaacacagtgcagcctgggctatagtcatctttctaccaacgcagttatgaaacatcattggtaatactttagcccagaggaggggcccacagaggctgtaatgccaggctgcccgctattcccaatggaggctggtcggaggacgtggctcagagtgaaggccaagggggccttccctgaaccccagagtggaggggccacctgcccaaaggcgcagcccaggccagcctccagggagcccccacctgttcagcagagcaggccacccctgcaggtagcagcggagagtgagctcagcctgccctgcagaccctgcctggatttgccaatccctccctgcgtgggggtgggtgacaaatggtgggagagaggcaggggtcagagaagtcagttttctccacgtggaaggaggctcgggagttggggaggacacccccaccttccccggccttttgttgccctacccaagggcctcgtggtcacacttgtggtgagctggggggccgcccctagggagaggagaactgtcggggtccccttcatgaagccactcccaggactgcagggggccgtttgggtttaccccccatgaaactgcctttgcaaaaattataactgaggaaatgatgacagtgaaagaaatcagacctaaccgactccacattccttctaacctttaagctgtccttattcatccctgggcgtaggccgaactaactttgggaagtaattcagttcatggtttgactctgaaacaaaattggtaacagccctttcccgaatagacccccttcttgcctgaggaccagtcggcctttgtaggactaacaaattagctgcaaggttagaaattatggtttaggggtcttgtggcctccggctgtgagagtctgaacctccccaaattgcttctggggatcacctcactattgtaaaacctgagatcagtgctggggatattctgcagaccccgcactcatggatcagctgacaccacctagaccagtcatctggctcaaccagttccgccatcccacccaggaacagaagacagcaagaaaaactcactttgaccccctatgagtccatctccaaacggaccaaccagtattccccactttctgagcccctacctgccaaattatctttaaaaactctgatccccaaatgctcggggagacccttttgagtaataataataaaactctggtctcccgcacagctggctctgcgtgagttactccttctcctttgcaattcccctgtcttgataaatcggctgtgtctaggcagccggtgaggtgaacacactgggcggttacaccaggattaatgaaactgacgcaaagctcctttgtgccaaagctggaactcatgcctcccacccgccgtccacgtggtatccagctgcacagtcatgcggtgtccagctgcatggtcacgtgacattgcagctgtgccgtggcgttggcaagactgtgacacacggcggccccacgcggtgtccactgcacagtcacacgacattgcagcactgccgtggcaatggcaagactgtgacacacggcggccccacgcggtgtccactgcacagtcacgtggcattgcagctccgccgtggtgacggcaagactgtgacacacggcggccccatgcggtgtccactgcacagtcacgcggcattgcagctccgccgtggtgacggcaagactgtgacacatggcggccccaagcggtgtccactgcacagtcacacgacattgcagcattgccgtggtgacagcaagactgtgacacacagtggcccaaacgtggggggctcttccattcctgtattacttgatcgaagaagtctgtaggtcaaacgcccttgccaattacagttgctagactttaaagtgaaaatgcattttcttgccctcaccatttaaaagccaaagctcagaactttgagttttaagtgaaagtcccaaatgatggaattcaatttctttcccccaggtcacagccaaaggggctgtcatgcagggagatgaggggccacacaggcactctggggacctggggctttctttcctcaggaggcccaggggcgcgggtgaggtgtcggctgctttgcacccaggccacgctgcttccaggggccttgtggctggcagagtggacctgacgtttcccagacgccgttgctgggggctcctgtcctgggaagggcagattttctcctgcgtgtgggtaacttgtaaggtggcaaggctgcgttccccggacccccgtctgcgaggattctctgaggtccaagtttccaacgcctttctctggaaaggttttgcctttgcttctcccagaagcttgggttgccaggactccctcaaactaaatttttggcctggggtttttccagtcatccagtgagcgtgagttctggccacactgcccctgaggtgggcttgtgactggaatttcctggggtgacctttttctgcttttccccctgcttccagagccaaggcgacgcgcccactgtctcccagctgggtgggcttcccaaggccgtctgtggggcctccttgatcctcccgtgggcaggtctcacgtcccctttgcctctggctccctgtgtgcgtggctcactcaagccaatgggaaaaccctggaaactctacagagaagtaggtaaaatccatggacagagtgtgtagaacaagattacaaatggctctgaaatatagggaaagaggctcgtagtaaagaaatgcaaatacaagctatgcagagatgcagtttctcacacatcagactggcagcgattcaaaagcgcgactgcggtggaggaggccgtgggaaactggctccctcagacactaggagggaaactgtccttcacccgagggagcggaaggtggcagtagctaacaaaattacactggctttgccccttgacccagcgactccatttctaggaatttcccccgaggtgacacctctgcaaatagggaacagtgcatgcttgagggatgcagcacagcctcatttgtcacagcgagacactgggaacgacctgagtgctcattcaccaggcagggctgtgcaaatgggaacagccacagcgcggggcatcatgtggccgtggggaacctggggagcctagggggcctggggggactggggagaactcagggagtcggagcacgggaggacagacaggctgctcagtgtggcaggtgcagcgccgagggcgtctgcaggtgggtgagaagggggtgtaaggggacacacacacaccacacatgcacatgcaaaccacacacacacgtaagccacacacacaaatcacacacatcagacacaccacacacgcacatgtaaaccacacacacaatcacacaccacacacacgtgaaccacacacacaaatcacacacatcagatacaccacacatgcacatgtaaaccacacacaatcacacaccacatgcaccatacacgcacatgtaaaccacatacaaatcacacacactacacacacacttaaaccgcacacacaaaccacacacatcagacacaccacacatgcacatggggaccacacacacaaatcacacacaccacacacacacatatcacacacatcatacacacacataatacacacacacacaaatcacggcacacaccatacacgcacatgtaaaccacacacacacaaatcatatacacgcacacacaccacacacgtcaactatacacacaaaaatcacacattctttcactacacaggcatatataaactacacacagaaatcacacaggcagacacactacacatgcatatgtaaattacacacacataaactacacacacaacctatacacacaaatcatacatgcactatacatgcacatataaactacacactatacacacacaaatcacccacatgcacacacacggcacatactacacctacacctgtgaactacacacatacataaaccacacacacaaactacacacacataaacttcacacacaaactacacatacatataaatgatacacaaactattcacacacaaactacacacataaaccacacacacacataaaccacacaaaacacacacacataaactacacacacaaactgttcacacatataaaaacacacacaaagtacacccaaactatacacacaaaccacacacacatataaaccacacacacaaagtacacacacaaaccatacacatacatataaaccacacacacaaagtacacacacaaaccatacacatacatataaaccacacacacaaagtacacacacataaactatacacaaactacacacacacatataaaccacatacacaaactatacacaaacacataaactacacacacaaactacatacacatataaaccacacacgcaaagtacacacatgtaaactgcacacacaaactatacacacacaaagtgcacacacataaactacacacaaaccacacacacatacaaaccacatacacaaactatacacaaacacataaactacgcacacaaactacatgcacatataaaccacgcaaagtacacattcataaactacacacacaaactatacacacatataaaccacacaaagtacacacatgtaaactgcacacacaaactatacgcacacatataaatcacacacaaagtatacacatgtaaactgcacacacaaactatacacacacaaataaaccacacacacaaagtacacacgaaccacacacacacatataaaccacatacacaaactatacacaaacacataaactacacacacaaactacacgcacatataaaccacacacacaaagtacactttcataaactacacacacaaactatacacacatataaaccacacacacaaagtacacacatgtaaactgcacacacaaactatacacacacatataaatcacacacacaaagtacacacacataaactacacatgcaaactatacacacacatataaaccccacacacaaagcacacacatgtaaactacacacagaaatgatacacatttaaaccacacacacaaactacacatacataaactacacacagaaactatacacacacatataaaccacacacacaaactacacatacataaactacacacacataaatcacacacaaactacacacacaaactctacacacacatataaaccacacacacaaactacacacacataaatcacacacaaactacacacacaaactctacacacacatataaaccacacacacaaactacacacacaaactctacacacacatataaaccacacacacaaactacacgtacataaacttcagaaactacacattcatataaatgatacacacacaaactacacacacatataaaacacacacacaaactacacacacataaactgcacacagaaactatacacacacatacaaactatgcaaactatacacacccatataaaccacacacacaaactatacacacataaacttcacacacaaactacccattcatataaatcatacacacacaaactacacacacacatataaaccacacacacaaagtatacacacataaactacacacatataaactacacatgcaaactatacacacataaactaaacacacagactacacacatataaactatatatgcaaagtatacacatgcacataaaccacacacacaaactgtacacacaatataaaccatacacacgagctacacacacatgtaaactacatacagaaactacacacacacataaataaccaccaggtgggaggactgggtggagtgagaagtcagagaatcctttacatatgtgttgacttttgaaacacgtaaatgtttacacgttcagaaatagaattaaattgacaagcacaaaaaaattgaacattgaattcaaacagaaatcaatgaacctaaaacaattgacagcaacaccagatggaaacaagaatggaagtggctttcgaaggggcctctggctgtggggacccgcagctccgcgtcgcaggctggttttgtcgcagcagcagcgctgctgtggtcgtctgaaaccactgtctgtggattaagggctggtcacccccagcagcttggtggtcctcctcggaaccaggactctttctctcgctgggaggcgggagatagggatgtggaacgggaaacaaagagggttcctgggggcttgtgcttggaccggaagcggcagcaataactcataattcaaaaaaaatccattttctgtctctaaccactgaaaggagctaacactggtgctacccaagcacacaggcacacgggtggtttccgaagctgtgtggcacaatggggcctaagtccagatctgggtggaggtgggcacaggatgagccagagtatggatcgcgtcgcgccaggagggcggatgcacttgaggacagacggggatgcctcaacaggccaaaaaggccaggtggaaggggctctggtggccaaatttgagacaggatgaagagcattggatgaacagtatagtccatggcggccctagaaggagggagcacttcctcctagaacaatccagccaacgtgggagaggcgatgggtttgaaagtccccatttgtgcactccccctggaatgaacccattcaggtgaagatcagcagcggatgttgaagtcggctgaatagcatccccaaggcaagtgcctatcctaagccccagaacctgtaatcacaggtccccttgtatggcaagaggggctttgcaaatgtggctaagtgagggacctggagatggggaggccaccctggattatccaggtgggccctggtgatcttcagggtccttttaagagggaggcaggagggtcagagcctgaggaggggatgcagtgatggacgcggagcttggagggatggggtttggaaacggaggaaagggccacacatgtacccaggaacactggtagaaggaatgcagccctgccgacaccgatctcggcccggtgtgacccattttagacttccggtctacagagatgggagagaacacacctgtgttgtttgtggtaatctgttacagcagccacaggcaactaactcgggtgccaaagccattgagttaagggctgttggggaacaggatattcacgctcctaggaccaccagttacaaaggggagggggacttacgcaggagcagctggcgacagtccttcccccatgactggatgtagcatcacctgggagggacagctgacatgtcccctgctgtgacgggcagaggacagcgtctcctgtgagtgttgctgcacaaaacaccacacccgaatttcatgctgggccagtccgggttatgctgcatcctgccggacagctgaccagaccctggaagctagtggtgtcactaaaggaaaagagctcatctggtgtaggaggcttaattgtggcaggagggcataggtggggggtggtaagaaggaagtgtcaggagggaatgatgctgctaggcatttggaggcggagctcaggggcaggaagaggatttggaagaatgatggatagaattgatgacaggctgaattttaggtgtctgagaaaaatccaagtggaaacaattcagaagatgcatgaatattcaagtatgggcgtggaagaaaagtctggactggaaatatatatttaaaagtaaatagggcggccagttgcagtggctcattcctttatttccagcactttgggaggctgaggtgggcagatcacgaggtcaggagatcgagaccatcctggccagtacgctgaaagcctgtctctattaaaaatacaaaaattagctgggcatggtggcatgcacctgtaatcccagctacttgcgagactgaggcaggagaatcgctggaatctgggaagttggaggttgcagtgagtcaagattgccactgcactccagcctggcaacaaagcaagactccgtctcaaaaaaaaaaaaaagtacagggtatgagtgatagttaaagtcacgcctgtgaatttgtggaaagatgtgaaacagccaactcagggtccgaaacgaaataagacagactcatgtttcctgactttactataacattgcctattgcattttcaagcacgaaggggaaaatatatatttttttatggagatactttgatctttcaaattctggacctgggatgtgaaatggccatggccttagttattttaactggctaactcatagaatcccttttctgtgttccacaaatgtgccacattttgtgctattcatattcctgtatctagtatatcttctttcattaatctattttagtgcagtaatagttatattttcagatctaagaactaattgcttgactttgttaatggataaaacaaactgtaatatattttaaagaggtttattctgaaccaatatgagtgactgaggcctggagaaaacacgcaaccaagaaggcttgagtaagtggttccgaggtggccgggttggtttggttttatacatttcagggaggcaggagttacaggcaaaaacatcaacacatggaaggtatacactggttcggttcaaaaagggggattatcttcaggagaggtcttataggttgtaggtggacttggggattctctggtttgtgattggttaaaggagtaaggccctgtctacagcttagagttgacagaaaggaaggtaagaatgctctgtcagagtcagccacaataaaatgccctggttagcaagcctgatggcctgcaggcctgacttacacctgccttgcatggccttagggcttgttcataatttgttatcttatggccacacggggtctgttctgtcagtcttaggatctctattttaacaccgctgctggttacttgttgagtccaaactccaaaacagaggaggtatgatgaggtgtgtctgacctccctttctttcagggccagaaacagcttttcagttttctctggggtcctcttggccaagaagtttctgttcagttggttgggggggcttagaattttatacttagtttacaacctagcgttggtctatattatatgctcaggaaagtttctgaaatagccctggactggttgggtgatctgggatatggaaaatgggcctgtgtcctgaatgatgcacttgaaaatggaatataagactccgtaaaactcaaagcatccatgaacacaaaattcaattgagttgatttgccgcaggctttctccactgctaacagttacaattcaatctcagttatacatggtgtccaaaagaagcacattgtggtgaccagcagaaaccaagttttgcttgaagaataaaggttgcaattttgcaaaggtcatgtgttatataaattttcagtaagatgagatagttttaaatatttatggcatggacctaaaatacacttgcactctttaggatgaaggaatctattattttgttggtaagtgaggaatttaaatggccactaatttcttgcacgaatagctctgcacgtttttctccatgtgtttgtagcgtgtacctttatcggtcaagcaacagagtctcgctgtgtaccccaggctgcagtgcagtggtgcaatcaaggctcactgcaacctctgcctcccgggttgaagtgattctccctgcctcagcctcccgagtagctggtattacaggtgctcgccagcacgccctgctaatttttgtatttttagtagagacagggtttcaccatgttggccaggctggtctcaaactcctgacctcatgatctgcctgcctcagcctcccaaagtgctgagattacaggcgtgagccaccacgccgggcctaaaatcttaattaaaagatataatggaaacatagacaacataataataaagccatatacaacagtcttaccatatgggcagtatggatgtaacaatattgattcttccaacccataaacataaaatatctttccatttctttgtgtactcctcaatttccttcatcagtattttacagtttttattatagagatcttttacttctttggttaagtttatttctatgtattttatttgtagcaattataaattgggttacattcttgatttctttttcagattgtttgctgttggcatatagaaatgctactgttttttgtatactgattttgtatcctgcaactttgctgaatttgtcaatcagctctaataattttttggtggagtccttaggtttttctaaattataagattatatcatctgtgaacaagaataatttgacttttcctgtcccaatctggatgccatttatttctttctcttgtctaattgttctgtctaggacttccagtgctatgatgaataatagaagtgaaagtgggcatccttatgttcttctagatcttagaggaaaagctttcagttttttcccattcagaatgttactagctgtaagactgttgtatatggctttattatgtttacatacattccttccttaccaatctttttgggagttttttttatcatgaagggtgtagatttttattgaatttttttcagaattatttgaaattatcatatggtttttgttgatatgatgtatcattctgttgatatgttgtatcacactgattgatttgcatatggtgaaccatccttacattcctggaataaatttcatttggtcatattaaatgattttttaaattcgttgttgaatttgatttactagtattttgttgaggatttttgcatcaacattaatcagagatattggcctgtagttttctttttctgttgtgtgtttgtctggctttggcataaaggtaatactggccttgtagaatgtgtttggaagtattccctcctcttcaattttttggaatagtttgagtaggattggtattagttcttctttaaatgtctggcaaaattcagcagtaaagctatcatcaggttccaggcttttcttttttcattttaatccatttgctgctgccagaaaatttaatttcatttttagttagtaggccactgactagtttagtgcgtagacttcatgtttccatggttctttagtttgtttaattgtctcaaagtggtaaccaataaaagtttccaaatttaaaacctttcatttgtaaatggatttctatgaaacttgtaagtacaaaatctcagaaagatacaattaaattatactacatgatatctacatgtcacagaatcatgatcagaagttttcactcctgctcccaaataaaatgttggcctgacagatattttcaagtaaaatacttggctattcttgaatctgtaagaacatgagtcttttaaattacagcatctgaacaaaaaattcagggaaaaagaaataaataggcccttgactatggcctgccagaatccagtttggagataaaaagggcttaatttggaggcacagataacattgtactattaatttcctagactacttgcctaactttgatttgtctcatccaagaaatgactgagaagggaaagtgtatagtattatctagtcttttgtttaacttttacctgtttcttcatggaattaaatgataaaagagaaacaaaaataggttcttaaattaagcatcaagactaaagatagatatttaagacacattttaatgattaattgtgaaatcacccttcaaaagatggaaaagaaattttgaaacaattcttggcttggtcaggaagacaattagtgtcttcagttaaaactatgataatagtgttgtcaccaaaatggtggaatagggagccctaggccttgttccccaatagagacagcaacttaacaacaatatatggaacaaattaccttttttggaactccagaaacaacttatgttgcagcaccccaggtaaatccaaagccaagaagagctgtattgaagtggataagaaagtgtattatatttacttgtgatacccccttcaactagtgtgcacagcacagtatgctcaagagagaatttggaatatcagaaacataaagtgggaggcaagacgtaaagaagtagagtttttgcatgtgattgaagttgttaccagtttaaaatatattgttgaaactttaagatgttttatgtgatccccatggtaaccacaaagagaacagcttgtgaatgtacacaaaagaaaatgtgatcctttcagtaaccacaaagaaaatagctaatgaaaatacacaaaagaaaatgaaaaagaaatcaaggcatatactaccaaaaagaaaatcaatgaaacaaaaaggaaggatgccagagaaaaagaggtacaaaatagctacaaggcatacaaaaacacaatgaataaaatgtcaatagcagttcttccatattagtaatatctttcatgtaaatagactagtttccccaataaaaagacaggttggctgaatggattaaaaaattctactatatgctgtgtacaagagactcactttaaatctaaggagacatataaggtgaaagtaaaagaatagaaaagatactccctgcaaattgtaacaaaaagagagtatacaaaaacagagtataggtggctacatctataccagaaaaaaaaatagtcattaagtaaaaaatatcacaaggtacaaagaacaatatataataacctggtccatttaccaggaaaatataataattataaatatatacacacctaacgtcagtgttctcaaatatgggaagcagacattgacaggattcaagggagaaataaacagcatacaataatagtaggattcaatactccactttcaataatgggtagaacagccagcagaagatcaataatgggacagaggacatgaataacatcatagaccaaatggaccaaatacacatccatacaacatttcacccaacagtggcagaatacacattcttctcaagcacagttggaacattctgcgagaaagaccacatactagaccactaaacaagtcttaacagttttaagcagattgaaataatatcaagtatttttcccagtacaatagaatgaaactagaaatcaatagcagaagaaaaactggaaaattcatgaatatgcagaatttaatcaacacactcttaaataaccaatgaatcaaagaaggaatcacaaggaaaattgcaaaataatttgtaaaaaagaaacaaaaatacaacacactaaaacttacagaagcagcaaaagcaatactaagagagaattttatagtggaatatgccataaaaaaaagaaaggcctctcggcagggcgcggtgtctcatgcctgtaatcccagcactttgggaggctgaggtgggcggatcacaagttcaggagattgagaccatcctggctaacacgacgaaaccccgtctctactaaaaacacaaaatattagcctggcatggtggcaggtgcctggagttccagctacaggaggctgaggcaggagtatggtgtgaacccgggaggcagagcttgcagtgagctgagatggcaccactgcactccagcctgggcaacagagtgagactccgtctcaaaaaaaagaaaagaaaggtctcaaatcaacaagttaattttatacacaaaggaaccagtaaaagagaacaaactaaatccaaagttagcagaaggaagaatataaagattagagtaagaataaatggaataaagaataacttttataaaagttagatttaaaaaataacaacaaaattgaaaatcctttagctagattaagaaaaagagagaatactcaaataactaaaatcagaaatgaatgcctcattcattttttatcagatattataactgatgccacagaaatagaaaggattataagggactactaagaacaattataagccaacgagttaggcaaactagaagaaatgggtgaattcgtggtaagatacaacctaccaagatggaatcatgaagaaataaagaaatctgaacagatgtgtaactagtaaggagaataaatcagtattcaaaaatctcccaacaaaaaatggaccagacccaaatgatttcactggagaatctaccaaacatttaaagaaaaattaataattatccttaaactcttccaaaaaaatcgcagagagaaaacacttctaaacttattttataagggcaacattaccctgataccaaacctagacaaagatacaagaaaactatagattattacacctgatgaatattaatgaaaaatcctcaacaaaatatttgcaaactgaatttaacagtacattcaaagaactatatattgtgaccaggttttattcctcctaatgcaaggatagttcaatatatgaaaatcagtgtaatacattgcattaacagaataaaagacaaaaagcacacaatcatcttaattgattcagaaaaagcatgtgacaaaattgaacaccctttcatgacaaaattaagaaacgaagagtagaaaaaaattacctcaacataataaatgttatgtgtgggtttgaataagtatgtatgtatatgtatagatatacacataaatgttatataaatataatatgtgtgcacacatacagggctaacaccatactcaatgatgaaaacctgaaaactttccctaagatcaagaacaaggcggggcggttccaagatggccgaataggaacagctccagtctaagctcccagcataagtgatggagaagatgggtgatttctgcatttccaactgaggtactggcttcatctcactggggcttgtcagatagtgggggcaggacagtgggtgcagcccactgagcatgagctgaagcagggcaaggcgtcgcctcacctgggaagcacaaggggtcagggaattccctttcctagccaagggaagcagtgacagaaggcacctggaaaattgggtcactcccaccctaatactgcacttttccaatggtcttagcaaacagtacaccaggagattatatcccgtgcctggctcggagggtcccatgcccacggagcctcacttattgctagcacagcagtctgagattgaactgcaaggcggcagtgaggctggggaaggggcacctgccattgctgaggcttgagtaggtaaacaaagtggcctggaagctcgaactgggtggagcccaccacagctcaaggaggcctgcctgcctctgtagactccacctctggggacagggcatagctgaacaaaaggcagcagaaacctctgcagacttaaatgtccctgtctgacagctttgaggagagtagtggttctcccagcatggagtttgagatctgagaacagacagactgcctcctcaagtgggtccctgacccctgagtagcctaactgggaggcaccatccagtaggggcagactgacaccttacacggccaggtaccacactgagatgaagcttccagaagagcgatcaggcagcaagatttgctgttcagcaatattcactgttctgcagcctccgctgctgatacccaggcaaacaggggctggagtggacctccagcaaactccaacagacctgcagctgagggtcctgcctgttagaaggaaaactaacaaacagaaaggacatccacaccaaaaccccatctgtacgtcaccatcatcaaagaccaaaggtagataaaaccacaaagatggggaaaaaacagggcagaaaagctgaaaattctaaaaatcagagtgcctctccccttccaaaggaatgcagctcctctccagcaatggaacaaagctggacagacaatgactttgacaagagaagaaagcttcagatgatcaaacttctccaagctaaaggaggaagtttgaacccatcgcaaagaagctaaaaaccttgaaaaaagattagacgaatggctgactagaataaccagtgtagagaagacctcaaaggacctgatggactgaaaaccgtggcacaagaactacgtgacgaacacacaagcttcagtagccgattcgatcagtggttgaagatcagatgaatgaaatgaagtgagaagagaagtttagagaaaaaagagtaaaaagaaacgaacaaagcctccaagaaatatgggactatgtgaaaagaccaaatctacgtctgattggtgtacctgaaagtgacggggagaaatggaaccaagttggaaaacacttggcaggatattatccaggagaactttcccaagctagcaaggcaggccaacattcaaattcaggaaatacagagaatgccacaaagatactccttgagaagagcaactccaagacacataactgtcagattcatcaaagttgaaatgaaggaaaaaatgtcaagggcagccagagagaaaggtcaggttacccacaaagggaagcccatcaaactaacagaggatctctcggcagaaactctacaagccagaagagagtgggggccaatattcaacattcttaaagaaaagaattttcaacccagagtttcatatccagccaaactaagcttcataagagaaggagaaataaaatcctttacagaccagcaaattcggagagatttttgtcactaccaggcctgccctacaagagctcttgaaagaagcactaaacatggaaaggaaaaaccggtacaagtcactgcaaaaatatgccagattgtaaaggccatcgatgctaggaagaaactgcatcaactaatgagcaaactaaccagctaacatcataatgacaggatcaaattcacacataacaatattaacgttaaatgtaaatgggctaaacgctccaattaaaagacacagactggcaaattggataaagagtcaagacccatcagtgtgctgtattcaggagacccatctcacgtgcagagacacacataggctcaaaataaagggatggaggaagatctaccaagaaaatggaaaacagaaaaaggcagggattgtgatcttagtctctgataaaacagactttaaaccaacaaaaatcagaagagacaaagaaggccattacataatggtaaagggatcaattcaacaagaagagctaactatcctaaatatatatgcacccaataaaagaacacccagattcataaagcaagtccttagagacctacaaagagacttagactcccatgcaataataatggcagacattaataccccactgtcaacattagacagatcaatgagacaaaaagttaacaaggatatccaggaactgaatgcagctctgcaccaagcagacttaatagacatctacagaactctccaccccaaatcaacagaatatacattcttctcagcaccacatcacacttattccaaaactgaccacatagttggaagtaaagcactcctcagcaaatgtaaaagaacagaaattataacaaactgtctctcagaccacagtgtaatcaaactagaactcaggattaagaaactcaatcaaaaccactcaactacatggaaactgaagaacctgctcctgaatgactactggctacataatgaaatgaaggcagaaataaacatgttctttgaaaccagcgagaacaaagacacaacataccagaatctctgggacacatttaaagcagtgtggagagggaaatgtatagcactaaatgctcataagagaaaacagaaaagatctaaaattgacaccctaacaccacaattaaaagaactacagaagcaagagcaaacacattcaaaagctagcagaaggcaagaaataactaagatcagagcagaactgaaggaaatagagacacaaaaaacccttcaaaaatcaatgaatccaggagctggtttttcgaaatgatccacaaaattgatagactgctagcaagactaataaagaagaaaagagagaagaattagatgcaataaaaaatgataaaggggatatcaccactgatcccacagaaatacaaactaccatcagagaatactataaacacctctatgcaaataaactagaaaatctagaagaaatggataaattcctggacacatacaccctcccaagactaaaccaggaagaagttgaatccctgaatagaccaataacaggctctgaaattgaggcaataattaatagcctaccaaccaaaagatgtccaggaccagatggattcacagccgaattctaccagaggtacaaggaggagctggtaccattccttctgaaactattccaatcaacagaaaaagagggaatccttcctaactcattttatggggccagtatcatcctgataccaaagcctggcagagacacaacaacaacaaaaaagagcattttagaccaatatccctgatgaacattgatgcaaaaatcttcaataaaatactggcaaactgaacccagcagcgcatcaaaaagcttatccaccatgatcaagtgggcttcatccctgggatgcaaggctagttcaacatacacaaattaataaacgtaatccagcatataaacagaaccaaagacaaaaaaccacatgattatctcaatagatgcagaaacggccttcgacaaaattcaacagcccttcatgctaaaaactctcaataaattaggtattgatgggatgtatctcaaaatagtaagagctatctatgacaaacccacagccaatatcatactgaatgggcaaaaactggaagcattccctttgaaaactggcacaagacagggatgccctctctcactgctcctattcaacacagtgctggaagttctggccagggcaataaggcaggagaaagaaataaagggtatccaattaggaaaagaggaagtcaaattgtccctgtttgcagatgacatgattgtatatttataaaaccccatcatctcagccaaaaatctccttaagctgataagcaacttcagcaaagtctcaggatacaaaatcaatgagcaaaaatcacaagcattcttacacaccaataacagacaaacagagagccaaatcatgagtgaacacccattcacaattgcttccaaagagaataaaatactaggaatccaacttacaagggatgtgaaggacctcttcaaggagaattacaaaccactgctcaacgaaataaaagaggacacaaacaaatggaagaacattccatgctcatggataggaagaatcaatatcatgaaaatggccatactgcccaaggtaatttatagattcaatgtcatccccatcaagctaccaatgactttcttcacagaattcgaaaaaactactttaaagttcataggaaccaaaaaagggcccacattgccaagacaatcctaagccaaaagaacaaagctggaggcatcacgctacctgacttcaaactatactacaaggctatagtaaccaaaacagcatggtactgttaccaaaacagagatacagaccaatggaacagaacagagccctcagaaataataccacacatctacaaccatctgatctttgacaaacctgacaaaaacaagaaatggggaaaggattccctatttaacaaatggtgctgggaaaactggctagccatatgtagaaagctgaaactgtgtcccttccttacaccttatacaaaaattaattcaagatggattaaagacttaaatgttggacctaaaaacataaaaaccctagaagaaaacctaggcaataccattcaggacataggcatggtcaaggacttcatgtctaaaacaccaaaagcaatggcaacaaaagccaaaattgacaaataggatctaattaaactaaagagcttgggcacagcaaaagaaactaccatcagagtgaacaggcaacctacagaatgggagaaaatttttgcaatctactcatctgacaaagggctaatatccagaatctacaaagaactcaaacaaatttacaagaaaaaaacaaacaaccccatcaaaaagtgggcaaaggatatgaacagacacttctcaaaagaagacatttatgcagccaacagacacatgaaaaaatgctcatcatcactggccatcagagaaatgcaaatcaaaaccacaatgagataccatcgcacaccagttacaatggcgatcattaaaaagtcaggaaacaacaggtgcttgagaggatgtggagaaataggaatgcttttacactgttggtgggactgtaaactagatcaaccattgtggaagacagtgtggcaattcctcaaggatctataactagaaataccatttgacccagccatcccattactgggtatatacccaaaggattataaatcacactcctataaagacacatgcacatgtatgtttattgcagcactattcacaatggcaaagacttggaaccaaccaaaatgtcaatcaatgatagactggattaagaaaatgtggcacatatacaccatggaatactatgcagccataaaaaaggatgagttcatgtcctttgtagggacatggatgaagctggaaaccatcattctgagcaaactatcgcaaggataaaaaaccaaacactgcatgttctcactcataggtgggaattgaacaatcagaacacttggacacaggaaggggaacatcacacactggggcctgttgttgggtggggggagggatagcattaggagatatacctgatgtaaatgatgagttaatgggtgcagcacaccaacatggcacatgtatacatatgtatcaaatttgcacattgtgcacatgtactctagaacttaaaagtataataataataaaaaaaaaagaaaaagaacaaggcaagaatgtccatactgaccacttcttttttttttttttttgagacggagtctcgctctgttccccaggctggggtgcaggggcacgatctcggctcactgcaagctccgcctcctgggttcagccattcttctgcctcagcctcctgagtagctgggactacaggcgctcgccaccatgcccggctaatttttttttttttttgtatttttttagtagagacggggtttcaccgtgttaaccaggatggtctcgatctcctgacctcgtgatccgcctgccttggcctcccaaagtgctgggattacaggcgtgaaccaccacgcctggcccatactgaccacttctattcaacatagtagtgacagtcttagcctgggaaattagatatgagaaagaaataacagctatccaaaatggaaagcaagaagtaaaatgatctctgtttacagatgacataatcttattgtagaaagcactaaaaactgttagaactaataaattcaacaaaattttataatccaaagtgaacaaaaagtaattgcatatttatacactaacagtcagtaatccaaaaacgcatttaagaaaacaatcccatcaggaacttataaaagcataaacaatagtaacaagaagaataagatactttggaataaacttaaccaaggatgggaaaaccttgcacactgaaaactacgaaacaggctgggtgcagtggctcacacctgtaatcccagcactttgggaggccaaggtgggtggattgcttgagtccaggagttcaagaccaagttgggcaacatggcgaaaccccctctctactaaaaatacaaaaaatagccaggcatggtggcacatgcctgtagtcccagttacttgggaggctgaggtgggagaatcacctgagctcaggaggtcgaggctgcagtgagccgagatcatgccactgcactccagcctgggcaaacagagtgagaccctgtctcaacaaaacaaaacaaaacacagcaaaacacaaaaaacctacaagacattgctgaaagaaattaaagagacataaataaatagaaagacatcctgtactcatgaattgaaagacttagtgttaagatatccatgtacccaaagtgatttactgattcaatgcaattcttaacaaaatgcaaatgacttttttgcagaaatggaataaaaccattctataatttacatagaatctcaagggaccctgcatagccaaaacaatcttaaaaaagaagaatgaagttagagtgctcacacttttgattttaagaatattttgaagctacagtaattaaagacagtgtaacactggcataaagacacatatacagaccaatgaaacagaacaggaagttcagaattaaactctcacatacatgatcttcaacaagggtaccaagacaaaacaatggggaaaggacagtctcttcaataattggtgttgtaaacactagatatccacatgcaaaagaatgaagttgaaacttaaccttacatcatatataaaaattaacttaaaattgattaaagacctagacatgagacctacaactgtaaaatgactaggagaaaagtgtaagaaaagcttcatgacactgaatttggtaatgatttcttgaatatgataccaaaagaataggaaacaaaagaaaaaggtagacaaataggactacatcaaacttaaaaatttttgcacatcaaagaaacagtgacaaagcaacctgtgaaatgagagaaaatatttgcaaattatatctaaaaggggttaatatccagaatacttgtctatagagaaccactacaagtcaacaacaaaagacaatctgttaaaaaaatgggccaagaacttgaatagacattcctcccaagaagaagtataaacattaaaaaaatgttcagtgcctttaatcaaattaaaactacaatgagcgatcgcctacccatcaggatggtcactacaaaaaaagaccaagcaaaacatattggaaggatgagaagaaactggaacccttttacactgttggtaggaatgaaaaaatggtgcagctgctatggaaaaatgatctgaggttccccaaataattaaaaatagaactactatatgatccaggaatctcacttctgggtatgtatgcaaaagaactaaaataattatgtcaaagagttatctgcatacccatgttaattgcagcattattcacaaaagtcaagagttggaagcaacccaaatgtctattaaaagatgaataaagaaaatgtggaatatacatacaatggaatactatttgaccttaacaaagaagaaaattctgtcacatgctacaacatgaatgaaccttgaggatattgtactaagtgaaataagccaatcacaaaaagacaagtattgtatgattacatttataggaggtttcaaaaatagacaaactcatagaaacagaaactacaatggtgattgccagagactggggacatggagaaatggggagacgttgtttaactggtttagtttcaggtttgcaagattaaaaagttctggagatttgttacacaacactgtgcatacagtgaacgctactgaactgtgcacttaaaaagtggttgaaatggtaaatttcttatgtgttttaaaatatatatgtattttttaatttttaatttttttttaatttttttgagacagagtctcactctgttgcctgggctggagtgcagtggcgtgatctcggctcactgcaagctctgcctcctgggttcacgccattctcctgcctcagcctcctgagcagctgggactacaggtgcccgccaccaggcccagctaattttttgtagtttttagtagagatggggtttttcaccgtgttagccaggctggtctcgaactcccgacctcaggtgatccgcccacctcggcctcccaaagtgctgggattaccgcgtgagccaccacgcctggcctgtatgtgtttttaaaatcacaatgagaaattaaaaaataaaatgaaaataagaaatgcttagcatataagaaagtgaagcatcgaagcccacgaagatacagcgagtttgcttactcccagcttgtctggcactgtccagatcttactgccgatagccctgcaccctgagtataacctcagtcccaggcacaccaggtgttcggatattctatatgaaaaccagagcatttaaagaaatggtgtaaacagaataaaggtattttgttgaaagtaaagtataatgctatccttacttggtaatcccattgcctttaaagtgaagcatattactgggatgtaaacctgtatttttctctcttggctctttaacagattctccagatctgtcttatttatatttccttcaaaatacttctgtgatttctatcttttcttgtttccaagccacacttcagcttcattccttatgcacaggagagcctgttcttggtttcttttcttccaggttctgatttttaatctgcccaaattgtaactgggacatttattgacaaaaagaaatttgaacatgtaacagccttttttttccttctaatttttaagtggtttctaattaggtaatttcctgaaggttaaagttcttaaagtctctgatttattagttcatcattcttaattttttcagttttctatcattgtctagtagagtatgtccagttgataggatatctgaggacatattatctctccatcaatttatttctgtattacacacactttctctccattctcttcttcagaccttctgcaccacctcccctcaacagttgtaacaaataaaaatgtctccagacattgctgaatgtcccgaggcggcaaaatttcctctggttgagcacagctgatagaaataatgcccaaatttcaagattttttccaaagtggtcttcatattcaattcccaaacgtgtacttaacattgttctttctgaaaagagtactttccccattttctctacctggagagaactccaggaagctgagaccggccagaccacagagcttgacccaggttccacacatttttcatgtgcaaattggaaagcacgatgagatatctctcttgcctgtcattatgatttttttttaagtgaaaaataggctgggcgccgtggctcacacctgtaatcccagcactttgggaggccgaggcgggcggatcacgagataaggagatgagaccatcctggctaacacggtgaaaccccgtctctactacaaaatacaaaaaattagccaggcgtggtggcggccgcctgtagtcccagctactcgggaggctgaggtaggagaatggcgtgaacccgggaggcggagcttgcagtgagccgagatcgcgccactgcactacagcctgggcggcagagccagactccatctcaagaaaaaaaaaaaagtgaaaaataaaaatcctggtttctggggaatcaatcactcatatagtgctgtcgttaacataaatatccaaatcttcacagaggaacagaggacaatatgacaataagcactacattttcaagtgtcttttatacccattgaaaatttggtagaaattagatatctaggaatttcccctaacagagtaaatatacagaccgtgtgcggtggctcacgcctgtaatcccagcactttgggagaccaaggcgggtaggtcacgaggtcaggagatcaagaccatcctggctaacatggtgaaaccccgtctctactaaaaatacaaaaacaaaattagacgggcgtggtggtgggcgcctgtagtcccagctactcaggaggctgaggcaggagaatggcgtgaactcgggaggcagagcttgcagtgagccgagatcgcgccattgcactccagcctgggcgacagagcaagactacgactcaaaaaaaaaaaaaaaaaaaagtaaatatacagaaatacctggctataaaactgtcacagcttatttataataacctcaaactggaagcaatctaaatgtccatcaaaaggggactagaataatactcaaccctaaacaacatattgtggaatatttaatgacatggaatgacttctattttaagaacaaaacaggcggggcgcagtggctcaagcctataatcccagcactttgggaggccgaagcgggcggatcaccaggtcaggagatcgagaccatcctggctaacacggtgaaaccccgtctctactaaaaatacaaaaaattagctgggcgtggtggccgacgcctgtaatcccagctactcgggaggctgaggcaggagaatggcgtgaacccaggaggcggagcttgcagtgagccgagatcgcgccactgcactccagcctgggcgacagagcaagactacgtctcaaaaaaaaaaaaaaaagaaacaaaagatgtcaagtccttagtcattataaaaatgatgcttaatcattttcttggattttgcagatgaattggtgaatagctttgtgacagacctttgttcaagatccattcaaggatagaagacaattgcattgaatggttgaatagggagatttctcaggagaatgttgctgggtgcggttgaatatttactctcccacatccttgcctggcaggagggcctgtaaggaggctattctatgagcttgtatcatctccctggattctaggagcaaattaagaagcaaatgttggacctctgcctgtgaaaaccacaggtccaagacactgagaggaaccaggaaccacggtaagaagagaggaaagtggtgtgagtgcctacactttcatcatttgcatgacaagggggtcccatgagtcaagtacagtctaggaggtaattgaggtggagctgtgcagaagggaccctgaccaagagttgaggggcaccagcggagaggctgtgggttgcacctccaggggcggatgctggaagtggtgcctgaaaggagtcagcaggaagagccacattgcttgtatcttgagacataactgggtgtgcaaaatgggaaatcactgtggatctctcagtaggaatctttcagggatagagccggttgtgaacattctgtaacatcagattaaatagggccttttctgttcttcatctctctttcatgcctttcttcccccagatagacatactcagtgagctctcttcccagtttgaagcaggtctgaggtggagaagtagagaaaatcaaagttttgactattgcatggaagtggacatcctaattattgaaataatactgttgtggccagggctgatgtttagctgagatgtactggtgtggttgcactggttattaaaatattaaaatactttaatattggttggtaaacagtcctgatcctaggccccttgagggcctcccctgggccctggaaaccctgtgggcactgctattcctccttcccaccccctccacacacttcctatccctgagaccagtgtccccggcggtgaggctgatgctccagtgggctgtacccaatgtctctggttttgcagccgggcttcctgggattgtcctcatgtgatccttatgggaacagcaacttcctcaattgtcacctcttttaaatgtcacccaagatcagttatgaactggctcaagttttatgcaaaagagtctcccaaaatcggcctcaaaagcacttttgttaggacatttttgagaaaaaaatatatgatgctttatgattttattctactttttcaatgtcacatttacaaatgtttataattaagttaaaagggtgaggcagaaaaccaggcaactctgtactgatttttgtaatataatctgtctcaaaatataccattagaagtttaaatatttaaatagttataaccatttctaggggatggtaacatggctaacttttagacttttatttattagtttttttttttagacggaatctcgctctgttgcccaggctggagtgcagtggtgtgacctcagctcactgcaagctctgcctcccaggcttatgccattctcctgcctcagcctcccaagtagttgggactacaggtgcctgccaccacacccatctaattttgtttttgtatttttagtagagacggggtttcactgtgttagccaggatggtatcgatatcctgaccttgtgatccacccgcctcggcctcccaaagtgctgggattacaggcgtgagccaccacgcctggccctggccagtatttcttaagtttcattaaaaaaaaaaatacatatatatatatagtactcttttgactattactattttgaatgagaggaataaaataatacatgcaactaaatgggattttgtatttttccttcacatacattgacctacgtttaaaatgtaagcctctcaccctcctgacaactccatatccccaccccctgctctatgtggtcagagttggtgcatcccaatgccttgaatagggtctgacacatttgctgttggaatcacttgaatcatttcacttagcaggaacatagtaaagtataaatgatgctgaggtatatctccccaaggaggaggacacagaacaggttctctgtggggacaggaggagggactggccctgtgtacccactgcctccccacggcttcctcaacttttgcttgatttttcctcgatcaggaacatgacatcacattcatccagaccttgaacctatcttattaggtttattcctaggtattttcttgtttttctgacatgcaaatataatctttttccttatttcaattttctggttgattatttccatcataaaggaaagttgctctgtaaaatttacctgtttctagccacgcgataaaattttcttattagtttcaatggtgactgtatacacacacacacacacacacacacacacacatactttaagttctgaatacatatgcagaacgtgcaggtttgttacataggtgtacacgtgctatggtggtttgctgcacccttcaccccatcatcaacattaggtatttctcctaatgctatccttcccctagccccccaccccgacccccaccgacaggccctagtgtgtgatgttgccctccctgtgtccatgtgttctcattgttcaactcccacttaatgactgagaacatggggtgtttcattttctgttcctgggtaagtttgctgagaatgatggtttctagcttcatccatgtccctgaaaaggatgtgaactcatccttttttatgactgcatagtattccatggtgtatatgtaccacattttctttatccagtctgtcactgatgggcatttgggttggttccaagtctttgctattgtgaacagtgctgcaataaacatacatttccatgtgtctttatagtagaatgatttataatcctttgggtatatacccagtaatggtatcgctgggtcaaatggtatttctggttctagatccttgaggaatcgctacactgtcttccacaatggttgaactaattcacacttctacccacagtgtaaaagcatccctatttctccacatcctctccagcatctgtggtttcctgactttttaatgattgccattctagctggcaatctctttgtggttttggtatctcattgtggttttgatttgcatttctctaatgaccagtgatgatgagctttttttcatatgttttttggccacataaatgtcttcttttgagaagtgtctgttcatatcctttgcccactttttgatggatggggttttttatttttacttgtaaatttctttaagttccttatagattctggatattagccctttgtcagaaggatagattgcaaaaattttctcccattctgtaggttgcctgttcagtctgatgacagtttcctttgctatgcagaagctctttagtttaattaaatctcatttgtcaattttggcttttgttgccattgcttttggtgtttttagtcatgaagtctttgctcatgcctatgttgtgaatggtattgcctaggttttcttctagggtttttagggtttttatggttttaggtctaacatttaagtctttaatccatcttgagttaatttttgtataaggtgtaaggaagggatccagtttcagttttctgcatatggctagccagttttcccaacaccatttattaaatagggaatcctttccccattgcttgtttttgtcaggtttgtcaaaaatcagatggttgtagatgtgtgtcattatttctgaggcttctgttctgttccattggtctatatatctgttttggtaccagtaaatggttactttttttaaaaagcaaactctttcgaattttatatgtttataatacagcaaataattttgtcttgcttttagaaaaaaattgaggtaaaattcacgtaacataaagttaaccattttacagtgaacaattcggtaacactgagcatatttacaatgttatagaagtaccacctctgtttagtttcaaaatattttcatcactgcaaaataaaaccatgtaagcagtcaaatcccacctgtcctctcctcctgtctctgtcaaccaccgatctgttctatgggtttacctatcctggatatttcatataaatgaaattatacaataaccctgtataattttttgtgggcctgacttctttcatttagcataatgtttttgaggttcattcatgttatagcatttatcagtactccacttctttttatggctgcataatattccactatatgtgtatatcataatttgtttatacattcctctgttgacggacatctgggttgtttccaacttttggctgttttgaatagagctctttcgaacatgtatgtacatgtatttgtttgagaactcgttttcatttctttggggtatatacctaggagtgaaattgctgagtcatatagtaattctatgttcaactttttgaccactgccaaactgttttccgcaaacatcatcatcactagccatgtatgatttactccacatcttcaccaacacttggtgtttaatatttttttttaattatagccatcctggtagtgaagtggtatctcatcgtggttttgatttgtatttctctaataactaataatattgaacatcttttcatgtgcttgttggccatttgtagatcttctttggagaaatacctatataaactctttgaccatttcattttaattgagttgtttgtctttctattgttgagtagttaaagttctttatatagacacatcatttagagatttgcaatttttttctcccattctgtaggctatttttaaactttcctaataatatcatttggtgtacaaaagttttaaattttgatggagcccaatttatatatttcttaatttgttgttgatgcttttggggtcatgtctaagaacatgtatgtacctaatctgtatctgagaacctaatctcagattcaagatcaggaagatttaaccataggttttcttctaagagttttgtagatttagctcttgcatttaggtctttgatacattttgagttagtttttctatatggtatgaaataagggttcaacttcattcttttgcacgtggctatttggttgtctaagcactatttgttgaagagactattctttccccattgaatggtctttgcaccccgtcaaaaattaatcaccacaaatgaatgggcttatttctggaatcacaattctatttttctcatctatatgtttatccataaggataaacagtgccacactgttttgattattgttaactttgtaataagttttgaaattagaaagtgtgagttctccaactttactcttctttttcaataatactgtcttagctgttcgagatcttttgcaattccttacatatttgataattagcttttcaatttctgcaaaaaggctattcaaattttgacatagattgtattgaaactagatctgtttaagtattgccattgtggcaatatcaagtcttccaatccatgaacacaaggcatatttccatttatttaggtattctttaatttcttttagcaatggtttgtagttttcattgtgtaatactttcacttccttgataacatttaatttgaggttttttaaatcatttttatgctattataaatggaattgtcttaatttagtttttaaattattcactgcgcctttctaagaacacatgtgatttttgtgttcagctgtacctttgctgaatttgtttattagctgtagtagtggattctttgggattttctatatctaggtttatcagtgaatagagatctttcgatgcttcttatttatttttcatttctgatttctctggctagaacttccagtacaatgttaaatgaaagtggtaaaaggggtcctccttgttttgttcctgaccttaggggaaagttttagtctttaaccagtgaatatgattttgactatgggtttttcataaatgcccttattttatgttaaggaattccccttcaatttctaattttatacgaggattttttttttcttttgagacgaagtctagctttgtcgcccaggttggagtacagtggctcgatcttggcttactgcaacctccgcatctcgggttcaagtgattcttctgcctcagcctcctgagtagctgggactacaggcacctgccaccaagcccagctcattttttttttttttttttttttttagtacagacgaggtttcaccatgttgaccagcctggtctcaaactcctgacctcatgatccacccacctcaggctcccaaagtgctgggattacagatgtgagccaccatgcccggcttgaggatttttatcatgaaagtgtggcagattttgttgaatgcattttctgcagttgagatgatcctgaatttctcctcgcccccacacacctttatcctattaatgtcatataatacattgggtttctaatgttggaccatccttgctttcctgggctgaattccacttagatatggtataaaatccttttaatatgctgttggattttatttgctagcattttgttgtggatttttgtatctttattcataagggatattggtctgtagctttcttttcttggaatatctttccctggttttcatatcagggtaatgctgtccttatagaataagttagaaagtgttccctccttttcaattttttggaagagcttgagaaggatagatattaattgttttttaatttgtatttttatttcaatagttttggaggtacgggtagtttttgcttacatggataagttctttagtggtaatttctgagattttggtgtacctgtcacctgagcagtgtacactgtacccaacatgtagtcttttatcacttatgcctctcccactcttcccctgagtccccaaagtccattatatcattcttatgtatttgcatcctcatatcttagctcccacttaaaagggagaacatatgatatttggttttccattcttgagttacttcacttaaaataatggcccccaactccacccaagttgctgcaaaagacattattttatttctttttatgtctgagttgtattccatggtgtatatatactacattttctttattcactcattggttgatgggcacttaggttgattccatatctttgcaactgcaaattgtgctgctatcaacatgcatgtgtgtgcatgtatcttttttcatatagtgacttatttccctttgggtacttacccaatagcaggattgctggatcgaatggtagttctacttttgatcctttaaaactgttttccggcctggcgcagtggctcacgcctgtaatcccagcactttgggaggcctaggcaggcagatcacgaggtcaggagatcaagaccatcatggctaacacggtgaaaccctgtctctactaaaaaatacaaaaaattagccgggcatggtggcgggtgcctgtagtcccagctactcgggaggctgaggcaggagaatggcgtgaaccctgggaggtggagcttgcagtgagccaacatggtgccactgcagtctagcctgggcaacagagcaagactctgtctcaaaaaataaataaataaataaaataaaaaaccaaaaaaaaaatctgtgttttccgcagtggaaaactagtttttccatactgttttccatagtggttgtactagtttacattcctaccagcagtgtagatgtgttacctttccaccacatccacgccaacatctattgtattttgactttttaattatggccattcttgcaagagaaaggtgatatctcattgtggttttaatttgtatttccctgataattagtgatgttgagcatttttttcactttgttggatgtttgtatattttcttttgacaattgtctattcatgtcctttgcccactttttcatggaactattattattttttactgttgatttgtttgagttcttgtagattttggatatcagtcctttgtcaaatgcataatttgcaaatactttctcccaatctgtaggttgtctgtttactctgctgattatttcttttactttgtagaagctttttagtttaattaggtgtcatgtatttatttttgtttttgttgcattgcttttggggtcatagtcaagaattctttgcctaagccaatgtctagaagactttttctgatgttatcttctaaaatttttatggcttcaggtcttagatttaagtctaagttttcttagatttaagctattttgagttgacttttgtataagtgagagatgaggattcagtttcattcttctatgtgtggcttcccagttttcccggcaccacttattgaagagagtgtcctttccccaatttatgtttttgtttgtgttgttgaagatcagttggctgtaagtatgttggctttatttatgtgttctctgttctattccattggtctatgtgcctacttttataccagtaccatgctgttttggtgactttagccttgtagtataatttgaagttgggtaatgtgatgcctccagatttgttctttttgcttagtattgctttggctatgcaggttcttttttggttccatatgaatttcaggattgctttttctggttctataaagaatgatgacggtattttgttgggaattgcattgaatctgtagattgctttggacagtatggtcattttcacaatatttattctacccatctgtgagtgtgggatgtgtttccatttgtttgtgtcatctatgaatctttcagtagtgttttgtagttttccttgtagagatctttcacctccttggttaaatatatttgtaagtattttgttttacttttgcagttgtaaaagggattgaattcttttttttttttttttttttttttttgagatggagtctcattctgtcgcccaggctggagtgcaatggtgcaatcttagctcactgcaacctctgcctcccaggttcaagtgattctcttgccttagcctcctgagtaggtgggattacaggtgcccaccaatgtgcccggctaatttttgtatttttagtaaagagtgggtttttccatgttggccaggctggtttcgaactcatgaccttaggtgatctacctgcctcagcctcccaaagtgctgaggattgcggacatgagccaccatgcctggctgaattgaattcttaatttgattcttagcttggtcactgttggtgtatagcagtgttactgatttatgtacatttattttgtatcctgagactttattgaattcatttgttaggtctaggagcttttcagatgagtctttaaggttttctaggtatagaattatatcagcagtgaacagcaacagtttgacttcctcttttccagtttggatgccctttatttctttctcttgtctgattgctctggccagcacttccagtactgtgttaagtagaagcagtaaaagtgggcatccttgtcttgttccagttctcagggggaatgctttcagcttttccctattcagtatgatgttgcatatgggtttgtcatatatggcttttattactttaagatatgtcccttctatgcttattttgaggaaggtttttattataaaggaatgctggatttatatataatgataaaaggattagtcaaacaggaagatattatgatcctaaatttatatgcacctagcactggagcttccaaatttataaaacaattactactagacctaagaaatgagataaacaacagtacaaatatagtgggggacttcaatactccactgacagcactagacaggtcatcaagacagaaagtcaacaaagaaataatggacttaaactataccctagaagaaatgtacttaacagaaaattgcaaaacattcttcccaacaactgcaggatatacattttttttcatcagcacatggaacgttctccaagataacctatgataggttacaaaacaagtcccaacaaatttaacgaaattgaaatcatatcaagtattttctcagaccatagtggaataaaactggaaagcaactccagaaagaacacttaaaatgatataaatacatggaaattacataatctgttcttgaatgatttggtggttaacaatgaaatcaagataggaattaaaaattctttgaaatgaatgagaacaatggcacaacttatcaaaacttctgggatacagcaaaactggtgctaagaggaaagtttatagcattaaatgcctacgtcaaaaagtctgaaagaacacaaatagaaaacctaatgtcatacctgaaggaactagagaaacaagaacaaactaaactgaaactcagcagaagaaaagaaataacaaagatggaagagaactaaatgaaattgaaacaaaaaatacaaaagataaatgaaatgaaaagctggttctttgaaatgataaacaaagttgatgaccattagggagattaaccaagaagagaaaagattcatataacctcaagtagaaatgaaactggagatagtacaaccaataccacagaaatacacaagatcattcaaggatgttataaacacctttacatgcacagactagaaagtctagaggagatgaataaactgctggaaatatacaaccctcctagactaaatcaggaagaaatagaaaccttgaacagaccaataacaagcagcaagattgatcagtgattaaaaaaacaaaacaaaacactgccaacaaaaaaagaatcgagaaccagatggattaacagttgaaatctatcagacattcaaagaagaactggttatcaatcctactggaactattccaaaagatagagaaagagggaatcctccataaatcagtctatgaagccagtatcaccctaataccaaaaggaggagaggacataacaaagcaaacaaactacaaaccaatatccccgaacatagatgcaaaaatccccaacaaaatactagctaactgaatccaacagcatatgaaaaagataatgcatcatgaacaagtgggttttatatcagggatgcaaggatggtttaacatacacaagtcaataaatgtgatacatcacataaacaaaattaaaaactatacgattatatcaataggtgtgaatccctctttaaatgtttggtagagttaatcagagaagctatctggtcctgaacttttttgttgttggtggtaagttttaattactgattgaattacttcacttgttataggtctattcagattttctattctcgagtcaattttgatagattgtgtgtttctaggaatttgctaatttcatctaggttatctaacttgttggcataaaatagtttgtaatttttttttttttttttgagacggagtcttgctctgtcacccaggctggagtgcagtggcgcaatctcggctcactgcagcctctgcctcccaagttcaagcgattctcctgcctcagcctcccaagtaactgggattacaggcacctgccaccacaactggctaatttttgtactttcagtagaggcggggtttcaccatgttggccaggctggtctcaaactcctgacctcaggtgatctgcccgccttggcctcccaaagtgctgggattacaggcgtgagccaccacacctggcctgagcaatgatttgactacattcataatttgggtatatcatgttttcattttcatttggctcaaaatattttctaatatcccttataactttttatttgacctataggctgcttaaaattgtgttaatttctacatatttgtaaattttctagtttttcttctgttattgatttttagtttcattctgtatttgtcagagaagataatttacataactttatctttttacatttattgaaacttgttttatggcctaccctgacacatgatccacgtgctttgtgtattttgcaattgtttggtggagtattttcttttttttttctttttgagacgtagtcttgctctgtcgcccaggctggagtgcagtgccgcagatctcggctcactgcaagctccgcctcccgggttcacgccattctcctgcctcagactccaaagtagctgggactacaggtgcccgccaccacacctggctaatttttttcttgtattctttagtagagacggggtttcaccgtgttagccaggatggtcttgatgtcctgacctcgtgatcagcccgcctcggcctcccaaagtgctgggattacaggcatgagccaccgcgcctggcctcggtggagtattttctatatgtctgttaggtcttgttgatttacagtgtttttcaagtcctctatttctttattgatcttctgtctagatgttctatctgttattgaaagtgactgtttgagtccatttagtgttgctgtaacagactacctgtgactgggtaatttataaagagaagaggtttacttggcccatgattctggtgacttgaaggttcaagattgagcagctgcatctagtgagggcctccctcatgctgcttccactcatggcagaaagtggatggggtgtgggcgtgtgcaaagagatcacgtggtgaaaaagaaagcaagagagagagagatacacccactgacccaaacacctcccagtgggctcctccgtttagcactgttacatggaggaacaagtttccacatgagctttggcaaggccaggccacattcaagtgatatggggcatataatttgccaaatgcagtggggtattgaagtctccaacaattattgtagtactatctacttcttccttcaagtctatcgatgtttgtttcatgtattttggagttctgatttttggtatctatacagttataagtattttatattcttgataaatttatgagttatcaatatataatgaccttaattcatttcttgtaacaatttttgactttgtttatttttgctttgcgtatctactataagtttttattttgtagttaccattaggcttacataaaacctcttataacggactgtttatatttggtaacaacttaactttgatcacatagaaaaaagtctccacttttactccatccccttgcccccaatttatgctttgatgtcataatttatatttttaattgtatatcccttagcaaattattatagctattatttttaatacatatttatttaatcttcatactaaagacacagatgatttacttaccatcactgcagtattagaatattctgaatttgactgtgtacttacttttagcagtgagttttatactttctcatgtttccatgacaccaatgagcattcttttctttctttcagcctgaagagcttcctttaggatttcttgtgagacaagtcagcttttatttgtctggaaaagtctttatctcacttttatttgtgaagaactgctttggcaggtacagtattcttagttggcatatttttttctttgaggctttgaatatatcatcttgctctctcctgccatgtaaggtttttgctaagaaatatgctgctagccttattggaactctcatatatgtgatttatttctattctcttgctgcttttaggattctctctttgtctttgatttttgatagtttgattataatacattttgttatagtcttgtttggatagaatctgattggagacatttggtccttataccttgatattattccccaggtttaagaattttttagtgattatttctttaaacaatgttgtcctaggggctgggtgtgtgggtgttggcctggaggctaggaccattagggttgacctttgtctgggggctccaggtgctggcctgaaacctgagtctacaggggtcatcttggagcctgggtccatgggggctaatccagtgctggagtctgccaggaagaaactgggctgtggctctgctgtaatgtgtggctgcaggggaaaatatgaagagtgggtctgtgggtgcctgtttggagatgagagctgtagcggttggcctggttcttgggtaggtctgaatcctgggaccatggggaccagcctggtgctgcaagcagtccagagcctttggctgcctggccctggggtgggcctagagcctgagtctgtgggggatagcctggagttggggtttgtccaaagtctggggctactgatcagctacagtcaggctactactccaactgtcctttctatctctttagtgcatcctttctgaaatctcctacctggtttccttagttcttgtgaaggtggttttatgcatggatagttgttccaattgatgtttctgcaggggagcaagagctagaaagtcctattcaccatcttccttacagccttctgccccaaggctgcagtactcttcaatcacatgttttatgttacctctttcttttctccagccatttggaaataattaccaagagctactttttttggccaggtatgcaatttttgtgaaccaatgctgttctaactgattctaactcaagaggcgagaaaagcccagatgcccctaattggatccatggttgtactgtgctgtatttccaggacttgtgcaaagtttaatactattactcatcagttttattttacctcctatttttctcattctttgcatggatttacggaggcactttcctgactttttcattgtgggctgtgttgtagtcaccttggattgatctctggccctttggtcattgtgtgctttgagtctgcatggtgagtcccagttttatttcatgcatgagcttcattgacagaaaatcattataccttatttccttgcttcatgcttggaagatgtggatttggccttcatattcctgactggatactttaaatgagtcagatgcatctgctttagataggtattgactaaggagaagtaagggaataatctgtaaaactcaacccaaaatgaagtcttttttcttgctagaggcatattatttatttggatagattaagattttcctctacatgtttaagaagttaatctcaatttggatgtgattagtaataatttcaaatctatatttcacttgagtttcttgcagtgtaattatgtttgttgtctgtttgggaatactaaaacaatcattttattgtagtatatttaatacttttaccatatttcttcttacttaaacgaatacatataaataacaaccatgagaatctcaagcatatttgaaatattttaatatcattatgaaagtagaaagataaaattagagtgctccaaaaatatttaaaaattctagtccaatatcctcatttagagaaagaaaccgaggcccagaaatgtaaaagcaagtgaataaaattagtggtatggccagaattaggtactttgttcatgaaaatatttagacatttttgaggtgagttaggactggcagggcacggagggacactgttgtcataaaactatgaaggacctaccaaggaaaaaatacctctaggggtctctgtttattgagttctaaaaaaatacccatactatatttggttggctaataacatataaatggattttaattggtaagtgtttggggcatttctttttctctgttctttcccttccttctccacacatctatcccaaggcacaggcattttattttgcattttggacctgctgtctgtttgacagtgtcctcttttgatttatttattattgttgtttgcaaagaagagggaaattttgaagcatgaacttgctgtgctaccttgatttggaggtctcctggcccagtgtggaaaaagttaaaatcatctgacatatgtttatatatatttaagcatctcagttggcttcatttgtgcaatgaggtcccaagatccactcaaactcctacttacatacaggaaagaaaaaacatctgctgctttgactaaaagttcctcctggccttccctgtgaaactcaggtgaaacctccagccaacagaattgtaacagagtcattctattacaccaagaagcctgtgagctcacagggggaggaaatactgcagcaggatatgcagttgggaggatcttcctgcccacaagaaaatacaaaaaaagtggaattaatcatcttcatcttttcacagaatttgctaagaaattaaattcaaattaacacactcatagtttttgcctaccatgttcaaaacactcctggtgcttatgagagacgtggtcttttagagggcacagttaccataaggcagccacaccagcaggctgggtacttacattaatgataaacctattatgctctttccccatgaaaacagatctggaccctcacctcccccactaccgctgtcacaggctcctggaatttccctctctcacccctacccttcaccacttttgtgaatgttcctcaatctgactccatcttccatcagtcttctcctcttcaaaccctttctctgtgctctgtggaattcctgatcagtatagttttcatatagacatcctttacttaaaccttctctcccatttcttgccttaattgaaaattggcctctctctagtcatcatcccccctccaattccataggcctcattacgacttccaaatcatttcttctttttctacccttgaaaagcctggcacctctgatgtttgtaccacttaccagtgtcacaatattaccatattaccctctttgtgttagagcttcccagagaaacaaagccaataggacacacacacacacgcacacacccgcacacacatacacacacacacaagtgtatttataattaaataagaaatatatagatatgacggccaggcgcggtggctcacgcctgtaatcccagcactttgggaggccaaggagggcagatcacgaggtcaggagatcgagaccatcctggctaacactgtgaaaccgcatctctactaaaaatacaaaaaaaattagccggacatggtggtgggcgcctgtagtcccagctacttgggaggctgaggcaggagaatggcgtcaacccgggaggcagagcttgcagtgagccgagatcacaccactgcactccagcctgggcgacagagagagattccgtctcggaaaaaaaaaaaaaaaagaaagaaagatatatatgtgacaaagttctcatttctataatttgtcttgtggctgtagttagtgtttataattagcttcttcctttaacagttcactattgctgtttcctccggtaagccctctagcactacatggctctttgctttacgtggtggcccaaaccttcattcctgaagggtctaggccatgagtgttcctgcctggattggtttgttgtagttttccatcaaccttaaccaccaggcatgataatattgaaaggtgcctcgagggacctcctatgttccagacatactcttctttatctccattgtggaatagtagtccaattttctcttggtagtcaggattaatcaccccaaccagcacaataactcccttctttgccagttgattcagaggcatgagtaacccaaagtggccaggtgactttcttaacctccagttcagtagagtcgttgttgcgtctcctggtgggagcattcatccctctgttactataacctctaggtagttactatatcctctatagtagagcataagattgtgaaaacaggaagtcaacatttgctactgagttgctaggggtaatggtgagtggttttccaacacaatgaagtcttaggcagtataccactccgaaatcacttgatcagagatttccagcactcactgggggcatttctgaaattgtggaggctgagaatcttctgtcttgtgtctgtaagacagagacccaggaaagctggtggtatagttccagtctgagtccgaaagcctgagaatcaggagcactgatggtgtaagtctgagttcaaggacagaaaccaagcaatgtcctggatcaagcagtcaggcagggaaaggcagagacagaattctcacttcctctgacatttttgttctattcaagtcctcagtggattggatggggcccactcacattgaggagggcaatctgccttactcagtacgccaattaaaaagttaatgagatatatacctcttttgaaaacaccctcacagacatgcccagaaatgtttaacccactatctgggcatcctgtggcccagtcaagctgacacatgacagtaaccgtcacactcatcctcctcccttcgaactgctttctcactgcccctcagtgactggagccattagcacctctctgcttcacctctcatctcatctctcaaagccacgtttaaaatgttactgtatacattacatgtctttgtgaaaatcagtatgctgagctatggagaaaaaaagtatttcagagaagtgtgaaacaaactgaaatttaaaatttaaaacattacatgaattgtggattatcagaattcacttaaaatatttccataggtaaaagagaatgcttgattatgtcacatttaaatactgttctttagtttttattttaatcgggacaatttacattaagcactggtaaagcaatttcaaaatttctgtaggttaaaacaacaaaggggctaggcgcagtgactcatgcctgtaatcccagcactttgggaggccgaggcgggtagatcatgaggtcaggagtttgagaccagcctggccaacatggtgaaactccttctcactaaaaatacaaaaattagccgggtgtggtggcgggcgcctgtaatcccagctacttggaaggctgaggcaggaaaattgcttgaacctgggaaacagaggttgcagtgagctgagattgtgccgctgcactctagcctgggtgacagagcaagactccgtctcaaaaaaaaaaagaaaaaaaaaaaggattatttctcattcatgctagatgtccagtgagggtggatggggagctctgtttcacactgacactcaggagtctaggctgacaacggctccatcctcttgtcactgcttctggtggaatttgtggcctttctggtcgctgcagcaggagaaagagaacagagaaccacactgggactttgacagcattggcctcacttttgctcacatttcattgatcagaactagtcatgaggccctgcctaatgttaagggctgggaaatgcaggcttgcctatgcacaagcatcactactgcccagcagagtcttttttttttttttttttaagacagagtctccctctgtcacccaggctggagtgcagtggtgccatctcagctcactgcaagctacacctcctgagttcatgccattctcctgcctcagcctcccaagtagcccgccaccacacccggctaattttgtttttgtattttttttagtagagatggggtttcaccgtgttagccaggatggtctccatctcctaacctcatgatccgcctgccttggcctcccaaagtgctgggattgcaggcgtgagccaccacgcccagcctgcccagcacagtcttgttaaacagctctcatgtcctgtggagtcctgtcatgacacatgggaacatgcgtgtcatgataggactccacatataggactccacatataggagtaaaggagaaacgtgagttgatcagtgaaatgaagatgaaggacagggtgaacctcagagcctgaggttgaaggttaagtctgtgatatcagcaagcatgtggaaagaacacactttcctggtggaggcacatgtggaggctttgatgggcaatcaggaggttttaggacagctgtgagcagttctgcttttttttttttttttttttttttttttgagacagagtctcgctctgtctcccaggctggagtgcagtggctggatctcggctcactgcaagctccgcctcctgggttcacgccattctcctgcctcagcctccagagtagctgggactacaggcacccgccaccacacccggctaattttttgtattttcagtagagaaggggtttcaccgtgttagccaggatggtctggatctcctgacctcgtgatccgcccacctcagcctcccaaagtgctgggattacaggagtgagccatcgtgcccagcctgttgggtcacattttataatacatttgctgaggtctattttgtgatctgtgagtatgcactgtggtggtggcagtaaaatacatcagtgggagttttcctgcagagctcttgatccatgcggggtgtatcacaattgcacagtaaatattgatttcattgagaagaaagaaaaatctgataagaaataaaatgaaccaataaatattttctctacgtatgtgtggtagacagaattcgcaatgtgatcccatgatttcatacccgaatccctcagagcccacaagaatagggaatcccatgactatgttgtgtcatatggcacagttgactgtagagtagggacactatctggtgggcctaatgtcatcacacagtttcgaagcagagtgttttttttgactggtagaagaagtcagagagattcagagtatgagaatgacgcagtgtgtactgctgttcagaaacggagggagccaagagagcaggaatgagggtggcctgaagggtgcaagacaggtcctggctggcagccaacaaggaaaccaggaccccagtcctccaatgccaggaatttaatcctgccaatagcaggagtaagcttggaagaggagcctggggtctagggaagaaaacattaacttacatctttatttcagccttgtgagactgagcaggcggtccagccgctgcatcctggaattcttgccattatcacactcgtatgtgaaataataaaaccgtgtgttagcttctgtattgaataaactgaataaacttctcaactttgctttccttctccagtttcctctccccacccctacagtatcattctttatggaagacatattaaatttctctttaaaacaacattgctttgaaatataaaaaacagcatatgtcaactgtttttttacaataagaagtactataaccagacttttttaaaaaaatgatattatcctgcttagctcacaaaaacattttgattatttgggctgttaaattttacgtgtcatgttcagtaaatcaattaggttcttaagaaatctcctgcagattgtcagattgaagagatcataacccagaaggaaataagcctgcactcctaagacaatcagtgcttctaatgagaaaagtgactgacagataaggtgggaagattggcctcacctcatggggcagctctgctgttcttgcccatcctgatgtttttggataacaaggaaagtgtattcaattttttagctcccccttttaaaaaagcagtggaagcttgtaatcaaagacaatcatgttggggtccggtaggagtcaccccatcgcattcatcacactcatcaaccaaagggaggaggcctctccctgagttcctgcttgaggaacatggctggaaaagtagggagaatggaagctgatgccaaaaacaaaaacaggagagagaaagaaatgcctctgtttggtgcttcgaaacactcgatttaatctgtgcatgtaggtggggaaagcatttgtccatttttaatttctgtagttaatccaggagcctccagaataggcttatggtttggagtgaccttgaatggtgacaagagtatattttatttgcatggctctccccactttaccaattactttctcataggagtcgcttgtttctcacccatgaaattgttaggttttgttaacttttcagtcttgagattagaagaggctttaatgtgctagaagcacaactgcacttttgattcatgaatttttttttttttttttgagacggattctcgctctgtcgcccaggctggagtgcagtagggcgatctcggctcattgcaagctccgtctcctgggttcagccattctcctgcctcagcctcctgagtagctgggactacaggcacccaccaccacgcctggctaattttttttgtatttttttagtagagacggggtttcaccgtgttagccaggatggtctggatctcctgaccttgtgatctgcttacctcggcctcccaaagtgctgggattacaggcgtgagccaccgcacccagccgattcatgaattttctattcagtttccagcctcttctggaacacattcagcaatggagagctccctgccttttgtaactctggagagttcaagttaatccatttattgtttgctagaaaatataaccttttgaaaatattttcttactttccattttattatttatttattattattattatttgagatggaatctcgctctgtcaccaggctgtagtgcagtggtgcaatctcggctcactgcaacctcctcctcctaggttcaagcaattcttctgcctcagcctcccaagtagctgggactacaggtgtgtgccaccacgcccagctagtgtgtgtgtgtgtgtgtgtgtgtttggtagagacggggtttcaccatgttggccaggatggtctcaatctcttgacctcctgatccacctgcctcggcctcccaaagtgctgggattacaggtgtgagccactgcacccagaccattttatcttttaactgtctgcaacaaagacagaaaatgacaccaacctaaatcattcctgttagagttcaggaccatcatctcccaaactttggagtgtctgattccctgtagtcaatatgcaacgagatttcaggcaagtattgtttgaggtcgacagtaactgtatccaaaagttaccttcctaaacatatacaattgttttagaaataaatgcctacattttctttgagtacctgggctaactgatgaaatcggcctttctgcctcaccttacaaaggtactttacaaagtttgggattaatgttgagatgggaaatcaacccacactagatgcaaaaaagcagagctcactgcctgaaaatgtgaggtgtgaggctattcaatggttgtaataaaaaataaaaaataaaaaagatcaatgaaagtgggcttagaagggccagtgtccaggcagctctgctgtgggaactgtagaatccgggtcatgggaatgaggaaggaaaatgacttgggtatattccacagagtggatcctattttcagaacatgctttcatttctttttgcatttgacagtttatactcaagaataaaatagtcacctcaagggcgttagggaagcagaagcctaggagagcccgagtgacaccattttaacatcagctccgtcttcaagttagcagggtgcattccttgccagtcatgactcatggtcctaacatgttcacatccaaggaaagagcgtggtaatgcctgcaaggacaaactcctacaataacaggcagtccagatgtcccaatgcccataacaatatatgctttcaagatagttgtagttacgctttgatgtactcgtacactaaaatgtcaaggatcgttttctttaaatcaatagaataataaattttgtcattctgtcagtccacctgcacataggcaaagcttagtttattctttacataaagaagatgtatatgtaagaaaaacttaaaacaaagatggggcattcctgttcttgctttctgaggataccttactctataacctagaggctttcaataaactctcccttcccactttattctgcaactcaccttgaattctttcctgtgtaagatccaagaacactctcttggggtttgtatcaagatcccttttctggtaaaaaagaggatgcaaaaattcagctacaacaaaaatagacatgggttatttttcctaaaaagattgcacttgtctgttgccattggaggaatgtatccgatgttgtcaaatgtcaaacaagactcagaggacctgacaactcatattttggaagctggttctctttggaatacagaattttaaaaggcttgaagcagtactcttgagtaatatggagagtagatagatgatggagagcagagagaatgatttaggtttgtgccattttctatctttcttgcagacagttaaaagataaaatggaaagtgagaaaatattttcaaaataattactctttatactcacaatataaccttttcacaataattcttcttcctcttcttctccttcttcttcctcctcttgttcttcctcctcttcctcctcctcttcctcctcctcctcttcctcctcttcttcttcttctttcttcttctttcgtcttcttctcctttcttctttcttttttcttctttcttcttttcttttttagatggaatcttgctctgtcaccagactggagtgcagtggcatgatctcagctcactgcaacctccgcctcccaggttcaagggattctccttcctcagcctcccgagtagctgggactacaggcacacaccaccacgcctagctaattttagtatttttagtagagacgaggtttcaccatgttggccaggctgttctccatctcttgacctcgcgatccacctacctcggcctcccaaagtgctgggattacaggcatgagccaccatgcccagccaataattactctttttgtattccagcagaaaaggtgggatcatggataaacgacttgccccaactctggacaatgaagcagtggcaacctgttaacacatattaattttgggtatttctgaaagttttttttttttttttcacctttctaccctcctgcttttcccgtgagaatgggtgtggttactcatttgcttacacaaatctcattcttgtatccagtttgataactggatactactgaagctgatcttcagtagtctcgggtggtcctagtgaaccagcttctccagacgcagctgttcaccttctgttcattcagcatccaaggtgagtcttcagcactgtctgatgctccagcagttcattctggcagtgctcttacgagagggatagcgggagcaggccggcggcacaggccagatacagtcagggtcagatgaccacctgatggggaggttcttcatccacagactgttctcattgtttgggggattcttcctccttttttattcctgtatttaatctggcttcagtcattaggtgtttctttcatagaggaattttaatcatataagggtaagctttgttttaagattcatgaaagtggcatatgtgctgaggtggcctaggcaatcagggtttttaggtcttattttcatagggacccagtaatcatctcccggccagggctggaaatccccaggccaggttacatcatactgctaagtgaaacatagtgtagaccccatgagatgtttgagtgggctttatggccatcattaatcttacaggcatgggatgtttcttattgtaccatacaacagctatccacacttctcatccacattcttgcagcaatctaatcttctcatacaacagtgaggtaagattaccactcagcctttgttgtgatgactgcccacctgctactttaagtttagctgtgtgtggtactatgattactcttcctttcaagaacagcattttctttcctttgggattaatgattgcttgtttggggggctatactttatttttatacattattactaatatttaaaccaaatttttcttaacctgggttttctctaaaaacagagcctagtacaaaggtatgtaggcattttattttatttgggaagtgactgtaggaaacagtaatgtgagggcctggagaacatgaccgagagaaggaaaagccaattaaaaaatacatagggtcaggagatcaagaccatcctggccaacatggtgaagccctgtctttactaaaaatacaaaaatttgccgggtgtagtggcaggtgactgtaatcccagctacttgggaggctgaggcaggagaattgcttgacccaggaggagaagattacagtaagccaagatcgtgccactgcactccagcctggcgacagagcgagactctgtctcaaaaaaaaaaaaaaaattacataggggctcacctctgcagatagggctgaatactgctggaactgtttgaggagctacatgaaatgcatcctcttgatggctattgtcctccaacagaagcaggttgtttctttggagttaatgcctctccactcccaggttatgcagacctgtgtgctgtgtcctgagaaatttcagtaaagctcattgcagaaagcattcagggtagtgcagccatggctgaagtcaaagggggttgagaggacctgagatgggacacatgttgggggaaaggcagttatctagagctgggagggggacctggtaatgtgactcctggcaatgtcctttacatggtcctttctctcaagtgtacctaatgtcatcaattcctgaactttgggagtgggaccatttcatataattcgaacctcttctacacgtgatataaactactaagtcaatggcacatatccatctttttttccagatccccaagttcctgttttctcttctttcatccttatgggtttattatgttttttacaaagacaacccccttattgtcatcttagtggcatttcaggggtaagtagaatgaaaggcatgcttcctatctgctctcttgaatctacatatactcttttgggttttaaaccttttagagaaaaaaacttccatggtatatgcctcttaacaaagatcttacatgaataggccaaaaaactcagtttttgtccagctaataattgaattgtaaccaaacgaaaccagccagcttgctatagaattattttaatagggcatacactgtacgctttttgtttctgcacatttttacacttgcagatattatacacggaattttatattcttcctgttcagttaacattctgtgtatatcttctcttttctacatgattaaaaaaatgttattcggccgggcgcggtggctcacgcctgtaatcccagcactttgggaggccgaggcaggcggatcacgaggtcaggaaatcgagaccatcctggctaacacggtgaaaccccgtctctactaaaaatacaaaaaaattagccgggcacggtggcgggcgcctgtagtcccagctactcgggaggctgaggcaggagaatggtgtgaacctgggaggcagagcttgcagtgagccgagatcgcgccgctgcattccagcctgggcgacagaaggagactccgtctcaaaaaacaaacaaacaaacaaaaattattctacacccctcttctatcctatttcctgtttttacatccgctctcccctcccgcttctgagtctccagtgtcctttataccacactatgcctttgcctacccatattagcttataagtgagaatatatggttttggttttctattctgagttacttcacatttcaaatggagttgttttcttaacttcattcacttagtgctcactgcgagtgtatagtaatacaattaattgtttaatattgatttttatccctcaaacttgctgaactcatttattaggaatcgttttctggggtattcttttggattatacgtatacaaaatttgggtaaaccgtaagtaactgatgttacaatctgttgtgctcattcagtacttttccctaagcccaatcacacattaaacaaacacagagttccttttagttcctgcctaagcactgagtttttataatgaaaggtgggaagatatgttctataagaaaaggttttttaaaaaaacagttttattgagatataattttacattccataatattcacccatttaaagtatgtaatttaatgttttttactatattcacagttttgtaaaaccattaccattattcaactttagaatacttctatttcccttaaaagaaaccccatgcttgttagcagtcacttgctattctcctctccttccccacttcaccaactcctcacctctctacccgaagtaaccactaatctacctgcttattctgggcatttaatagaattggaaccatgcaatatatggtcttttgtggctggcttcttttacttagtataatgctttcaaggttcatctatgttgtagcctatatcaatacttcatttctttttaagacagaataatctttcattgtatttatgtaccacattttacttatccattcatcaggataaatgggcattttggacattgggttgtttcaacttctggctattaggaataatgctgctatgaacattcatgtgcactttttttttttgagagagtcttgctctgtcgcccaggctggagtgcagtggcatgatctctgctcactgcaaacctctgcctcctgggttcaagtgattcttctgcctcagcctcccaaatagctgggactacaggcacgtgccaccatgcctggctaatttttgtatttttagtagagatggggtttcaccatattggccaggctgctctcacactcctgacctcatgatctgcctgtctcggcctcccaaagtgctaggattacaggcgtgagccaccgcgcctggcccatgtacacatttgtgtctgtgtgtgtgtgaacatgtttcacacctaatggtggaattattgaatcgtattgtaattctatgtttaattttttgaggaattgtcagttttccacaatggctgcatcatttcacatatttatcaacagtgtgtgagggtttaaatgtcttcaaatccttgccaaaagtttttactgtctgccttttcgattatagctgtctttgtagacgtgattttgatttgcatttccataatgaatagtgatgttgagccaattttcatatgtttgtggatatttgtacatcttctttggagagatgcctatttaaatcctttgcctatattgtatttggtttatttgccttgctactattgagagtggtatgattcctttatattctggatataagacccttatcagatatatggcatgcaaatattttattcatttctgcaagttttgtctttttttgatggtatcgtttgtagcacgaaacttttaaattttgatgcagtcgaatttattttttctttcattgctcgtgcttttgctgttgtaccttaaaaatctttgcctaaacccaaggtcagaaaatttcactcctctattttcttctaaaagttttacagatttttatgcttatacttaggcttttaatctttttgaataagctttttgtgtatggtgtgagatagggcattgagttatctagccacatttgttgaaaaggctcttctttctccaagcacttttattagaacccttctgaaaaattcattggctataaatataataatttatttttagattctcagttctgttctactgatctatgtgttattcttatggccatactacactgtttttattattatagctttgtgttatgttttaaaatcattaaacgggaatcctttaaatttattctttttcaaaattgttttggggattcttggtccctgaattttcagaacttttaagatcagtttgtcagtttctgaaaaagagctagctaagattttgatagagattgtgttgaatctgtagatcagcttacaaagtatggtcatttaacaatattaagtctttgggaggctgaggcaggagaatcgcttgaactcgagaggcgggggaggtttcagtgagccgagattgtgccattgtactccagcctgggcaacaagagtgaaactctgcctcaaaacaaacaaacaaacaacaacaacaacaacaacaaaaatattgtctaggtaatatctttccatttatttagatctttaatttcttttaaaactggtttgtagtttttagtatacaaatcttgcaattcttttgttaaattataccttagtattttattctttttgatgtcatttcaaatggaattgtgtatatatatatatatatattttacttcagtagctttaggggtagaagtggtttttggatacatggatgaattgtgtagtggtgaagtctgagattttagtacacctgacacctgaggagtgtacattgtacccagtaagtagttttttatcccttccccttctgagtctccaatgttcatcataacattctgtatgcttttgcctacccatagcttagcttataagtgagaacatgtggtatttggttttccattcctgaattacctcacatgtcaaatgaaattgttttcttaatttcattcactgaatgttcattgttaacatataaaaataaaattaatttttaatattgatttttatccttcaaacttgctgaactcattagttctaatagttttccggggtgttcttttgaattatctgtatacaaaacttaggtcatgtataagtagagatagttttacttcttctttttcaatctggatatcttttgttatttttatttgactatctcggctggcccatctcgtggaggggatttttattgtaaatttttttattagagagatgtactgtatatattttcctacagtaattttgaactaattattcttatagacatctgtatattttctacttatttttagatttctttttgacttatgggtaaatgaaatgcgtgtttattaatttccatatttttctagatatttttgatgtttttatttttctccagattaatggcttccttatcagaaaatatctgtagattttccatcatttgaaatttgttgagattttatttatggttcagtgtgtgcttctttttaaataaatgttctgtatgtgcttgaaaatgatgtgtattttggcagcatttgactgagtgacagttttatgaggttcaaatcttctaaatcctcttagtttcttctattaattagtgataaaaatgtgttaaaaagaaaaataatcagagtagaggattttctttgtagttctagggatgtttttatttatgagtgttgaggctaggtaattagatgtatatatattataattattttatcttcctaataataacatgtctatattagcttttatggttaatattttcctggtatgcctttttactttttaaatcattaacctttctgtatcctaatgttttatatatgtcttgtgaaaacaggagcaaattgggttttgtgttatagtctgttcatttttactttaaaataaatagtttagtcagtttatgtttaaaacaattactgatatatataggtgtgtattttccattatatctgtgttcgtagtttatccatgttccattttcttttatcttaggttgtttatattttcttatctaatttccccccttgtaatttagaagttgtataatatttttatttttattgtaataattataacatagatactatattaatatccatattgttcagaaaaacagaaccaacaggacacacacacacagtctgaaagccagcagtcttgagacctaaaaagaatccgtttttcagttcaagtctgaaggcagtaaaagatgcatatcccagctccaacagtcaggcatgaaagaaaaggtcagctttcttgttctatttaggccttcagctgattgaatgaggcccattctcattggggagcacaatctgccttactcagtctactgattcaaatgttaatttatccagaaatactctcacagacacatccagaataatgtttgaccaaatgtctgggcaccatgtggcctagtaaagttgaacacataaaattgagcactacagcacttaattgatcagtgtctcagttaatctgtatcttgacctcataccaaatgataaaggagcattagaagactcttttactttattttccttcctctctttttattctgctgttaataaaatttcattttttatcttaaacattctacaaggtgatgccattatttttttctattttttattgtggtaaaatatacataacatactttttatcattgtaaccatttgtgagtatgcagttcagtagcattaaatatatatttacaatgttatataactattgttactatctacaccaaaaaaaaaaaatatatatatatatatatatatatatatatatatatatatatatattttatacggagtctgctctgtcgcccaggctggagtgcagtggcacgacccctgctcactgtaagctctacctcctgggttcatgccattctcctgcctcaccctccagagtagctgggactacaggcgcccgccaccacgcccggctaatttttctgtatttttaatagagacggggtttcaccatgttcgccaggatggtctcgatctcctgacctcgtgatccgcctgcctcggcctcccaaagtgctgggattacaggtgtgagccaccgtacttggcccctacaccaaaaatttttattatcctcaacataaactttgtagtcattaatcaataagtacccatttccccactccttatcctctagtaagcttgattctactttctgtctgtaaatttgcctactctaggtaccttatatacatggcattgtacgatatttgtcctgctatatctgccttattaaacaaagcataatattttcaaggttcattcatgttgtagcaaatataaaaattttgtttctttttatagctgaatagtattccatcacaatgccacatattctttatctatccatctgttgatggacacttggattgcttccaccttttggatgttatgaataatgctgatatgaacattagtacacaaatacctgctttagtccttgctttccattgttttctatacatacttaggagaggaattgctgagtcatttggtagtcttaagattaactatttgagaaactgccaaattatcttacaaagcagttgcaccacattttacatttccacccttaatgcacgttccaatttctccacattctcaccagtatttattatttttcaattattatttttattattatttgtatagccatctttgtaggtgtgacatggtatctcgtggttttgatttgtatttttctatctactaatgatgttggacatctctttatgtatttattggctatttgtaggtcttctttggagaaatgtttattctagtcgtctgcccatttttaaatgtttgtttgtttgttttttgttgttgagtattgcattagtccgttttcacactgctataaagaactacctgaaactgggtaatttatgaagaaaagaggtttaattcactcacagttttgcatgcttaacaggaagcatgactgagaggcctcaggaaacttacaatcatggcggaagatgaaagggaaccaaggactttcttcacatggtggtaggagagaaagagagagtgaagggggaagtgccacacactttcaagcaaccagatcttgtgagaactcactcaatagcatgagaacagcaagagggaagtccaccgccatgattcagtcacctcccaccaggtccccccgacatgtgaggattacgattcaacataagatttcggtggggacacagagccaaaccatatcaagtattaagagttcttcatatagtctgggtattaatcctttatcagaatgtctgagatattctgatctgagagttcttcatatagtctggatattaatcctttatcagaatatctgagatcagaagcagcaattagcaatcagagaatagatctctgatatttggaggacagggtactatttggccaccctggcctctgcaagctgaatggaaactgctattggaatgcatgcacagctacctgccatgtgagtggaggtaagggatggatagttgctactgtgctaagagctgaaattgacaaaattaatgcaatttaccatccaacctttccctggaagtcgcaaacctttaacagactctagagttccaaaagagttacatcagcctggctgcagtggctcacgcctgtaaccccaacactttgggaggccgaggcgggtggatcaccaggtcaggagatcaagaacatcctggctaacaccgtgaaaccccgtctctactaaaaaatacaaaaaattagccagtgtggtggcaggcgcctgtagtcccagctactagggaggctgaggcaggagaatggcatgaacccaggaggcggagcttgcagtgagtccaggtcgtggcactgaatgccagcctggttgacagagcaaagactctgtctcaaaaaaaaaaaaaagaattacgtcagacatattctatcaatgcaattgtgtctagttgggggagacagtttcccggtgcttcttaatttgccattccagaattctctctctctttctttatttgttatatctgttaaaatttatatttgttaatcactttggtttcttctttttagtcagtttagataatttgtgtgttttaagaaatttatgcacttattttaggttatttgtttggcatacaattgctcacagtactcttaattctttatttctataacatcactagtattgtccccattctcatgtctaatttttgtcatttgcatgttttcccttttcttcttagtctttctaggtaagtttgtcaattttgttgatctttgcaaaaaaccaacttttgattttattgatttttctctattgtttttctagtccccgttttgtttttctgtgctctaatctttattgtttatttccttctagttttgagtttaatttgttctttatatcctcattctttaaggtggaaagttaagttactgatttggaatgtccttttcaatatagttatttatagctatacatttccctgtgagcacagctttcagtgcatcccacaagttttggtatgttgtgttttcattttcattcatctctgttttctaatttcatttgcaatttcttttttgatccattgcttgtttaagaatgtgttgtttaatttccacaaatttttgaattttctagttttccttctttaaaaatatttttaatagtatactctatttagcttaatatattcgtagtattatcataccattccaatacatcatcaatgaaagaaattagtatcgagatatcttacattctttcttttgtactaatgatataggaggagggcagggcagtgttgggtagaggagaaggtccctggctagggctccaccctcaggcctgtgcccatggacctaggtgaggacagatatttctgctttcgttcccatatgttgcattttccaagaccatcctggcctgccatgcccccatcctgtgcctataaaaccctgagaccttagcgggcagagacacaggagctggacatcaagaggaacacacacaagtggaaggacactcaaatggctggacattgagaggaacacacaggcagaggaacactttggcagacaccagtggaatgacgaaacgctgaggggaattcagtcggagagtctggctactgagcggctccactccaggggaaaaccaccttcccaatccatcccccctctggctcccctccatctgctgagagctacttccactcaataaaaccttgcacttattctccaaacccacgtgtgatctaatatttctggtacaccaaggcaagaacccaggatacaaaaagccctctgtccttgcgataaggcacagtgtgtaattgagctaattaacacaagccacctgcagaccacaaaactgaaagagttaactgtaatatatgcccactggggcttcagaagttgtaaacactcaaccttggaggctgccatggtgccagcgcttcccatgccctgcctgtctgcatggttcccctagaggtatgagtagcagggcaccaaagaagtgagccacacccccatcacacgccctgctgggggataaggaaacttttcccattacactaagtttttgaaatgcagtgtccatttcatgtaatagcagatctccatttcttttttgtttgctttctgttattgatatctaacttcatcctgttgtggtctgagaagataccatttgtatggcaactatcttctaaaatctattgagatttaatttgtggcctaacatatggtctgtcttggagaaatgtctcatgtgcctttaagaatttgtttgctgttgttgttgggtagagtattctgtgtatgcctcttagatccacctggtttatagtgttgttcaagtcctccattttcttacgtatgttctgtttgttatatatttcttattgaatgtggggtgttgaagtctccaattattattattgtagaattgcatatttatcttttcagttctgtcaacttttctttcatctattttgaggatctgttactaggtgtgtaaaatgctattgcttttcaatggccaacgttcacttagattaactcctatatttatcagtctcagtgctttaattattcttgcattctggaacatccatctgttgtcacttcccttctttttataagaaattcctttagtgatgtagaataatatgattatggcaaaattttcctagtcttgtttatctgagagtatatttgccatccttttattgaatcattgatatttttatctctgtgtttctttgtaagagtcttttaaacttttacttggaaataattataggtttgcagaaagtttcacagataatacagtttcctcatacccttcactcaatttccctaatagatgtatcttacataactgtagcacaatgtcaaagtttggattttgacaatggcataatatggtttgtatagttttgccattttatcatgtgtagatttgtgtaaccaccacagaaattaaaatacagaaatactccatcatcacagagatctcccacaccacagagatctccctcaccacagagatctccctcatcacagagatctccctcatgcaaccccttactgtcaccttcctacccccatgattcctatcccttgaaagctcaaatttcttcttcatttgtatacttttttggggtttttttttttttagaatcttctaaattaaactatttacatttaatgtaattactgatattttagagtttaagtcttctttttttgttttgtgtctattctttgtttcttacatctatgtttttctttctcctgtttcactgtgggctacttcatttttttttttttgaattccatttttttgttatctctagtgttattgggtatatctctctgtatagctttttgggagtcctttaggtattaaattatacacacgtaacagcatattctgctggtatcaatattttaccagttcagttaaagtatagaaattatatccccttttgtgtctctttccctctccatttataatataatggtcttggccgggcgcagtggctcaagcctgtaatcccaacactttgggaggccaaggcggatcaccaggtcaggaggtcgagaccatcctggctaacacagtgaaaccccgtctctactaaaaaatacaaaaaattagctgggcgtagtggcaggcacctgcagtcccagctactcgggaggctgaggcaggggaatggcgtgaacccaggaggcagagcttgcagtgagccgatatcgtgccactgcctccagcctgggtgacagaaggagactctgtttcaaaaataataataataataataatataatggtcttaaatattttttctacatacatcgagaatcacatcagacattattataatttttacttcaatagtcaaacataatttggaaattcaagagtagaaggaaaacctgtatttacccaaagttttgctctttttattgtttctactttcttcttgatgttccactttattcctgaagaatatttgtgctggatatagaattctagactgatagttattttcttacagcactccagaaatgagattgacacttacactggctatgtagccattttgggtttttagcttgtggacgaaaatttctctctttgaacttttcaccttggacaggtccagtactactacattttcctcgtaatagcatccctaatttcataaaataccttatatcttagtttgttttccattttttgcttaataaaaggagtactgatggatacagatttttatctgtgtcaactttagttgtttctcattttgtattatatagtgtggatcagtccaagatgaatttaaagaaagatatgatgatgtattcttaataatttttaaaaagttaggtgatatacaaacttatgcagaagaaacttatagtaaataatcttataaaaggtattttggaactactttcaaagcgtattttagtggactgattagtagaatgctctctcttaagtttataaagccctggaaattcttctggtatgagaaatgaaaactcaactaagttttacagatcttcattgatgcttgacttctctcaaaaaggaaatggtataataaaatggaatgggtttattttgtaccagccatcatcttaaaatcaggaagtagttaattgtgaaactgaaatattggcgaaacagaagagtttccatttttgatgatttcctctattggcacatatcatctaagagcggctacatcccaacagtgggaaagtgctaagtaaaaacaatgataagaatgacctaggccgggcgcggtggctcacaactgtaatcccagcactttgggaggccgaggcgggtggatcacctgaggtcaggagctccagaccagcctcaacgtggagaaaccccgtctctactaaaaatacaaaattagctgggcgtggtggtgcatgcctgtaatcccagctactcgggaggctgaggcaggagaattgcttgaacctgggaggcggaggttgtggtgagctgagatcgcaccattgcactccagcctgggcaacaagagcaaactctgtctcaaaaaaaaaaaaaaaaaagaatgacctagtgatctcagttgaaaaaagtgtagtggtctcatcctataaaggtttttttgttttgttttgttttgtttgagacagagcctccatctgtagcccaggctggagtgcagtgccatctcgtctcactgcaagctccacctcccgggttcacaccattctgctgcctcagcctcccgagtagctgggactacaggtgcccgccaccaagcccggctaatttttttttttttttttttgtatgtttagtagagatggggtttcactgtgttagccaggatggtctcttatcttctgacctggtgatctgcccaccttgtcctcccaaattgctgggattacaggcgtgagccaccgtgcccggccctaagaagtatttttaaaacatcctacttttcatttctgaaaaaaaataaataaaaagcagttgactttaaactctttaaaaacagaagaatctgggtatttgtttctattatttgatataaggcagaatcttttagaaggatttaaacactttactaaagtcaggaacaaacatgtagggaaaaacacaacagtatttttggaggattagattttatgtcatccacagaatgaagatactgctgtggaaaactggctgatcaatatgagctccactgaacttttgtttttgttaacaatgtacctcagtaagtatttagttaatatatccaacacatgcccttgaagctattcatccaaatgtccagtaacagataactcagaagacagttatataacacagaagagaataatcaaatttagctatgatgagtatatctgaagaatattaaattctatgttctaattttaaatattatcagtgagaatagtgtaaataaactttataggaaagtgaataaatacatgaaaaacatttgtatcctatataacaataaattgccatttacagctcctacaagtcagtactaaaactacaaatattcatgtagaaaaatattcaaatgatatgaacatgaaaaaaatcagaaaatgtcacttaaaaatgtttcttttttattttataaacttgtttttaatatctttcccctatttcttttgcattttcatccagcttcttgggttcaatgctcagtttatttgtttctgatttctctagttacataataaatgcacttaagattatgtttgaataattatcataacagaaggttgactaattagcagcatttatcttaattgcaaaggttagaaggatctaagtgcaggacagttctctgggtggccttggaccaacccagttctctcccctgtctcttgtagttctcaagaataactgtagaatgtactgggaatgcaacatcctgagagaagaaaggaatggctagaacagcccaggccctgttccagttccttggaaacagaatgtctttcaatgttttgtccagggggtaacttcaccttggagtataaaacccagggtgggctgcttttgcgggtccctagctgaggtacaagtgtggcatgcacagacaggactacacctcccccgagcagttttccccagccttggaggactagcttgccatgaatcccaggtgctgcctatctgtaagtaacaaatccacgtacgtgacttttgtgtgtttgtgttccatctcagcagactcagccaagttggtaaccagtgtcatactaagtatgtactgtatatataaatgcacagatattttgatgtttaacattccaggatctttcttttaaatgagttcttaattgtgtatcccagatccaagctcttctcctgacaagcctctggcatagcagtgaggtttgctctgtaagctgtggaagcctcagctggacactgtacccaagcttgctaggtatccactgtttcagcagtgctgagaaagaaaagaccccaagccctcaaggaggtcttttcataacatagcacagtctgctttttgcataattaaatcatttcttaacttaccaattgacagaaaatcactaccaataccattctattcaacttacatattccaccaaaccagacatggttgaacatcaacagggagccacccagagcgatttgagaaaaaagccaaaaccaaatccaaaagatctttacactatttaattgtaactgtgctgagttaaattattagaataagaaattttataagtttattttaaaatttttatttatttatttattgagatggcgtttcactcttgttgcccaggctagagtacaatggcgcgatcttggctcactgcaacctctgcctcctgggttcaagtgattctcctgcctcagcctccgaagtagcttggattataggtatgtgccaccacggccagctaatttttgtatttttagtagagatggggtttcgccatgttcaccaggctggtctcgaactcctgacctcaggtgatccacccgccttggctttctgaagtgctgggattacaggtgtgagccatcacgcccagccaacagtttatttgaatcatgagaatttgtattggtttttataaactagtttctttcatctcagattccctgaagtataatggggtgtataaataacagtaaaaataatagtaataacaattacttctctaggctgccagcagaaaacacctgaaatgtttttcttttttacatatcatttttgaaaatgttacaggaagaaaagttaaaatgatcctatcactaaaaagtagtttaatttttctttgtgaatctagtgtgaggagagtccactcaggtattaaggtgttcacatcctgattgtccttaacctcctcttccctctccccattcttaagtgggaaaaagaatttaaagaaaaattcaggccactgagaagaaaaaagcttggcaccccagaggggccagtgtaggtttcagggtttcaggtctatgaaaatttctccagatttcttcagatgacaaggagaaagggctttgcagagagaagtggccccaggatctgtgctccatgcagttagacgggctttgccagaggaagcccagagaggctggacgctatgcctggaacagagtgggagtgtgtggttactggggtggttctgccccatctcctggcagagtgctcagctgcccagagtggagcgcccgagggagaccggtcagcaatagtgaccatccccccaatgcttggcgcacctggttcctcttgtcaggctggggaatgagtgctcaggatgcccagtcatggttagaagtcggcggtgctcggccgggcgcggcggctcacgctgtaatcccagcactttgggaggccgaggcgggcagatcacgaagtcaggagatcgagaccatcctgggtaacatggtgaaaccccgcctctactaaaaatacaagaaattagcggggcgtggtagcgggcgcctgtagtcccagctactcgggaggctgaggcaggagaatggcatgaacccgggaggcggagcttgcagtgagctgagatcgcgccactgcactcctgcccgggcgacagagcgacactccgtctcaaaaaaaaaaaaaaaaaaaaagtctgccgtgctcaaagcaggcttattctcatctagaagataaagaaatatgggccctgttaccccaggcagctgctgaattggaatggaggcagcaggcactgaacatctgccctgtttcatccttgagtggatagaaatggcctcttattctgactctttccctacacatttgtggtaacacaagacttttaaaacaaaacaactgacttaattcctccaaccctgaatcacggcagttaatttcatttttctatacttaaaaaatgttttctggccaggcgtggtgtctcacgcctgtaatcccagcactttgggaggccgaggcgggcggatcacctgaggtcaggagttcctcagaccagcctggccaacatggtgaaaccctgtttctacgaaaaaaaaacaaaaacaaaaattagccgggtgtggtagcgggtgcctgtaatcccagctactggggaggctgaggcaggagaattgcttgaccccaggaggcagaggttgcagtgagccaagattgcacctctgcagtccagcctgagggacaggacaagactccatctcaaaaaaaaaaaaaattttttctttaaaacatgaatataaatgagtcagactccagtaagaaccacaatgtggcttccaagacagaataagagaaacaaacaactgcaagtcatttctcagtaatggggactggtgactgctgcctgagggcctgtgaatggctgtggcatttggggtcctgccctggtgtctccctgctgcttcctccaggctgaagtggcgcttctactagaaaggtgtctgcagccttgataaagcattgcaccttggcacagatcagcgtgaggacccaaacaacctagcgttgacagtttaagccaaagcaagccccattctttgctgatagtttttctagcaattgcctaagtggcagttggaaagaacttattgggaatgtagctacagacactctcccttctggcctcccttgatctcctttcatccttttatggtaacgcctaaggaaaaaatataacttccatctaatacaagatggaaaaaaaaatagatgtgcatagattccttctaactgaaggaaatcattcagtgaattatatacatttctctctctatatatatatatatttgtacacacacgtatatataacctattctctatcatttatctttctatcgtttatcatatatatgcaaatttcagtttaaaaattgtccattaagtgatacaatcaactatatgcaagacatataaaatcttaagactgtatacataggtatagtgtttatttcttacacaacaattgtttattacactattgaccaatgtgaccatacctaaaattcttgctttacaagaattaaatctttagtttaaattgaggtagtaatttcaaatttaagataacagtgagaatggggctgtaacttctctaataaaaatatgtagcagtacatacgtgactattagtcaaaagatggcacaggcagggaagagggcacacttcaccaggcagtgcggcctaaaggcagaaatattttgcaaatggaactgaagctggacaatgtcatatttggcctctgatttgttggctgaagcttcacagtataataagcctcctttggatgagagtgggctaagcctggaagactccaatcctacacattctacaaatgtgtgcagaaaatatcttcatttgctgtcagcacagagctggtgctgtgagggtggaggacgtgatgtggggaaatgcaaggaaagcccactcctttgtggtcctggtgtggggagggtggccctcgccccattcatgtttcaggttccgggaaagactggcctcctgaagcagcccccatgccaactcaggctcagccaaggcccttaggtggtatagcacagccaacaagtgagaggccctgaggtgcggggcctgagcttctcttggctcctggacgtatatgggatcaagaggggtaaacctggcagaaacgaagaggctgaagagtggcccagctgggccagacccaaactggaggtgcagccagatatgagatgtagggccagggtgcacctgggtagggctgcaccagccaggaaggctgctgagtttttgggccagagtgaaataaatcaggagcaacacccagccttgacctagctgagaacgtcagcaaggcaagaagaaatgacatggggaggtcctttgtcccggacgtggcaacccaggatcctgactctctcccttggcttgaaggtcccatgagccccactgcttttcatgaagattgtatgtgaaacacccagggtgggggtgccctcacacctcagggcctttgcacctattatgtcttctgccctgtaggaatgtgttccccacatagcccagatggccagcttactgcattcacatctctgctcccagtcaccaccacatcagtgtggcttccccgaccacctcttctagaatgattctccctgcactactttcactatagcccctggtcccatgtttctttttaacacctatcaccatatgacacatgtatttgtttattttctttcttcaactccctactaaaatatgagctgtgtaaagacaaagagtttgacattttgttcccaatagtgtccccagtgcctaggaacagagtgcacacacacacacacacacacacacacatacacacacacacatttgctattggcgagctatgatgcctttctgatgccatcttgactagtcacagcgaggctgggtaacctagaacattggcagactggcctttttcctacaggatactgagcgttaactgagaaaccagtgtaaattatgagtttaatgttttcaatcttaatagataattttcccttataatcagcaggggcagctctgaaaaaattaaaaataaataaaaataaaaaaatcagtgtagttaataaagagttgcgccatgttctctttgcatacaagagctgctgtgtgaaagatcctgcctcaggtgaccactgagttccttctccttttgagagaccctcccggcatgcagtaagtgccagcatattctcacgtctttgaatttcatgatttgggctgggactcgctggccacatcattggtctaaagttctccaagaacccagggtgagcatgccacagggagaaaacattcttgtcactttaaatacaaagaacatatttaaagtaattgctaatgattcaatatttgcaatacatgtgtgggcagttatgaaactttctttaacgcctaggcagatctaaatgccttatcaatttggaggcgctgtttccttcgtggttaacaatttaaggtgtttcgctgtgatttctgacttgaatgttcctttattagaggacgttgtcccactaacgtacatctcctctggaggctgggctaatcagtcttcagtctaagagctttccttcactactgctaattaaggatttttctatgatgaatacataattctaaaaaaatatgatttcctgatacaaactacatatgcttgaaataaaactccgaagtcaagttgcacaggcttatcaaacaactctctgagcacagaaatacagagtaaaagttaaaacacgtctctacaaaattataaacactgaatatcaacaaatcaaatgacttattgaacttactttgcaaaaattcagataaaaatgcatttatactaatcaaattccaatttctgcactatgtaggctacctttgtaataattacataagaacccttataatatagatcttttttcttcaataaaaaatcaactttgggattattctgtaaaagcagaaggagaatttggaaaaattaagccttctaagacctcccagatgaactctagccagagccccaggaggacttagtgatgccctctcacgcttggaggctggagggagggcgggagtcagttccccttgagttcctatggaatcttcagtctgttctgctagactgatagaccaagcttctcagacacccagactgaaggggataatgatctagcacctcggagtgtagacacacagcccttctctccaggtttactgacagcagctccagggcctcaagttcaggctctcctgcttttctgcccctaaatatgaactcaaagagactgaaaaagcagaagaccacgggaaatcctgcaaggtttctggcaccttagcaactcacggatgaagccattgggcctttccaaaactatcattttttgagaagacaagcatgagacatcctctgccgaggggaggaaagggacagggacagatatggataattgggaaagtttgataaatctgtaattttctgcctcataggcataagattcttttgggggtttactcactacatgatacctgtcactaggaagtttgtagattgcatctctgttgaaaatcctttgtgtgtgtgtgtgtgtgtgtgtgcgcgcgcgtagctatatatgcagagagccacacgtcttagaatttggccccccagcctcctcttcccaccacagagcaacgtctgtggtgccaatgagcccatcaggccatgcctctgcttggcacaactgccctccacgggagtctgcctcttcctttttttttttttcttatagatatgtgttcttttcaataattgagatgaaattgtgtaaacagattggcgttatgcatgttttttcagatgacattatatagtgaaaatattccccatgtcataaagattacttgaaatatcatttgcacagctccaatatttcataacatggattcaccattatttatttaatcccttacctgttcttgaatgcttgattggttttaacattgctccattttctttggatttttaaacaatgccttttcctgggtgatgatagccattgcaaaagctggtttcataattgttggatgtttttcattcttggatcctggatatcaaataaaatctttagagataatatctgagcctgctatggtttactgtcttttaaaactttacccttatttggggattaaataatgtgtgtgttctatcacagacacctattctaaaattgtctatcagtaagatggactgcattgccttttccttttccatagagtattgaatttaattgggttataattcctgctatctagtagctcaccaacaatggagctgtcagagcttactcatatactccatgggaagtttatgtgtctgaggcaaatgctggcaggtgaagcaggcattccatgaaaccaggcctgggtggaaaggaggcactcttgtgtgcagagtctggtgccgctgggcccacacacctgggagcactccctggctgcccacaccctgttcctttcaagaatttgggttgtgttttcttctttcttgacaattagtataagggcagtagctaagagtttggatttatttttttttttgatggagttttgctcttgttgcccaggctggatggagcatgatcttggctcactgcaacctccacctcctgggttcaagcaattctcctgcctcagcctcccgagtagctaggataacaggcatgtgccaccacgcctggctaattttgtatttttagtggagacgaggtttcactatgttggccaggatggtctcgaactcctgacttcaggtgatccacccacttcggccttccaaagtgctcggattacaggcatgagccaccatacccggccaaaagtttgaattttgattcagtcatgactttgccacttaatctgagtctccaggtaggtcatgtcccgcaattttctcatcagcaggctgggaataatgacaggctatattccaataagttttcattgaaggttaaataatatgacagagatctggcatatgtaaatcctcaataagtggcagccatttttgtttttattgctttcgttattcattgagtttcagatactgaaattaacaatgcgtattatccacctgttcctctgctgcttggattccagaccaaatttgccaccttttttgtaacttctaagattcactttgtactcttctgttttcttttatttactcaataagtatttattgtgaatctactgtgtgctagtcaccagtttaataatactctgttcccatctctttgcctagtgcacatatataaggaattctatgaaactataaccatactgacagatttcttgtatagtccagatgatgatcccaccattttaaaagtacacttcaaaatgctcaaagagtaagcttcaaatgtctcaccacagaaaataagtgacattatgaatacgtaaattgacttgatttaacattccacatcatgtacatatatcagaacttcactttgtacccaatacatgtgtacaatgatgatttttcaattaaaaataatattaatgaaaaagttgcatgacagtggaaaaaatgttttgaaggatagaggtttgcttatgatcacatgattctgagcaaattaatctgaagcttttttcacaatataactttattatgtagagttgttatagaaattaaacaacaatatagaaatcaaaaaaattttgttagttcctttcttttactcctcagatcagtatggttagggtgttcgcaaactctgtgtacattgtgctgtgggttagccactttagaaacagagggagacagtgaggccggtggagcttgggagagctaaatagagtctgagatggagagattgcatacaccagtgtgtatttgaaataaaatgtagtgaaaattaataagcttgaaattacctagcttaggctgttaaacaaaacattttaataaagaaaactaagtcatttaggtttccagagaatagtaactgtcactaataaaattaatgtttatttaggaaaaacttgtatcagtttctgcaattgaatcaatcaacatccaatgaggaaacagaaaccacatagtaatttggaaaggaaaatcaatataaataatattaaatgttatatggggttaacaataaaggggtacctgaagaaaatatttgggctctgggagagtccccaaggaagaaacaaacttgaaaaggggccccactccccaagactgggcctctgactcattggaggtgtggttgcagctcaccagcttgagaggaggttctctgggttgccccgggcagaagctggtaggaggtgacatggggctgcaacaggccagctgggagctccttctggggtgcaggtgggcacacaagcaccacgtaaggagggcacgcaggagcaccctccagggaacaggcaggctgaggatgaggaaggatgaatgtcaaagcaaggcagctttgggtctaactctgagctcagaactgtggccaaggtttgttttctgggtcagttctggatgaatagcttcatgggatcctgccacatatcaaatttagctacccaaccatctgaaatgaaacagtagaggaaaaacaggataatgaaaattcttatttagcaatgtataaagaacatgcaacttagctcagcatgtgtatcatgctttatttgggccagggatcgctaagaatattcatttttaaacttatttttttggcagagaaatgtttctggctcagcaaatataattacaataaggtttgaattcctgtttgccaggattggaaaacgatacaatttctaaagctctaatcagttgtctatccattttatctcgagaacagagctctattagctattctattagttagctattctcacaaatatgctgcataacaaaccacccccaaactcaatggcttatggcaacaaccattgatttcttgctcgcacatcagcaggttgcttggagttaagctgattaagtcagggcttggcttggctccaggctgcaggtgggtttcaagtcagcttcatgtagctgttcccgtgccgtgctgcttagcatgtgctctccttggggcaatggcagaagcacaagggacaggcatttcatgagcatttcaagcccctgcttgggtgaagtctgttaatgctcattggccaacatcaatggggagagaagtatgcttctgtcatggaggttaaagagaatagagtgaatctttgatagaccataatccaatctcccacagcaaggagagtatacaaaccacatcttaagtctggatcggcctgggatttttctgccccttgacagcagcagctgccttgccctttgcccaagggagtccactctgctgcttcctgagtgtcctcattcctggtcactgcacgattgtccttaaatggtgttagctatttggacatgggctaaatgctactccccatgcatgtttgctcacctgttccatttctgtgtctaggcaggttggctgagcctgtggcttctctctagagcttccactgcatcttactgaatttcttaggaagtagttgacacaattgactacactgatttctgcaaggtcccctaaatcatttcagaatgcatggggattgactcccaagagacaaaagggaagaacttaatgcacagtgcactaagcagcaaagtagttttgcctccttgagcctattcaaggttctctgtcacaccttgaatcagccaagatcaaattttagtgttcgtcacttgtaaatgtagtagacacaaaacctggaattgtgtctttatttggaaatagggtctttgtagatgtaatgaagttaagatgaagtcatatcggattagggtgggccccaaatgaaatgattggtgtccttacaaggagagggagatttggagacacagaaagacagagagacacggagagggtggaaggccatgcagtgatgaagggagagattggagtgatgcagctgtgagccgagaattgctggcaaccacctgaagccaggaagacgcaggaaggattccccgctggagccttcagggggagcatggccctgctgtcacctgacttcaggctttgatcttctggaattgtgagccaataaatttctgtttacatgccacctagtttatgataatatgttgtggcaactctgggaaaacataacacaacacctccgatgtctattttagtcagaattctttggttgcaattagcaaatactaagaaaaaaagtggattgatcttaggtcatttgaaactggctttaatgtgtgaagttaggaacatgggtgctgttgggactctcttatctttcatttatgattctctcttgtgctggctttattctcccaggtcagcttcttcataaggctgatgccatagcagctgaagtgttgaggctttttgatgagagaaaaaaggcttttctgtgtaattctaagattaagtcccaggtaagggttctagttcgcccctgctcatctggatggaccactgaggtttggtggacaggctgtattggtggtccacctagcatcagtcctctgactgttgaacagtgacaaaggccatgaaagagaaagggacaaggagtgtaacaagaacaagtgctaacaggatcatggaaactgttcggccactgctgttcatccaccaccacactgatggactgaagcaagaaaccagaaatcaatggaaaatataacaagaaaggttatttagaaattggtttcagaagagggaggtcatgtgggttgaatagtgtccctccaaagctcctgttcagctggaagctcagcttgggaccttattgagaaatagggtttttgccagaaaaatcaagttaagatgagctcatcctggatcagtgtgggccctcctgcaatcactcctgtcttcataggaagagacacagagatacaaagggaaaagcatgatggaccacagctcagagactgcactagtgcagctgtaggccaaggattgctgggaagcaccaggagagaggcagggaacagagccaccctccgaacctccaggaagaagccagcactgccaaagccttgattttggacttctggctctagaacttgtgagttaatacatttttgttgtctggggcctccagtttgtggtactttggcggcaccagcatgctaaaacagatgtgggactcaatcctaccttaagtactattgaactgcaaaatgaaagctttagaaaacacaagagagctgaaattatttaataagaagtgtagttatatgtatcactagaggaaaacatcctttcttttctaaaagaaaaattagatttcttattgaagcagggagaagatttgcctacaattctcattatgattaaagataccaatttatcattgataatactgattataaaacagaattacattaggggatgagagtgtgaataccaccaggacattaaataaaatatttgaggaatgaggtaattgtcccagacttgttggattcaatcaagggttttaaggctgctctattgcatttccttttaccataatatcatatatacactaccatagggagagacgcagcgtagcttacataatgaaatgactttacagctaatttgattctgcatttgaaaaccaaacaattctcaacatttatgcttgttcatcttcagcacagttgttgcgtgactaagttacttatgaggaggtccggagttcacgtttaggacaagttctactaattctggttcatacaaaactttccaacctctgagctttgtttgtttgttgtttactttgtgtttgttttatctttaaaaactgtaacttttttttttttttttttgagacggagtctcgctctgtcgcccaggccggactgcggactgcagtggcgcaatctcggttcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccaaaactgtaacttttatactatctttcatactatcatgaaacaagcagagccttgatttacgttttgcattatgcatgattaactcaatctacttttgatagtccccactttgggaaggtgagggtgcatagtccatacgtccccacttgctctttcccctcataatggtgacttttatctgttaacctgactgggctacggaatgcccagacagctggccaaacactctttctgggtgtgtctgtgagtgtgatttggaagagatgagcatttgaattggtggactcggtaaagaagatcaccctcacgaatgtgggcagatatcatctgaaccactgagggcccaagtagaacaaaaaggcggagaaaggggaatcccttgttggtatttggcctgggacatctctcttctcctgccctctgacagcagtgctctaattctcaggcctttggactcagatttaattgcactgtgggctttcctgattttccagctttcagttggcagattatggaacttcgcagcctccagaatcccgtgaactgattcctgtatatatacatatgtacacatacaaatatttgtgtatttatctctgggacccgatatacatctatatctcctctattgggtccctttctttagagaaccctaatacactcctatattgatggtctgacacctgtcacacataagaggaaatgctcttttgggataattattcataatatacaagttagagaatcatttatgtttcttagatattttcatatgtgtagagctgctttatcaatttgcagccctggtggggagcccagagcagagccccgggctggcagagctgggatcggggtacagatgggcttgcaggagcctggccactggcaccgctgctgggcctcagcagtaccatgccctgttccctcaaagccacattgtcttttgcagaggttgcctccaaagaaggtattttcttatgaagttttatgcctttgtaaaagttgtaaaatatacatgatagaatttaccattattatttatttatttattttgagacagagtctctgtcgcccaggctggagtgcagtggtgcaatctcagctcactgcaacctccacctcccgggttcacgccattctcctgcctcagcctcctgcgtagctgggactacagccacacgccaccacacccagctaatttttgtgtttttagtagagacggggtttcaccctgttggccaggatggtctccatctcttgacctcgtgatccacccgcctcggcctcccaaagtgctgagattacaggcgtgagccaccgcgcctggccagaaataatttgtttctttatcactgaggaccatctcaagtgacagggctccaagcttttgctcatgttccgctgccttggaatccaagggcaactgcggccatggtagcctattttcatcaaagtcaaatggcatcttgtcgacagaggtgagggcctgcaaagtcctactacactcaggacagtcagtcccctgctacaaaaaaattatcaggtacaaaatatcaataatactgagctagagaaactgagttctaagtgaaatggacaaacctttaatagtagtgacctggcctgaaactttaatgtttctttattgttttaaactttcatttggttgactataggagcagcaaactgttttgccatttatttctgatgctttaactgtacaatgttccccgaaatgtttacactttaattcttgccaaatttgttgtagccaactttaaccgtggaatgacatatttagtccctcaacactgtcacttgaatgacacatggcaatgggtcagccacttcttggagcagcacctggagaccagggcatttcctgttgcaaacagtttcctactgacctttgtgggaaagaagaaagaaaacccaagccgggcacggtggctcacacctgtaatcccagcactttgggaggctgaggtgggcgaatcacctgaggtcaggagtttgagaccagcctgaccaacatggtgaaaccccgtctctattaaaatacaaaaattaaccgggcgtagtggcaggcgcttgtaatctcagctacttgggaggctgaggcggaagaatcgcttgaaaccaggaggcagaggttgtggtgagccgagatcgcgccattgcactccagcctgggcgacaagagcaagactccatgtcaaaaaaaaaaaaaaaagaaaaagaaaagaaaaccgaggcttggatttttaaatcttcaattgtgagtgaaatttgcatcattactctgttatagttccacttacgatttttagaataaataaaaacaacataaagtgttttgagaaacataaaaatattacagacatatacacagatgcagtgatgcaaatgtaaagatgataaagtccaatcgtcagaaaagtcgtaagtggaattaaggcaggacacaagcaagattcactggtccctgaacagcagggagcgatagaggtgtctgaatacctttgggagtccacatccccggggtgtgggtgacaggcaggcccttcatccccgggcagagctgagcttgttcttgtcacatttaacctcagtcctctgataaagccagaacatacaatgtttttatctgcccattcagaatcatgtaagtgcaggtttttttaagtaattatgagggtgagtgagactttcactgtaatgtttggtaagtaatgaggtgattcagttttatgtccatcttgatttgaggaagagagaatggtgagggaagcattgggacaggttcatctggaaccacagacacttaaatgtagacaagcctttaatgatgcctggtcctcgcttcctcccaaatgcaggtatgtattacatctctgttggctgttcccctagaatcagctgtagcttttccagtggccaggagccctggtccccgttaccgttgcgaggctgtcttgcattattgggcactttgaatgcttaaaactgggcttctggaaaaagagtcagattcacctggatctggatctggcaggtgaatgtcacagtctctaacgacctcctaattcctgtcttctctctttccttccttttttttttttttttttttttgagacggagtctccctctgtcgcccaggctggagtgcagtggcacgatcttggctcactgcaagctctgcctcccgggttcatgccattctcctgccttagcctcccgagtagctgggactacaggtgcccgccaccacgctcggctaattttttcatatttttagtagagatggggtttcaccatgttagccaggatggtctccatctcctgacttcgtgatccacccacctcggcctcccaaagcgctgggattacaggcgtgagccaccacgcccggcctgtctttccttcttttaatctttctacacatgaaaaggcgtcagtagcccccaccatcatgtatgtcacctgggacaccctcagtctgcctttgttaatgtcagagccaggaacgcagggaaaaaactattttctgagatacgtttttgtgcagagagaagagactttccatgtatattgcctttcctgtaatattgtctgttcaggtagctgtgtgccatatccaggtagctgcatgccctcttccctgttttagcactggttgatactgagtttatggttaattagtaaatgtgttaaaaaattttttgaattttttttcaaaaatcagcaagcacaaatatgtacctagcattttccaaggatatgggtatggaaagataaaatgccagaacttacaatttaattagatattagtgcaaatgatcgatacactgcaatgtggtaactgtgtaacagatattaattgcaccatccaaaattcagtatgttaaaaatggaactcttcaggttatcataggaatgttgcttgactcttatgcccagggcagactgtgaagcatccattcccctaaatccagggcagtcaggtaaggggccttcttatctcagccacttctccacttccagcccagactcttgctgtattaacctctgtttctccgacacagcagacccggagactttttacctcctttttttgtgactcctccccactctaccacaagtagggttgcaagatttagaaaatgaatatttaagacactcagttaaatttggattttagataaatgacaaatactgttaattagtataagtatgtcccaaatattgcattgcattttattgtatttttttttgtagcagccgtaccctcaagaactgcaccttccaaccacccttatatgagcctgctccaaaaccttgccagccagcacttccaggttacgactattgacctccagctcccagtttcaggtgagaggtgagacccagtcccacactagcatgtcatcttcgtggaatcccaaaagagacaatatatagaggacaggatttttttttttttttttttttttttgagacggagtcttgctctatcgcccaggctgtactgcagtggcgcgattcttggctcactgcaagctccacctcctgggttcacgccattctcctgcctcagtctcctgagtagctgggactacaggcgcccgccaccacaccccgctgattttttgtatttttggtagagacggggtttcaccgtgttagccaggatggtctctatctcctgaccttgtgatccgcccgcctcggcctcccaaagtgctaggattacaggtgtgaacaccgagcccgaccaaggtacggcctttttaaagccccctcccctgcttcacacccagcaatgcgcctgctttaagggtgtccttgtttttgacaaactcacaatctccgcctccacaggtttcgggcgcccctggtggttgcactttgccagtagcttatggcaacccaccaggtttgctgatgctggactggcatttacctgtcaaagtaatttaaaccataagatttattcccaaatagggggggaaacagataaaatgggagaagggcatggttgtgggtttggactaatcagaacaagattctaaatttttataaagagaggagatggtactgcaggaaagccctgtgagtctcccctgcaaaatacccacctagacctgtttttgttggtggttgtgtgtatgccttctgaaacagtgtgtctccacagccaaacatgtgctgggatgcaggagatgcttaggccaccttgatcagtgatgtctgaggcttccccaggctgtttaattcacagcctccctcctttatgctcccccagattctctttcatttagattgtgttgactcagctcaggggatgaatatatgtatttgccaacattattgagtttgctaattaaaaagcactgaaagaaaacttactttccctctgcgtttggtgacttttacccctagaactcttcttcttaggaagcctatgacaatgaagatactataaaaacaagggtctttccaattcccttctgctgtgtcgtggagcgaacactcaacctggagtctaacgttcttaatttctgtcccagatctttactggctgggtctctgcacacttctcagtctcctagagtcttcaggttactcaatcaaaaaatgttctaaactagttgttataagagtgctgaacacattggctggttcactcacacaatagatttgcctgacaactgttcactaaactgtatatcttagtgcagtatgtggatttaactggtggtgttgctgatgtgtcaaaattttgagcacgttccagcttttcattgttgttattttccatcttccattactttgaagggaacatgttacaggacacaaagaaatactaaacttgcaaagcatatgaataatagcaaatgtgattattatttatttacttataaaaagatgatagattacttcatgttctgcttaaagctactttttgcatttggaccattttgagtagcccatattctgccaaaaattataattataaaattagtgaatcacgcagaaaacattggaactaaattattgacacggctttggaaaggtgatatccaatcttatatgcaaattccagttgtcttccattactcttgggatctttcagcagatttttgccatctgtgtagaagctgttattgaattttcttgctgagattatataatttctattcagagaattaaattccccattacactgtattttgtttctctacaatataaatggaaaattatgtaacagggaatttatacatttgttttgcacctgtggtatttaaaatgtggcaggcatttagagctgtcataaagacccaggccgaaaatgctttattgcatatgattatccttctcttactacttttgaaaaggaatgaaatacagccattttaatattcatgtgttccatccaaacagaggactgaataataaaagtggataacttatatttgcttccattacaaatagttttatcttgccatcttcagtcattgttttcggcttgcattgtgatactatgaagtggatcagaaaatatacttcctgagtgctacttgttaaacaagtgtatgaaatgtgcttgaccctgctctgtgcagtagagcatttcagactaatcacaaactactgagtggagtcaaagcagcagctcagactgctttctctgcaaaaactggagataaagtgttggttagaatataacgtttagcttctcatgttgtaactaatggtaggcctggtggagtggttaaaatataatgaatccagtaccaatggattccagaagtatttgatacccatctaatataacgctgctcaaaacattttgatgggtctctagggtctaatgaataaacttccaaccttagtctggtccttgttatccgacttatgctgtttctttctttcttttttttttttttcagagagttctcccagtctcctggatcacactggtcggaaagctgtttggtagacaaccttcgagtctttctgccttcatactgtgggtataccgttctcccaactgaaaacccgtttattttcttatctgtctactcaaagcctaaccaacaccaaatggcctagaaatgccacgtacctaccagttgcctctttcctcctccagcccttgtgaatgtgaattcacatctctgttctctgtgttccttggccacttagtaccattcacaatatctctcatagctagctctctgccttagggctggcccatgggactaaaattccttgtggtaggtatttttttttcatatttctattcttatagcatctagcatagaacaaacagcctagtatctagtgggtatccaataacaacttatgcaggtgattaggcaagaaaaagaaataaagcctattcaaattggaaaggtggaagtcaaattgtccctatttgctggcaacataatcttatatatagaagaacttaaacactctgccaaaaatccattagatgtgataaacaattcagtaaggttgtattgtatgtatcaaaacatccctatgtaacccatagagatgtataattattttatgttgatcaaaaataaaataataaaagctcttaataaaacagtcatctctttcagaattcatggttaccattgcctctagtattatttgtcaattaaaaaataaaatttaaaaagaatttaaagagttgaatgcagtttaaaaatgcatgcaggccgggtgcggtggctcacgcctgtaatcccagcactttgggaggctgaggtgggtggatcgccaggtcaggagatcgcgaccatcctggctaacatggtgaaaccccgtctcaactaaaaatacaaaaaaaaatagccaggcatggtcacaggcgcctgtagtcccagctactcgggaggctgaggcaggagaatggcatgaacctggggggcggagcttgcagtgagaggagatcgcgccactgcactccagcctgggcgacagagcgagactccgtctcaaaaaaaaaaaaaagcatgcaagtaaggaaggatcgtgtgagggtaagggtgcaagtgcagctttaaagatattagtaagagaaaagaagagggcgtatagtgcatgctgtgacatgggatgacagcttgcactgagagagcatggatctatatttttactatatactctgtaattgaacatttcagcttatttggattgtattaagccactttattatttgaatgctcacaatttccttctaatttcaaacttgtttgtggacctgtaaaaaaattctttttttaaatgcacctgtttaatgacacaggacacttttcatttatgcatggtacactggtagcccaatctgaaagtactattttctacactaaacttttttttttttgagccagagtcttgctctgttgccaagctggagtgcagtggcgcaatcttggctcactgcaacctccacctccttgggttcaagagattcttctgccacagcctcccgagtagctgggactacacacctgtgccaccacacccagctaatttttgtaattttagtagagacagggtttcaccatgttggccaggatggtctcaatctcttgacctcgtgacctgcccgcctcagcctcccaaagtgctaggattacaggcgtgagccactgcgcctggcctaaactatttttaaaaagaagtaacagcatgcctctacttatgtaaaagcaaacatatgttttgacggtggtgaagttggcttctgttaacccaacttctaaagaactaaattggccaaaagaggaaaaaaaaatgcttattttattaaatttaaatttagtaaatgcttatttactacattgacttgagggtttcagacaaatagcttagttagtggttagatcaagaggctttatagaagaaaagcttaatggtgcttatttataaaatgaaaaaattagtagttcttggccctgcctcatctgtttctcaaatttgttggttatgaaagatctgactgaaatccacaccatctggcttttagtgctgggatcccagcacaggccagtttagccatctgcttctgtctctgacgccacatacaacagagagtcttttgtcattgttgttgttgttgttgttgttgttgttgttttgagacgaagtcttggtatgtctcccaggctggagtgcagtggcacgatctctgctcactgcaagctccacctcctgagttcacgccattctcctgcctcagcctcctgagtagctgggactgcaggcgcccgccaccacgcccggctaattttttgtatttttagtagacacggggtttcaccgtgttagccaggatggtctcgatctcctgacctcgtgatctacccacctcggcctcccaaagtgctcggatcgcacccagcccagagctgcattttcatacaccattgaaatcagtgaaccctcaccgtgtgatgagaatgctggatgaaattttatgctgagtgagggaacaatctgttgaaaataaaggttagaaatgtgtagtgtcctatcgtgtcagtgccacaaaaaagatggggagtcctgccacatggtggaatggtgccacataagtcagagcaggaagcgagtgcagaaggacccaagtgactggagagatgattgcaaatgcaacagaaattctagggttcatcggatgctgtggctatgcttaagaaaccagccactcagctaagaaaacaacagtgagaaataacaccgttacagtggatttatttctctgcttaaatgactgccttgcagaagagctgtgatcttttgatattttttggcaaacagcatcaaaaacaagatatatggaatcaaccaacagatcatgtatcactgtgcttgtactggtaaaactccgtgtacttactccacgtctaccgtagtagattgagagatggtcatccaaagatctcagattctaatccctgggactgggaagtgttcccttgtttggcaaaagagtctttgtagacgtgattaagttagggatcttggcatgaggggatgaaccttctttattcaggtggccttgaattatgatcacaagtgtccttataaaagagaggcaaagggagaaagcacagaaaggagaggaggaacttaagtgcccatggaggcagagaccgcagtaatgcagccacaagttagggacgccaacagaagatgggaggggcaaagaaccagtccacccccgtagactccaggaaaagtgtggtcttgccaacacattgattttggaattctggcctctagaactatgaaagtataaatttctgttattttaagcagcccagctgtgatactttgttaagcagccacagggactaatacccctactatgtgccactcactgtgccagtcctggggaagatttaggctggaaaagcatggcctttgcagcatttttcccccaccagtgctgagacaatatgttgaaaagactgggaaaatgttataatgtattcaaaataccagatgagagctttctgtgtacctgtcactatgctcagctccagagatgggatatgaacaaaataggcccaattctcttccctctgtgccgaacttactttctgttaagtacaaaatagggcttaatgctatgaaaatgaagaggagtgacaacattgatgtcaaccaggaggatcagggcagattttaaatatgatgtggctgcagcaagagtgtgtgcgcatgggaacaggcattccaaacgaaggaatcactgctaatacagctgcaaagtctgcagtgcctttgggaagccttgacaagatgaacgtgtcagagagcaggcattcagtctttaacacagcctttccacatcggcctataaaattgtattatgatgtttcttcatttggaaaactagttttaaaggttgcattttgatgagtttgcaacattcaatttcatggaatccaaatcgcatgccctttggaagaggtgccatatgtgaatgcacccataaagtgcacgcatgcagcgtttgttacgtggtaggatctcatgcaattttaaatgactctcatgttaaaaaatgcttctattggcagggggtggtggcttacacctgtaatccaagcactttgggaggccaaggcaggtggatcacctgaggtcaggagtttgagaccagcctggccaacatggtgaaaccccgtctctaccaaaaatacaaaaattagctgggcatggtggtgggcacctgtaatcccagctatttgggaggctgaggcaagagaatgtcttgaacccagtagttggaggttgcagtgagccaacttcgtgccattgtactccagcctgagcaacaagagcaaaactccatctcaaagaaaaaaaaatgcttctatcactcttagccttgttttacttcatactctggtggtgggcaggtttgctaccttaaatatgtcctagaagctgaatccaaatactttttgaacaattttctgacttcctttagagaaatgtactgtcagagtactatgtataattttttaaatacagctaccctgaagacttataaaagtctggttgttcaggcagtaatttatttacaaattcatgaaaatgaaaacagtttatgcaagcaaccagctctgggatgcctcatcgtcctttgcaaaattatccaaatcatgatgaaataggctttatttttatggattaaacagagaagaatgtctaatgaattgtctagaaattgaaatacgcaccttttatgaatagggacatttcataagaccattctgtattgtgagttaggaattcagatcagttgaagcattaaaaaaatcaaaccttctgcagctcattaaagcataaacctaatttttagaatttatccgattaatatagtaagacctccacctgcttagaataatattaatacttggcctcatttacctccaagagggggataggcccctgaccaatcttcccatttcaccgaggacagacacttcccttgaatcaggtggaggttttccagtcatatttgcaacactgtttaatgctcaattgccctatttctttcctctgtgaagtgaatacaataacttaaatgaaggttgtttgaaactcctactattgggtaggagtttgcaacctggttactatgatcagagctataatttttttgtttattataattaggttttttgcaagactaaaattgtgcttcttttaaagtgctgaagaatttccaggcttgtcagcactaatacgtattctaattgcaaaaacagacacgaatatcaacccaggtgcatagacctcatagtgtcaatcaaatctcatcagaaactacttgtcttgcaggaggaaggggatcctaaaatcttttttttttaagggaaattttttatcaatttgtattctttatgtcctttcatattgccgtttaccataaatgaaaaccatgagaggaacttttaataataatacacatctgattatgcttttatgaatatacagaatattaaatttcaaaaggctttgcttgagtcccaaatgcaatttctaaaacattaactagcctactcagaatcaggtagaaatggtgcaaatgagctctttttatcacaggcattatttcttgaataaactcttttttgtttcctaaacttcaaaaaaactgtaattttattttcaacattcatgaaggataagtcaaatcctgtcagtgagtgagtccaacggtttccatgaaaggaggatgtggtcactttcatgaagaagccaactgaggaaggctttttcttggttcaatcatttgatgtaatgattcagatgaaagcacgtaagttagcctttctttatacctgcttcataaagtttgagactgctaaattaccaagataggacagtaacataagattatcttcttcatagcatacatcactatttaaaattattttatatatttacttatctgttattttctgtcttgcccactaggatatattgtccatgagatcttgtcctgtgaagtctttcctggcacatagtaagtgctcaataattgttgcataaaggtgaataaaccaataaatgaaagaacttttgcacatatttgtatgttacttgtaacacattttgtaatttgtctgttaatactgccttctcccttttctctgacatctttgcaaaggaagttatctagggcaaaataaattgcaatataaactgtcattaatttgcactaagtcctgtaaaacctgtttgcttttttgtgtttggtccatcagccagcagatcttttttttaattttattttttattttattttattttttttttttgagagggagtctcgctctgtcgcccaggctggagtgcagtggccggatctcgatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatttcctgacctcgtgatccgcccgcctcggcctcccaaagtgctgggattacaggcgtgagccaccgcgcccggcccagccagcagatcttaatgaagagagctaattgcagagttttctaataacgggtttttaccgtatagtcagactcagccccttttccatgttacattttctgctgaatatctacattactgcctttaataggcagtgcaaagccttaatgagatgatttattttgaagtgagttttaaaaattcctgggtatttagactctggcttattttttgccacctaattggtaggagtgagtagacaggtattgctaatggtactttaaatgactatcaggatctgaaggatgaattgtattaattattcaaattggaaatatttctttgagattttaaaaatcatattgaaagtcaatggtagattgaatcaatatgcaaatttactttacatatttttcagttcaagtctaataaataatgtacaactcttttggcattgtgtacatttatagagacatgtcaatgtcttcatgtcttttattattacttattaaagtaaagctgatggtgatatcaaaatgtcacctatgtttgtttgtttttttctcttggtatacatttgaagcctttctggccaacatccctcaatgtacctatttaaccttccaggtattgctcagtcagttacaaatatctggcctttcttttcaggctttatattctaaaatacttttctagtgagaagcaaaaaaaaaaaagaacaaaaaacctcactaattcactgtggtatttagttggcatagaacaaacaaccaaattacctggcatgtggcagctggtttataaaaatgtaaagtaggtactagacatcatttgaaagtttaggcacatataaattttgtctttagattatacaatatttttccataggtatatggtatatactgaacttattcacatgatttattccttgctataatacttttcatctaatttggctaactggaggaggagagtgcctactgtgaatgcctactgtgttctgtgttctaggctagaaactttgcattcattattgaacactcatatcaactttatgtgaaggcagcattatttactgaagaaattaaggctcagggaatttcaatttctccatattccatactgagtagtcaagctgggattgctagtctgctatttgtctgattctaaagtcagtgttcttttttaacacagtcaattggaaaaactctcattaacacagagatttttctctccatcttttaaagtttttactccaccactgctcactatgaacttattatattggagtggatgcaaaataaagtgccagaaatgacttgtagaacatggtctccttgctttcctccttataatgaataagtgatgggattaaatggattcggtacttttgggcccagaggaagtatctgggaatttgttaagaaataaacagaaagtagagagtgatgtcagtaaagtgatagactaggaagccccaggcttcattcactcacagataaactgacttgacaacaataagcctttatgagaactccagaaagtagttaagaaatcattgcacctcaggcaagctcaaagccaagaacagccacattataatgagtaagaaaggttattttatttcaaccttagtagctcctccaagctggcacaacacagcaaaattaggagaaaaaggccagctcatgccttttcctttgagagggaaagagaagagtagaacatatgtttaatgttctagcttttcagggggctgctcagggactggtttccctctcacctggcttgaagcagtgatgaggaaccagtatagtatggatgtcttgggactgctgagaagaaaaggttgctcagcagtttgatgcggccccagagaaccttatcaccatgaaagagctggtacagcttggagtgactgggagaaaatgcccagctcatgactactcgtttggaagaaaaagagaagagtggaacatgcatccagcaattcagtgtattttttttttttttttttttttggtcagggggctgccctacaaacagagttctgtcttacctgacttggagcattgacagaacctgcatgctttggatgcctatggtcacagaaaacaatagggtattcagcagcttgcatattacatcagagaatttctagtactgcagacagacatcagtgtcagcaagagattagaagctcctgaaaaagaaactgcaaatctctctaactgggaaatcagatacataagctcagaaaagatgtatccccagaaaagattttggaggaccccagaatctctaaccaggccgattggtgaagctcttcccttgtatgaaggcagtttatgaagattggaagaggtggctgtatatttaaatgcacacatcacagcaaaaaataacaagacacatggaaaaacatagaaacatgactcaatcaaaggaataaaataaacttccagaaaaaataatcctaaaaatggatatctgtgaattacttgacaaagaattcaaaataatcaccttaaagaagctcaatgcattacaagagaacacagaaatataactaaacaaagaggaaggctgggcacggtggcttacacctgtaatcccatcactttgggagactgaagtgggtggatcacctgaggtcaggagttcgagatcagcctgaccaacatgatgaaaccccgtctctactaaaaatacaaaaattagctgggcgtggtggcaggtgcctgtagtcctcgctactcaagagactgaggcagggaaatagcttgaactcaggaggtggaggttggaggttgcagtgagccaagatcacgccattacattccagcctaggcaacaagagcaaaactccatctaaaaaaaaaacaaaaacaaaaaaacaaaaaaacagccaggcatggtggctcacacgtgtaatcccagaactttgggaggccgaggcaggtggatcatgaggtcaggagatcgagaccatcctggctaacatggtgaaaccctgtctctactaaaaaatacaaaaaattagctggacgtggtggcaggcacctgtagtcccagctactcaggaggctgaggcaggagaatggcgtgaactcaggaggcggagttttcagtgagccaagatcatgccactgcattccagcctgggcgacagagccagactccatctcaaaataacaaaaaacaaacaaacaaaaagaacaaatggaaaacaatgcacaaactaatgtagaatatcagcagagacagaaaccagaataaaggccaaacagaagttatggagctgaataatgcaataacagaattgaaatattcactataagcatttaacagcagatgtgatcaatcagaagaaggaatcagtgaactcaaagaaaggtcatttgaagttattgaattagaggatcaaatagaaaagagaatgatggaaaataaagaaagtctgtgggatttatgtggtaccactgagtggaccaatacaggcattatgagagttccagaaggagaagggagcaagaaagggaagagagtttatttgaagaaataatggcttaaaaccactcaactgagaaagaaaatggatatccaaattcaggaatcacaaaagactccaattaagttgaactcagagtctcacaccaagacacacaataaccaactggtcaaaagcaaaagtcaaagagagattcttgaaaacatcaagagaaaacagactcatcatgtacaagggagtttccataagattatcagtggatttctcaccagaaacattacaggtcagaagggagtgggatgatatattcaaagtattgaaagaaaaaaaatcttgcctagcaaaaatactacatcttgtaaaactgtccttcaaaaataaacagaccttcccaaataaacaaaagctgagggacttcatcaccactagattaggcttagaagaatagctaaagggagtttcaaaatgaaatgaaaagattagctagcaacatgaaatcatatgaaaatataaagctctttgctgaaggtaaatatttaagcaaacacagaatcctctaatactatgatggtggtgcataaataatttttaattctagtgtagttaaaaatataaaagcatgaaaataactaaactataaatctatatacattgatacataaagttaaaaatgtaattgatagcaccaagaacataaagtgtgtgtagggtaacatgtaaagaagtaaagttttgtgtgtgattgaagttaagttcataattataagttcatgtaagttcatcaagttcactataagatgtttaatgtaatctctatggtaactacaaataaaatatcttaaaaagatgtacaaaaatgagatagaaatacaaacatgtcactgaaaaaaatcacaagagaagacagcaggagattgtaaaatttctttcctatcagtaattactttaaatgtaattgaattaaacactccaatcaaaagacacagaatggctgaatggattgaaaaagaaacaagatgcaaccgtatgctgtctacaaaagactcactttagctctaaggacacacacagaatgaatgtgaaaaaatggaaatagatattccatacaaatggtaaccaaaagagagcagaggttgtgatgcttatatcagatgaaatagactataattctaaaacttttcacaagggacaaggaaaaacaatacatgacaacaggatcaataaaataagatacaattataaatattcacctaacatcagaacacagacatatatgaagcaaacaatggtagaattgaatagacaggaacacaataatattagaagatttcaataccttattttcgataatgaatatatcaaccagacagaggattaatatgaacacagaggacttgaacaacactatagaccaattagacctaacagacacctgcggaacactccacacaacagcagaccatacattcttctcaagtgcacatagaacatattccatgtccatggaacaaatttaaggatattgaaatcagaccaagcaagtatcttttctgacaacaatggaatggaatgaaactagaaataaacagcagaaggaaaatcgaaaaattcaaaattaggtggaaattaaacaacacactctttttttttgagacaaagtctcgctctgtcacccaggctggagtgcagtggcgcaatctcggctcactgcaagctccgcctcccaggttcacgccattctcctgcctcagcctcccgagttgctgggactacaggcgcctgccaccacgtcccactaattttttgtattttcagtagagacgggatttcaccatgttagccaggatggtctcgatctcctgacctcatgatccacccgcctcagcctcccaaagtgctgggattacaggcgtgagctaccgcgcccagccaaacaacacactcttaaacaactgaagtcaaaggagaagtcacaagggaaattataaaattatcctgaggataatgaaaataaatgcacaacatatcaaaacttatgggatgcaacaaaagcagtactaagaggaaagtttataacgacagatgcttacattaaagaagaaagatctccagttaacaacctagctttacacctcaaggacctataaaaaagaaaaaaattggccaggcactgtggctcatgcctgtaatcccagcactttgggaggccgaggtgggtggatcacaaggtcaagagatcgagaccaccctggctaacacgatgaaactccgtctctactaaaaatacaaaaaaattagccaggcgtggtggcgggtgcctgtagtcccagctactcaggaggctgaggcaggagaatgacgtgaacccggcaggcagaccttgtagtgagccgagattgtgccactgcactccagcctgggcgacagagtgagactctgtctccaaaaaaaaagaaaaagaaaaaaagaaaatctaaagctagcagaagaatgaacataataaaaattagggcagaactaaataaaatataaaatagagaacggaaaaataatagaaaaaaacttttaaatgcgtttttttaaaaatccacaaaattgacaaacccttagctagactaagaaaaaagagagaaaacacaaataacaaagatcagaaatgaaagggaaaacattacaactgatactacagaaataaaaagaatcataagaaattactatgaacacttgggctgggtgcggtagctcactcctgtaatcccagcattttgggaggctgaggcaggaggatcacgaggtcaggagatcaagaccatcctggctaacacagtgaaacctcgtctctactaaaaatacaaaaaattagccaggagtcgtggcgggcgcctgtagtcccagctactcggcaggctgaggcaggagaatggcgtgcacccgggaggcagagcttgcagtgagccgagatcgcaccactgcagtccagcctgggtgacagagcgagactccttcccaaaaaaaagaaaaaggaaaaagaaattactatgaacacttatgggcaaaaaattgagtaatatataagaaatggaaagtttctagaagaatacagcctgtcaagactgacaatctgaccagacctgtaacaaataaggagaatgaagcagtattcaaaaatctttcaataaagaaaataccagggcctgatagcttcactggagaattttaccaaatatttaaagaatttttaatctttctcaaattcttccaaaaagttgaaaggaagggaatatttctgattcgttttatgaggccaacattatcctgatatcaaaatcagagaaagatacaaggaaagaaaactacaagccaatatctctgatgagtattaatggaaaaatacttaaaaaaatactagcaagccaaattcaactatatgttaaaaggataatatgtgatggccaaatgggatttatttctggaatgcaaggataatttgcatatgaaaatcaattaatgtaagatatcacattaacaacattaaggacaaaaaatatatgatcatctcaattggtacagaaaaagaatttaacataattaaacacacttgcatcataaaacactcaacaaactagaaagagaaagaaattattttaacatagtaaaggccatatatgacaagcctacagctaatattatattcagtagtgaaaaactgaattctttcccttctaagatcaggagccaggcaagaatgcccactgtttaaaaaattttatagatttttattttttaaaaagattatttatttttcaattgacaaaaattatatatattcatggtgtacaacacaatgttttgaaaaatatactgattgtggaatggctaaatcaaactaattaacatgtgcattacctcaaaaacttatttttggtgatgagaacacttaaaatttactttcttagcaattttcaagtatacaatacattgttattaactatactcaccatgttgtacaatatatctcctgtttaactgaaaaaaaatgggataacatcaaaataaaatgcttctgcacagtgaaagaaacaatcagagagagaagaggcaccctatagaatgggagaaaatatttgcaaaccatgaagataagaggttaataaacagagtatataaaaagcacacaatttaatagccagaaaacaaataacccaattaaaaaataggagcaaaggactggccgggcgtggcggctcacgtctgtaatcccagaactttgggaggccgaggagggcggatcccgatgtcaggagattgagaccatctgactaacacgatgaaaccccgtctctactaaaaatacaaaaaattagccgggcatggtggcgggcacctgtagtcccagctactcaggaggctgaggcaggagaatggcgtgaacctgggaggcggagcttgcagtgagccaagattgcgccactgcactccagcctgggcaacagagcaagactccaaaaaaaaatctctctctctctatatatagatatatgtatatatctatatcaatatctatatctatatatgtaggagcaaagacctaaacagacatttctcaaaaaaagacatataaatggcctacaggtatttgaaaaaatcctcaacatcaccctaaccattaatgaaatgcaaattaaaactacattgagatatcacctcacatcagttagaatggctattttcaaaaagataaaaggtaagtgttggtgaggatgcggaaaaaaagaattctgttacattggtgagaattttagtacagaaattatggagaccagtatgaagaattctcaaaaaattaaaaatagaaataccatataattcagcagtcccactttttggtatatagccaaaggaactgaaatcaggatctcaaaaaggtatgtgcacacccatgttcagtgcagcatgttattcacaatagccacggtctggaatcaacctaagtgtccatcaacaaatgacagaataaagcaaatgtaacatatatacacaatgggaatagtaatttagtcttgaaaaaagaagcaaattctgtccagtcaggaaatcctgtcatctgggataatctggagtacattatactaagtgaaataagccagacacagaaagacaaacaccacatgatctcacttatatctggaacttaaaaatgtcaaactcatagagatagagaatagaatggtggttgccagggatgggggctgcagggattgggcagatatttgtcatatgatgcccattcttgccacttctattcaacatagtgtgggaagtcctgtaaagacctaaatgtaagacccgaaaatacaaaccttctaagagaaaacacaggggaaaaactttatggcattgaacttggatatgattttatggtaattataccaaaagcacaggcaacaaaagcaaaaatagacaaattggaccatatcaaacttaaaaatgttctgcatgtcaaaggaaacaatcaacatagtgaaaaggtaacctatggaatgagataaaatgttcgcaaaccatacatctgttaaggggttaatagccagaatatataaagaactcctacaattcaacaacaaacaaagaagcaacccaattaaacaatgggcaaagaacttgaataaacatttctcaaaaaagacatacaaagagccaacaaccatatgaaaagatgttcagcattactaaccattctggaagtgcaggtgaatactgcaatgagatatcacctcacacctgttaggatggctaccatcaggaaaatagaaaataacaactattgacaaggttgtgaagaaattggaacccttttgtactgttaacaggaatgtaacatggtgtggtcactatgggaagcagtatgatggagaattttcataactttcagcagttcacttctgagtatacattttaaagaattgaaaatattatctgaaagaggtatttgctcacccatattcattgcagcattattcccagtagccaaaaggtggaaggaacctaaatgcccattgattaagaaaatgtggtataaacatacaatggaaaattatttaatcttaaaaaagaaagaaattcttaaacacatgacaacatgaatgaacaaaccttgaggacagacattatgctaagtgaaataaaccagtcacaaaaaaggcaaatactgcatgattccacctctatgaggtatctaaatcagtcaaacttttagaaacaaaaagtggatcggtgattgctgggtggagagggaaaagggggttgtttcgtaggtacatagtttcagttttacaagagatgaaaaggttctggagagtaactgcacaacaacatacattagtagttaagactactgtactatacatttaaaaatcattaagacgataaactttgtcatgtgtttttcaataaaaaaataaacagaaggttacagcatcatctgtaaactacaagatcatcagcatatgttatgtgttgaattttgccctccaaagtgtttgaagtcctaaccctcatgatgtgtaaatatgactttcttcggaaataggatctgtgcagatgatcaagttaagatgaggtcatcagagtgatctctaatccaatatgactgtgtcctcataagaaggggaaatctgggcccagagacagacatatatagagggaatacaatgtgaagagatagaggaaaaaccatctacaagccaaacaatgccaaaggctgggggagaggcatggagtggattctccctcaaagccttcagaaggaaccagccctccggcactttgaacttctggtatccagcattgtgaggaaatacagttttgttattaagccacccattttgtggtactttgttagtgaagccccaggaaaccaatacatcatgggttggggttatcgggctttaataaattacagcctctttcttcaacgcctgagtttgcaaccaaacagcataagcccaaacatgctacagaccacatcttagatagagggttaaacaactacacatcttcccctttaactccattgttgagcattcctcactgggtctcttcataatacttttcttgtagagtatatctatacgactttttaccagtttttaaacaggtatgaaacaaagttaagcttttgcctcaggaactgtgctaatcttacccaaagcttttagagcatttttagaaatgagagtgtttaaggtagattgaattaccatttcttttggtggcagtagaagcttgccatttaattgagaaactatatcttaaatcacaagtaaagaaatttgtggcttccactctagagaaaaactccagagaagagcataaattatgagctaaaagctggtatcgtttagagaaggctccaaagatgttttatggtaacaccaatctgaggaaggaagctctactcttgcctgtgataatttacttttgtctgatttcatgaatcatctcttatggaatgtgattggaaaatatatttacattactatatttgaaaaatgtgagtctacaaacttagttctctctaaccagtttcttcattgttgccaaagaccccgtgcagagcaatcacacagaaaaaggctgcttggattcaccagtgcagccgctgtggaggggcctttcattggcactgaaaatgcttgtttggtgatgaataacctttgttattattatactgcatgttattaaaatttttaacataattccctctaaactaatagtaattcagacaatgcagccactggcagacagcttcattagtcaatcttctttcttataaatgggagaattaagaactgctattactgtcattctgtctgctgctcattattgttgtagacttatgcacgagactaatcatattctcgttgaatgcatcatgcttagctcttgaacgtgtgtgacagtgacaagagcccaccgagtgacagggcagggttggtggaattctgtgtctccatatgcacatgcatgtgcgttccttcttacactcaggcacacataggctattttccagggttttattttattaattccttaggaatctcagaaagtgaacttcagaggctgggcacggtggctcatgcctgtaatcccagtacttgggaggccgaggtgggcagatggcctgaagtcaggtgtttgagaccagtctggccaacatggtgaaaccccgtctctactaaaaatacaaaaaaaaaaattagccagccatcgtggtgggtgcctgtaatcccagctactcaggaagttgaggcaggagaattgcttgaaccagggaggtggaggttgcagtgagccaagatcgcaccactgcactcaaaaaaaaaaaaaaaaatgaacttgagaaagcaagatggtaccctctgaggctttccccatacagtgtacatgtgtcctctccaaggaaaaatactccaaggacaaaaacaatacaataggattgttttttgtgagtataaacatctgatttctctgtagagagagaaacaaaacatttagaaatcatcaaaatgttttgaggcctctaaggtactttctgtgacttcacaaagactattattgaattcactttaaacaaagcattaaaaaataataatgtttgctctttctccaaagggagacaaagataatttttatggaggaacccttttccccattggattactagactatatcctcagtaaaaaaatgaaaagtgtccccacctggttgatggttaaacaaatgaagattaagagagaactaaaatgtctagaagcatttaacactgtgaaattctatgatagatgcttggatatttggagaatggaaacattatataaaatatgtgtataggttgggcgtggtggcttacacctgtaatcccagcactttgagaggctgaggcaggaggatcacttgaacccaggagtttgagaccagcctgggcagcatagcaagacccccatatccacaaaaactaaaaaaaaaaaaaaaaataactggatgtggttgtgcatgcctgtagttccagctctgtgggaggctgaggtgggaggatcacttgagcctggaaggttgaggttgctgtaagcagtgatcacactactgtacttcaggctgggggacagtgtgagaccctgtcttgaacaaaaaaaaaagtttgctcaagaaatattcagcaaccctctgtttcccaaagggaagaaactccttagagctgtgtttactgagtgtggtacatggtatacttttcttaggatacagatttctggcttgtcccggaaaaccagagtgtggtgactgtgggagggccccaggtcattcttatgtgccaacatctgaaagccaccatctcagagaccaagtcgtccactatgtggccccaagtcatctttccaatttatctgaaagtcttgccacaggggtcctcaactttggtgtatatcacaattacatggcctccacctccagagatttgaactcagtaattcttgggtaaatccatgaaatgtgggttttgattaaattaaatgatggatctgtagataattctgttgtacacagagtttgagaatcaccctgcttgcctaacagtcagcagatatgagttctgcactctggccttggctctgccccttgcctgcctggtcctggacatatcactgaactgctcagagttgttcattctttcctgtataagagcagcatgggtgcacctgcactggctacctcacaagttagatgatgtatggaaaaccacttagttagatgcaggatgtgatgtattttagggtgtccaagtcactgagtattatctacaagttaggcactgtcttcagtaccagaaatgaaataagaagcctgcattcgggaagtttattatgactctgaaggccgtcagaaggttgctattccctggtaatgttaatctattcttggtcttgtaggttacgcatgctgttgctgactgttgacacataccatcggctaagagcagtggctggctttgaaacagctccaccttccctgaatactctttcagcgtctctgacgtctaggccaagtttgtgtacttagctccatgacagcatcaagatacaaacaacaagaactgatggatttcagtacatcttctggggctcctgcctgtgggatacagcttgtctttgatgtcttaccctctacatccatgtctccttcctgtctgtgctgtggacttcaaactccagcatcagacatgaagacaacatcctgcagagattgctttaagcagctcccacagttataacaacatcatggccctatagcaaatatcataaaaatttttccacacctatattcacaaacataaaatcttttattggttctgtttctcagttgaatcatgactgatacaatatgagaagcagtatattattatttataggtaaggtgtcattaattacagatgcatgggtcaggcatagtggctcatccctgtaatccaagcactttgagataccaaggtaggaggatcccttgaggccaggaatttgagaccagcctgggtaacaaagtgagactctgtctctacgaaaaacaattttttaaggtgcatattataaacctagggaaccactaaaatatttttaaaagaagcataaatgataaaaaaacaaaaaatggagattaaatggaatcattaaaaataattcaaaatcagttagaaaaagaacaaagaacaaatataacaaataaaaacaagatatgagatagtacattaaaatccaactgtatcagtagctgtatttaatttaaatgacctaaacataccaactaaaacacagagatgatcaaattagataaaaaagcaagaatcaactataatctatctataataaattcacattaaatataaaagtatacaggttaaaagtaaaaggatgaaaaatataccatatatgccatgcaaacagttgctctattagtattagataacaggaaattccagaacaaagaatatcttcagaaataaaaagccaccacatatagtgtaaaagggccaattcatcaagaagaaaaagactaaacgtgtatgcacctaacaacagagctttaaaatgcataaagcaaaactgatagaacagaaagaaaaaatagacaaacctacacttagagactgcagcattcctctctcagtaatagaacagatgcacagaaaatcagtaaaatatgtagactagaactacattgttaagcaacttgacaaatttggtatttattgaatgctctattcagcaatagcagaatacacattcttttcaagggctcatgggacatttaccaagatactgggacataaaacaaacctcaacaaatttaaaagggttgaaatcatatgaagaatgttctgttactatagtggaatcaaactggaaattaatagcagaaagatgtctgaaaaatcctccaaatatttggaaatgaaatgactcacttctgtacaacccataggcaaaaaagaaagtcacaagggaaattaaaatatattttgaatgaaaatgaaacatcaaatacaagaatttgggagatgcaggtaaagcagtgcatagggggaaatttatatcattaaatgtttatacttgacaagaagaaagtcctcaagttaatggtatagttttacagtaaagacctggtggggggcggggggggaggcgggaaggaacaaataaaataccatagcaaagaaaaaggaatgcaataattaagatcagaaatgaatgactttgaaaagagcaacacaatagagaaaaataaaataaaaaaaaccgagttgattcagtgtgcccctattactttctagttaaacaaaaagaaaacttttgtttcaataattatacttaaatgtttattggatttttggagggtgactttttacgtactttaggatgacagataaaaacacaagcagtgcctaagtaggttcataattttaatttcacttacctgtaattttaccaatgcttacttatcaatgtctttaaaggtacaattttatggaaaattttacctacagtctgaacatattttctggtctttaaaatgaagttagtatgctgtataccatcagtatataaacttgaaacacttatagaacaaacatatcagagatcaataaatccttttgggtcactacaaactaccccattggcagtgtatatttattttgtctgttgagtaacaaacaggtaagttttagagttaacaaaagattaataatacaaaacagagctgtctagtaataatcttcagagctagaacacccacatgtatttataaagtcacatttttgggggataaccggaggtaacctcagtgaaaaaaagttaattctgttgtaaattcagttctgatagtcccacttgatgaccttttgtcttaaacaatttctaagttggctcatatcataactatgccaaacctcttgaaaaggctcattttaaggctctctaacagcatattattaactggcgagtcttccagaaggcagacatcctaagcttaacattaactctagtccaatgtttttggttgcctgcatatattttctttggcgttaaaaaaaaaaaagttggcctggcgcagtggctcacacctgtaatcccaacattttgggaggctgacgggggcagatcacttaaggtcaggaattcgagaccagcctggccaatatgacaaaaccccatctctattaaaaatacaaaaattagtggggggtggtgacgtgggcctgtaatcccagctactctggaggctgaggcagaagaattgcttgaacccaggaggcagaggttgcagtaagctgagattacgccactgcactccagcctggcgacagagcgagactccgtcttaaaaaaaaaaaaaagttttcactcgatactcttcttctagagctggcaatacattggctcagttgcaaacatgctcattattcccttcatcttacgtagccttagaagagagcagctagtgatatgccataaaactgtagacgtgataggtaggagcggatatcacttagtccaagtcctctggtctccaggtaggcaaggtcctttgcagatgccctggtgttagcggtggttcccagtctcggcaatgcattagtaacacctgggctgcctttataacggccaacctattatccccagtgattgatttaattgttcttgggttaaaatcatccctacattttttttttttagatggacacttactctgttgcccaggctggagtgcagtggcgcgatctcagctcactgcaacccccacgtcccgggttcaagtgattctcctgtctcggcctccagagcaggtgggattacaggtgcctgccaccacgaccggctaatttttgtattttcagtagagacgggatttcaccatgttggccagactcgtctcaaactctgacttcaggcaatcccctcgcctcagcctcccaaagtgctggtattacaggtgtgagccactgcgcctggccacccctacatttttttaaagcagccaagggaaatattatataccaaggctaaggaccactgagctgaagtactaagttttcagatgaggaaaccccaatctcctttctcactcatgtgggtttacggtattaactacattttaaatgtcagaagtttaaaaagcacaaaataaatgttacgaatagagttaaaatagggcagcagtgattctgatttgtgttatatatattgcaaggtttcacatcttaaaaatgtgaactttagtggatgattcaaagcacatgtattattctgtgtaaagaacactgtgtgtattaactcatcttcagtgggtattaactttgtgcttttttaaaaatgaggatttaaaaaacaaaacattaatgttctcttgctcattttctgagtcatgggagtagacggtatatcatatactagtcaggtttgcccagaaaatagaaagcattctaaatatttcaagcagaaagggattatatttgtggttatgtgtttattgataggactggagtgggaaagctagggaaggctgccactcttgttcagggtggccactgttactgtggtccaagaagctgctgctgctgcccaggagagaatattgcagggaatcacagtggactccagctaccttgcatcagaactgcggagacaggcgacacaggcaatacccagaggctgctgaagacagcaattctgttccttgctgtgggaggagggagaatagtgttgtgtgtgcttttacatctcaggcaagtctatctcgttgacatcgagagatgtcaggttgcactgagaaccctagaggaagggaactctgggaaaggcaggcactggctctctagactgtatgacaggcacaagtgcacagatgagaatgagaatgaatcctcattgtcaagcagaattaaaccaaactaaaacacattataaagcaaaaagatgatgaagagatgggccattgaacattttgtgtgacgttatctggattctgtgaaaatggaaccaatgttttccgatccactgagctacctttgttaacagggatattcataacatgtatgttttcttacattcatatatgtttttataaatgccatttatgatcctgagtatgtaaaggaagatgttgcctctgatactggtgtggcatgtgcaagactatttttgtgagtttcagtttggcgactgcttttggtgggaagaggtctttcagcaaacaaaattcaccagtcctaagagcgccttgaatgctggagataaaaatatttctttgaccataataactctgctgttggtatttgcttcagatttgtggcctagcatctgagattaggtccaagctttaataatgattggctgttcccctcgaaccctgggggtttatttatcatcattttccacccatgtgtcagctgaaaaaacaaaaaaattatcgattagcaatcccaaccacttatcacttaaactggataatttattacctaagtcaaaaagacacgtatcagtagagatgagctacagtgattattagcttcatactgtcctaccttgcctgcatgtctgcacttgtgacctgctgctctctttcttctgaatggagacaagaaagggaccatcagatgctggggttctgctggtagacagcgagcagagctatagtccctgactatgatggttgcttcactgctttagcttgtctcctgttactcttgctgcagcatggaaggctgcaataatactattcatttctaaatgcttgccagcgaagatggagtgctcaaatcatctaatgggtggatttaagacagcgagaaggagaaggcttgttgccatttccaattttttctggttctttaagatggcatgagagggaaataattaatcttggatagattttagcaaaacgaaacacccatgttcctaatctttggtaaaatactttaccaatttagggccgggtgcggtggctcacgattgtaatcccagcactttgggaggccgaggtgggtagatcacgaggtcaggagatcgaaaccatcctggctaacacagtgaaaccccatctgtactaaaaatacaaaaaattagctgggcatggtggtgggcgcctgtagtcccagctactcgggaggctgaggcaggagaatggcgtgaacctgggaggcggagcttgcagtgagccgagattgtgccactgcactccagcctccgcaacagagcgagactccgtctaaaaacgaacgaacaaacaaacaaacaaacacttaaccaatttagtttttccttgaggactagggttattttcctgatcagaaagacaggactaaggtgccagcctgggaattttgaatgactcatggaaagctgttacaggtagaaagatgtcagtgccaagtgttttaaataggcattttggaccattaggatgtcatggtttgcttatcgtggctttttttacgtctgaatacattctcatcagctatgcttcattcgttataaaaggaactctagaatcaagtgttgccattcttcttggtttcagaagaaagataatctcttgagctcacaggctcacaaacacatctcactgaaagtaattaccttcacatcagttatgagaaggcacatgctgagtttgcctccccaatgcctttcaagatttatgagtgccttatcactggatatcatgggcaacagatgcaccttataacgatgactttaaaaaataaactataattgttatgccttggctcctggccaaagaaacaggatctaagtctgattgatggcacaaggtagctttctatcatttaacagtaaatggctttgctcttttattatgttttgcttgagtaaaaaaaaaagataaatagaattaagaacttgatgaaagacagtcctgcagtgatacacattgaaagatgcaaaactaagagtcactgattagctggtgaacttgctagtgtggatcatggaatgactgtaagcatcatctcatgagcccatcatgaagctgacctcacagaggcagtggcactgcaggagaccaccaacaaagcagaaatggcaaaagagttcccagagaaataacgcctgccggggtcccaagataggaactagaaagaagtcagagctgtgcattggtgaaatacaagtgcttaataacccccatccttactcatatctgcatatgcacagcactgtgtgaaaagtagatgtgaccgattgcttgttatagaccagtgttcaccctcttctgtttcctttggtcatggaacctctaagttttaagtaggcatagagccacccagttaaagattgcatttcccacatcctttatcattaagtgcagccttgtgactagattctggcaatgggatatgaacagaaatggtgaatgcagagctgctccaagatggctgactagacgcagccaggaggaacatctcccactgagggtctgggacattgggaagactggcacgcttctagcagatcttcagagagaaggtattgagagtggatggagggaagacacaggtgctgggctgaagggggaggaagctgggaaccctgcatggggctactgcacaccaggactccttcctggcttccagtgactcttgcgaaaggggtgagtttaataggcaaattgctctcaccatgggcctctggaattgcagcaggaggagaccccttgagcaccgtggacacttgagttggcagggagagcagcttggagacgtattagtggcagaaccccagactgtgcagagcccagagggtttggtgtgggaaattctgtagtggagcatcaccagggatacccatcccccgaggctcagcttgctcccataggaaacttcagccctgtgagatctgtgggaccttaactctgcagggcagtcttgcccatcagactaggctggtctgagctgagaaccccatggttctgctagccttccctggggcccatcctggccatgcctgcttgcagtgcaggccccaggtacctcctgggggattgaaccataggtcctgtgctggtggactacaattaactggcagagtgctctagcagagtgatccctgtgaatacacaccatctgcaaactccctcaactgtagcctctcctgtgttgctttgcctgcaggcagtagcccatggccaacccaaacattgctttgccggtttgtgtgtgtgtgggcagaccttgccttcccttccccaccactgcacctgtgcacataaacctggccatgccactgctgttggcattaatgcactctgcccactcccacctccccactgcaacattgctattgtcactggagattggtgggcatggagcctatgagccttccctccaccagcaccctgcccctgtgccaacactgctgccagtgcaaaattggacatggagaacagcaaactcacccctgccctgagtggcactgccacctgtgtgaatgtgcacagagggcaatacagtcctgtgtccaccagtgccctactgccatgctaacaccaccaccagtgtggatacacacacaattattggcaggggccttctatccccaagccatggtgccaccactgctccacatggaggccaacatcccagcaactgctagcactctgccacagctgatgaacacaaactccaccacactgccactgccactgctgctggcacatgcaaatgaggctggatcccactgtcaccaccctatgaagtgctttggctggtatcacttattggagtgttgtgacctgtggtctgggagcacctcagaccctcaaaaacagcagtttccccttgaggagccaaagagcaaagccaggcctaatcccagcccccagagttagaatatgcagtccaggagtcctgagctgagccttggccctctaaaatattccagaaatgaagccagttgactgaactcaccttaaaccacaatcaaaccccaaggtcatcaaataggataaatgaaagaaaacccatccaaggtcagcaacctcaaagactgaaggaacatcagtccacaaagatgagaaagaaccagtgcaaaaactctggcaactcaaaaagtcaaggtgcttcattccaccaaacaaccacactagttttcaagtaaaagttcttaaccaggctgagatagctgaaatgacagaaatacgattcaggatatggatatgaatgaagatcatcaagattcaggaatacaatgaaacccaatctaaggaagataagaatcacacacacaaaagctgatataggagctgacagacaaaatagccagtatagagaagaagatgaccaacttgataaagatgaaaaacacactacaagaatttcataatgcaatcacaagtattaatggcagaatagaccaagcttagaaaataattgcagagcttaaagactggctttctgaaataagacagtcagataagaatgaagaaaaaagaataaaaaaaagcaaacaaaacctctggagaaatatggggtgatgtaaatagaccaaatctactactcattggcatccctgaaagacatggggaaaatggaagcgacttggaaaacatattccaggatatcatccatgagaacttcctaaacctagctagagaagccaacattaaaattcaggaaatgcagagaaccactgcaagatacttcaaaagaagatcatctccaagacacataatcatcagattctccaaggttgaaatgaaagaaaaagtgttaaaggcagctagggagaaaggacaggtcacctacaaagggaagtccatgagataacaggggatctctcaaaagaaactctagaagccagaagagattgggggactatattcagcattcttaaagaaaagaaattccaaccaagaatttcatatttggccaaactaagcttcataaacaaaggagaaccaagatccttttcagacaagcaaacgatgagggaatttgttaccaccagatcttccttacagaaattcctgaaaaaggcaataaatacaaaaaggaaatatcatcaccagccactacaaaaacacacataagtacacagaccagtgatttgataaagcaaccacacaaagaagtctgcataagaaccagctaatgacatgacagaatcaaattcacacatatcaatgttaaacttgaatgtaaatgggctaaatgccccattaagagatgcaatgtggcaagctggataaagaagcaagactcaatggtatgctgtcttcaagagacccatctcacatgcaatgacacttatagactcaaaatagaggaatggaggaaaatctaccaagcaaatggaaaagagaaaaagcaggagtaaaaatcctactttcaggcaaaacagactttaaaccaacaaagatcaaaaaagacaaaaaagggcattacataatggtaaatggttcaattcaacaagaagatctaactaacttaaacatatatgcacccaactaaggagcatccatattcatgaagcatgttctcagagatgttcaaagagacttagaataccacacagtaataatgggagaaggaaacattccactgacagtattagatcattgaagcagaaaattgacaaagatattcaggacctgaactaacactgaaccaaatagacttgatagacatacacaaaagtctccactcaagaataatagaatatacattcttatcaccgcatggcacgtattctaaaattgaccacacagttgaacacaaaacactcctcagcaaatgcaaaagaatcagaatcatattaaccagtctctcagaccacagtgcattaaaaatagaattcatgactaagaaaattactcgaaaccatacaattatatggcaattaagcaacctgctcctgaatgacttttgggtatatagtaaaattaaggaagaaatcaagaagttcgttaaaactaataagaactgagatacaacataccagaatctctgggacacagctaaggcagtgttaacaaggaaatttatagcgctaaacacttacatcaaaacgttagaaagatctcaaattaacaacctaacatcacaactaaaataactagagaagcaagagcaaaccaaccctaaaactagaagaagacaagaaataaccaaaatcagagctgaactgaagaatgggacacaaaaaaaccattcaaaagatcaatgaaggcaggagctggttttttgaaaaagtaaataaaatagatagagtgctagccagactaataaagaagaaaagagagagacccaaacaaacacatttagaaacaacaaaggggatgttaccactggccccacagaaatacagattaccatcagagactactatgactgcctctgtgcacacaaactagaaaatccagaacaaattgatacatttcttgacacatacatcctccccaagactgaaccaggaagaaattgtatccctgagtagatcaataatgaactttgaaactgagtcagtaataaataacctaccaaccaaaaacagcctgggaccagacagattcatagctgaattctgccagatatacagagaactggtattatttctactgaaactattccaaaaaattgaggaggagggactcctttccaattcattctatgaggccagcatcatgctgatactaaaacctggcaaagccacaacaaaaaagaaaacttcaggccagtattcttgatgaactttgatacaaaaattatccacaaaatactagcaaaccaattccagcaccacattaaaaagctaatccaccataattgagtaggctttatccctgagattcaaggctgattcaacatacacagatcaataaatgtgattcatcacataaacagaactaaagacaaaaaccatgattgtctcaatagatgtagaaagggctttcaaataaaattcaatatcctttcatgttaagaactctcagtaaattaggtattgaaggaacatacctcaaaataataagagccatctatgacaaacccacacagacaacatcatactgaatgggaaaaagctggaagcattacccttgaaaactggtacaagacaagcatgccctctctcaccattcctattcaacatagtattggaagtcctggaccgggcaattaggcaagataaagtaataaagggtatccaataggaagagaggaggtcaagctatccctgtttgcagatgacatgattctgtatctagaaaaccccatagtttttgccacaaagctccttaatctgataaacaacttcagcaatgtttcaggatacaaaatcaatgtacaaaaaatcactagcattcttataaaccaacaacagccacgctgagagccacttacacactgttggtggcagtgtaagttcttttaaccagtgtggaaagcagtgtggtgatacctcaaagggctaaaaacagaacaaccatctaacccagcaatcccattcctgggtatataccaaagtgaatataattcattatatcataaagacccatgcacacatatgttctttgcagcactattcacaatagcaaagacatggaatcaacctaaatacccatcagtgatagactggataaagaaaacatggtacatatgcatcacggaatactatgcaaccataaaaaagaatgtgatcacattctttgcaggtacatggatggggctggaggccattatccttagcaaagtaacacaggaacagaaaaccaaatccacatgttctcacttaaaagtgggagctaaatgatgagaacacatggacacatagtggggaacagacactgggtcatacttgagggtggagggtgggaggagggagagaatcaggaaaaacagctattgggtactaggctcagtacctgagtgatgaaataatctgtacagcaatacaccatgacatgccaaaccctatataccaaacctacacatgtacccctgaacctaaaataaagttaaaaggccgggtgtggtggctcacgcctgtaatcccagcactttgggaggcccaggcgggcggatcacgaggtcaggagatcaagaccatcttgggtaacacggtgaaaccctgtctctactaaaatacaaaaagaaattagctgggtatagtggcgggcacctgtagtcccagctactcgggaggcttgaggcaggagaatggcgtgaacccgggaggcggagcttgcagtgagtcgagatcataccactgcactccagcctgggtgacagagcgagactccgtctcaaaaaaaaaaaaaaaaaaaaagagatactgaggcttaatgatttcctcagggccacatgaataaaaattgtgagttgggcttccacaacaggcatctaatttcacttacctcatatggcatcccaagtcagtcaatacgtatttgcatctagttggtgattctcacaggagtgcatggctactcctgactcaagactggtccttctgtaagtggaaagcttttccccatttggagagagtggcatctggaataagggagggagagctcactacctaaggccgacttaatgctgcgctaggtgttgcgggtttacaaaagtacagagataagaaaaatcaactaaatttcaatacttgatttcccacatgtgtgttggttccttttccttttgtatattttaattccactgtgctgcttattaaatccacaattctgtatgtatcttgagtttagagggaatgttttattcattgcgcagtgtctgaaacatagtacaagcatagtaacttcattacatttttaaaagttataatccaaatctatatgaaccacaacaatcccattgatattttgatgaattatataattagaatttattgttgggatagccatttcttcttccagtgcaaataatactaaaaagaaaaatcatgtgcatattattaattacaatttcacgtgaattaagaattcttctttattatttatgtagccattttttaccctacaggaatgacaataatcctttcccattattgataacataataataataatactgttatgcttattttttctgtttttcctctagactcagtcatcctattaactcaagtcatttgatttaatggagtaagttaattcatattttgactgtgagtttccactaacaaaggaaaaaattcttggaagtctcttaagaagtccatttctttgttaaaagcaataatgtagtttgttcactgctgtgtggaggtgagactgtgagatagtctaataatacaaaagtctaggaagtgcagctttctcttctacttttgaaaattaccctgtttcaggatgcttcgtctcactaccttttgtttttgagcgtattcaatgtatgactaatcagaagattaaaggtattttgcctaaatgcatttttctacaaaacagggcaagaattagaaaagcctgcagtagtgtaagtaagctgacagaggtgaaagcttttttaaattaaaaaatttgataaaattgctactgctcagttatttatagagattgcaaatatgtaaattggttgagtgagaagataaattaaggggaaaaacaagctaatgggaaggaccgaccactacaaacagcattagcagtgccagtgttccaaaggcgtgctctcaggaaatttttcacctagagaaaatatcaattatgctcctaccattctgattatagacagaggtggttattttatatatttctgctggataatacatctaaaagctatgaatttgaatataatatatataatccttgttttataaggatatgaaaaattatcttttatagaatgcatcaaatccaaggaagaagataatgtggcatattcagaagtcttttcatggcatttcccagaaatctgagaactaaagtcactatgaagactcttctgtagaagagaccactacagacatcagtttctactaaacagtgaaaagtcagaaccattatatattaggtagaatgggaattaaatggccgtgttcacatttataatgcatttgaaaagcgagactagactacaatgctttgtagtaataatagattcagtgatttcacttgagacatagcaaattaaatctcagaaatgttgctgaattgattgcagggttccaacctctactatgaaaagaggaagccccgcagctctactacaatttgcctgacaaggctgaggctccaagcatgagtgatcaaaagaagataagtcattctggccctaataagcatagctgctgttaaccacgggaggagttttaaagtctctcataggaagagcctagttgtccaagctgtagtttcgagagaggccaaacgctcatcagttcatcttgtgtgtgtgaatatcagttgcaaaggttgaaacagaattatgccatatattctaaaacaggtgtcaaataatatcctgtgtactactttatcctaggcattttggggaacatcaaaatgcctaggataaaggcattttggggggccatcaaaaaagcattggcttatcaaaaattggaggagacagtgttataagaagcacctgagacagtaagtgtaaatcgtgtggccctgaccgtaaatagaatgggagcctgcagcatggactggcatgatcagaggtttggagctggaaccataaaaagcccctattaggtcctgccttccacccaccacaccatccaggccaacagatgctcactgtccacaggcttaactgatgattcctgtcacctgattttccagggtgagcagggtcactgaagtatctcaggtgaatatcccctacaggactagaggagggtgactttggagtagactgtgtgggacaagagaaataggtggtgaaatctgtggggacatcagtgggagtctttggtctgtggtctaataagtaaacctgagatcgaggtcaggatctgaaatacctgggtctacctcatggatttgtatattgcatctgcatcatgtccagcattggatatgatcatatctcctgtaggttacatttcacaaaggtttgttagttctgtgtaggcaaatataaagaggtatatgtgtatgtataagcatttaaaattctgtccctcctggccaacatggtgaaaccgaatctgtactaaaaatacaaaaattagctgggcatgttggtgcatgcttgtaatcccagctacttgggaggctgaggcggagaatcacttgaacctgggaggtggaggttgcagtgagccgagatcacgccacagcactccaacttgggcgacagggagagactccatctcaaaacaaacaaacaaagaaacaaaattctgtgaggtgtcttttgtagcaactggaatgaaactagagttcattatcttaagtgaaacaagccaggggaagaaagtcaaatatcacatgttctcacccataaatgggagctaagtaacctgtatagatggatgtagagagtgggatgacagataatggaggcttggaatgctgagggtggaatgagaggagtggatgatgagaaattagttgatgggtacaatgtacgttattttggttgatggataccctaaaagccctgacttgaccactacacaatctatgcaggtaacaaaattgcagatgtgccccataaatttgtacaacaaataaaaaaaaatctgtgagaatttgaaagtagcctatgatcatttccaaggagcagaaacaactacacgatgctgtggaaggactaatacatttgttcaaaaacaaaagcatctagtcagtcattaattctagatggcccatgaatgcataaattgtgcaaagatctacatagataatcaaggcaaccaggttctacacaaggtgaaaaggttctgaaaggacgagaagccttctaggccaccagttggtcaccttgccaccacaacaatggcccatttgataggagacaatgccatagaggggagaaaagaacagaagattgagaggagaaaggacgcaggttttgttgctgttgtttttgttgttaatgtttcctcttgcttccatgtactgcttgtcttttacaatcagtttataacttcagggccctgggactgtttttattgaaacatgacttagaaactgtaaagctgttttaggcattgctgggaaccgctgaaatagataagaaattgttatactcggcaaagttgaaaacaaataactatcagcaagctgcccaactctaccaaactcacagtgatactaaatcaatagaaagatgctgatttatgagcagtgaagtcattctcttcggagaccctgaagtatatggacattgcagtcttcaagcataaccccctcccaaattctatgctatttaaaaaactttttaagagactaccatgctacagttcaaatctgagcaattaaatcaaattgtgcatttttaccttagaatcaatggaaatctgttgtgtatactggaaataaaggaaacttgtggggaagattatagcacctctctagtcacagcagtccatcaaaatacctctgtttaatcaggccatgatgacaagcaaaatttaattgaataaatttgaatgaaaatcactgtggtagacaaaataatggcccccaaaagatgcccatgcccttaagccctgggatctatgaatgttacctgacatggccaaggggaagtaaggttgcaggtggagtaaaggtagctaatcactaatgttaaaataggtcaatgagcttggttacccaggtgcatccaatgtaatcactagggtcctgaaaaatggaagagtcagggggagttgacgttagaaagactcagttggccattgctggctttgaagatggcagagggccatgagccatagaaatgtgagcagcttctagaatctggaaaagtcaggaagacaacattctcccctggagtctccagaaagaaatgcagctcctccaacactttcattgcagcctggtgatacctactttggtctgataacttgcagaatgtaagataatacatttttgtttaacgcattaagtttgtggtagtttatcagcaggagtaggaaactaatgcaaccactaagagaaaatttttcttagtgtaggaaaattagaatagaggttattctcaggaattgcaacctgagctcttaatctttctgacattttatacataagaatagaactttaaacctagctaatgtgtattttaagaatgaataattgatgcaccattattagcacatatctatattttctcctatttgagaacagattttcaaaaagcaatatgatgattcacatggcacactatgtgtggatttattgactatccctgtagaacagcactctaatacatcactaaaacacagaaaacttataatacaagcaaacattatagcagtatgagagaaatggctttctgtcacacttagcctagtctcagattagataaaagaggaaaacaataattattccaaattcaaattgtgccaggatgtatctgtagcatatgtccttgaaaacagcaaagggtatataatttgatattaggaaacaggacaagctctggaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattcattagcaaggtagagaggacactaaccaatcggtagttttaatcaatctgtattccctcccccctccctctttgttttttgtttgtttgtttgtttttgagacagagttttgctccgtcgcccaggctggagtgatgtggcgcgatcttggctcactacaacctccgacccccgggttcaagcgactctccgcctcagacccccgagtagctgggattacaggcgccagccaccatgcccagttaatttttgtgttttcattagaggcggggtttcaccacgttggccaggctggtctcaaacgcctgacctcgggtgatccgctcaccttggcctctcaaagtgttgggattataggcgtgagccaccagtcccggcccctcccacccctctgtattatgaccatgtgtacccagcatttagctcccacttatgaaagagaacatgcggtattttgttttttgcttttgcattagttttctggaaagaatgcattcatgttgcttcaaatggcataattttgagttttttctggctgtatagtattccatgagtctttatccaatccaccactgatggatgtctggattaagcctatgtctttgtgattgtgaatactgctgtgataaaaatatagctacatgtgtctttttgatagggtatttattttctttcgggtatatacccagtaatggggttactggattgaatggtagatcaactctcagttctttaagaaatccccaacctgctttccacagtggctgaactaatttacattccttcagaaagtgtataagtgttctctattctctaaatcttcaccgatatgtgtttttcttttgacttttcaaaaaaagccattctgaccggtgtgaaatggtatttcatttcagttttgatttgcatttctctaataaataatgacgatgagcacttttacatatgtttgttgggtgcttgtgtgtatgtcttcttttgaaaagtgtccgttcatgtcctgttgcccactttttaatggagttacttgctgcttgcttgttgatttgtttaagttccttataggttctgcataatagacctctgttagatgcgtagtttgtgaatattttctttcattctgtgggttatctctttactaccttgatagtttctcttgttgtgcaaaagtttttcagtttaattaaatcccacttgtcattttttgttttagttgcaattgcttttgaggacttagccataaattatttgccaaggccgttatcaagaaaagtatttcctaggtttttttctaggcgttttatagcttgagattttttcatttaactctttaatccatcttaagctaatttttgtatttggtgaaatatgggggtctagttttattcttctgcatatgactagccagttatccccgcattatttattaaataaagtctttttcccattgcttacttttgtcaactttgttaaagatgtgatggttgcaggcatgtggccttagtttctagtactctagtctgttccattggtctatgtgtctgtttttctaccagtaccatgttgttttgattactatagtcttctagtatagtttgaagtcatgtaatatgatgtctctagcctatgtctctagccttagtattgctttggcctggctagcctacgtctctagccttagtattgctttggcttggctattctgactccttttaggttccatataaattttagatgttttctattttgtgcaaaatgacattagtaatttgataggaaaagcattgaatctgtaaatcgctttgagcagtatactcatctgcacgcagatgatactccagtgtatgttctgtggttgatgaatgaagtgtattgtaattccaaatggtcaagccagaccctgcccccgcccggctcctcctctgccagagctggatacctctagccaaggggcctctagagccactggggatggggctgagggccgcttcccgcccccgtgcagctgctgcagggcagaccgcctggcttggccgcagccacagggacatctggccctgcttccgagatgtggggagtgcgggcaggctcaggagttgcctggaggctgctgcctgcacacagaaggcggctgcagcttgggagcccaggctggctggaggggcatggcctggtcggcctcgggatcgccagcgcgcccagcctgagggcccccaggccgtgcctcccacccactcctccacctgagagagatcggggccgctgtcatgggcactcggcagtcaccccgtgtggggttgagcggcgggttttcagttctcgcccctgtgcagccgccaccgccgggcagaatgcctggcttggccacagccacagggacacctggccctggttctgcgagactgggagcgcaagcaggctcaggggttgccaggcagctgctgcctgcacacagagggcgactgcagcttgtgcacccaggcggcggagcatggtctgggtggcctctggaatgcgtgcgcaccaggcctgagggcctccctggtggtgccacctgcccaagtcttcctctgctggagcctggagcagctggaatggccactctgcagtcacaggggatagagttaagttttcttatcccacacatgcacacaaaaaggtaactattctgtgaggtaattaacatgttcattgacttcgttttggtaatcatttcagaatgtgcatataaacgcatcacgtacaatttttatttctctattacacctcagtaaagctgaaataattaacaggattgaaaggataaacccacagttctatagtcacagttggacccttcaatacctcattttaattaatggatagaaaaaccagaccgaagcttcatgagaaatacaagagttaaacaacggtataagccactgagagctaatacgcatatacaggacagtccatccaacaacagcagaatatacattcctttcaagtgtatatggaagttctctaggatgggccatatcttcatccacaaaatatgtcctaatcatttttaaaagtttgaaatcatacaaaatataatttacaaccacaatggaagaaacaacagataaataagtgaaaactggaaaattcacgaaaatgtggaaattaaacaatacagtcttcaactaccagtgagtgaaaaaaataaatcacaagcaaaattataaaatatcttgagataaattaaaataaaaacaaaacataccaaaacttattgaatgcagtgaaagtagagttcaaaggaaaatttatggatataaataactacatttaagaaaaatctgaaatcaacatcctcactctatacctaaaggcagtggaagaagacaaaataagactaaatccaaagctagcagtatgaaagaaataatagagagcataattagagcataaatcaataaaatagaagtttggagagcagtagaatgaataaacatagattatttgaaagatcaagcctttcactatattgactgagcaaaagatggaagactaattattaaaataataaatgaaagcagagccattactaccaactttacagaaatacaaaaggattacaggagtatactgtgaacaactgtctaacaacaaattagctgtcctggatgaaatggacgaatcactagaaagacacaaactaccaaagtggctcaagaagaaagagaaaatctgaatagacctataacctagcagattgaattagtaatcgaaagtgattaacaaagaaacatttatgaccaaatagctgcattaactggtgagtcaacctaacatttaaagaagaattaataccatttcttctcaaactcttctgacataatatatgaagaaggaatacttgctaattcattttttgataacagcattatccttataccaaagccaaagagagcacaaaaagagaactacagcacaatatcccttatgaatatataagcaaaaatctcagcaaaatactagcagcaatactgtataatcaaaggattgtaaactatcaccctgtgagatttatccccaaaatgcaagggtggctcaacatataaaaaatcaatcagtgtaatatactctaacagtaaaatgaataagcacgtgattatttcaattgatgcagagaaaacattgatgaaatacaacacccttctataataaaaatactcaataaactaggcatagaagggattttctgcaacgtgacaataggatgtacaaaaacccaacagttaatatcatgatcaatgatgaaacactgaaagctgttttcctaacatctagaacaagacaagcatggtgcatttgccacttgtgttcaatgtaccactggcaattttagccagagcaattaggcaagacaaagaaataaaaggcatctacattagaaataaaaaacagaagtaaaattatatctacacatgatcttatgtgtataaagctccaaataaaacacaaaaccgattataactaataaaagaggcaggatgcaaaacaaacataggcaaatgagctatatttctatatagttgtaaagaactatgaaaacattttaaaaattccatttataatagcatcaaagaataagttattcaggcataaatctaaccatggtggtatacacaaaactttgctgaaaaaaacgaaagagagtggaaataactggaaagacattctgtgttcacgggttgtaagacaatactgttaagatgacaataccatctaaagtaatctacagattcaatgcaataccatcaaaatcccaaaggcatttctgcagaaagaaagaaactcattctacaattcatacaaaaattcaaaggatctgacagacaaaacagtcttgaaaaagaatattagaaaactcacatttttcagtttcacagcctactacaaatctacagtaatcaagagagtgtggtactggcataagactaatagacttttagaccaatacaacagaacagatttaagatcctacaaattagcgctcacatatatggtcaatgactgttcaacaagctgtccaagtctagtcaagggaggaaagaacagtctcttcaacagctggatgtcagtgcacaagagagaagttagacccctaccttgcagtatacacgaaaattaattctaaattaataaaagacttacatgtaaggactaaagtatgtaactcttagaagaaaacacaaggtaaacctttatgacctttgagttttaagtgtattttgaaatatgacagaaaagcacagataacaaaagaaaatacacgtaaattagatttaatcaaaataaaaaacctttatgcatcaaaggatactatcaagggagtgaaaagacaacccatagtatgtgagaaaatatgtatctgataaaatcaaagtgcgtatctgataaaagcttaatatcccacaactcaacatcagaatttctaacatcccaattaaaaaataggcaaaggacttgaatagacatttctccgaagaagatacacaaatgtgtaagacggataagaaaagatgctaaacactgttattcattaataaaatgcaagacaaaacccaaatgagataccactttgcatccactagtaaggctttcataacaacgacacagaaaatcaatgttgctaaggaggtggagaaattggagccctcatgaactggctgctaggaatagaaaatgatgcacttgccgtggaaaacaatttggtggttcctcacagaatcacacagagaaacaagagctgctggcttccgggttctcctgggctggcgcggtacgtcccggaatcgcaggcgcgcatcccttcccgcctgagggcctgcctggccgtgactcccgcccctcttctcctccgaagagacgtcggggccgctccaggggccgtccgcagccaccggggatggggctgagggtcggttcctgccccggtgcagccgccgccgagcagaccgcctggcttggccgcagccacggcgacatccatgcccgggtctgcgaggctgggcgcgccagccagcttgggagttgcctggcgcctgtagctgggcgcccaggtggtgagcatggcctgggcggcctctggatcgcaagtgcccctggcctgagagccccccagaccctgcccccgcccggctcctcctatgccagagctcgacacctctagccaagggccctctgcagccacgggggatagggctgagggccggttcccgcccccgtgcagctgctgcagggcagaccgcctggcttggccgcagccacagggacatctggccctcgttccgagatgtgggaagtgagggcggactcgggagttgcctggaggttgctgcctgcacacagaaggcggctgcagcttgggtgcccaggcgggctggaggtgcatggcctggtcggcctcgggatcgccagcgcgcccagcctgagggcccccaggctgtgcctcccgcccagtcctccacctgagggagatcggggccgttggtatgggccctcagcagtcaccccgtgtggggttgagcggcggcttctcagttctcgctcctgtgcagccgccaccgccgccggtcagaatgcctggcttggccgcagccactgggacacctggccctggttctgcgatgctgacagcgcgagcgagctcgggggttgccaggcagctgctgcctgcacacagagggcgactgcagcttgggcgcccagtcggcggagcatggtctgggtggccgctggaatgcgtgcgctcgaggcctgagggacccactcttggtgccatctgccctgctctgcgccccctctgcgcctgcgccccctccgcgcctgcgccggggctctgcgcctctctgcctttgcgaagggcgctctgcctttgctagggcggagctgccttctcctcagcacagaccgggagagcatcgcgagggcggagctgagttctcctctgcacagacttcggagatacagcgaaggcggagcagtgttcgcctcagcacagacccgggcgggcgggccgggggtaccgcgagggcggagctgcgttctgctcagcacacacccgggagacaccgcgaaggcagagcagcgttctcctcagcacagaccttgggggcactgcctcgctttgggacaactcggggccgcatcaacggtgaataaaatccttcctgtttgcagccctgaataatcagggtcagagaccagttagaagggttcagtgtggaaaacgggaaaccaaaagcccctctgaatcctgcccaccgaggttctccccagccaaggcgaggcggccgcagtgcgagatccacaccgcagcctcggaagacaaatgcggcattcctaatgcagacatgacacccaaaatatgacacccccattgctcatgtaacaagcacctgtaatgctaatgcgctgcctcaatacaaaaatattaatataagatccgcaatcccctcgctgccgtgcagtccaaagacagccatcataataatcaacattgacatagtcaatacaaacttagtaatgaacctagggttaaggttggtgttagggttaggggttaggggttaagtttagggttagaggttggagatagggattggggtcagagttaggggttaggagtcaacgtttagagttagggtttaagagatgttaggggttagggattaggggttagggttgggttagggtgagggttggggttagggatagtggttagggtttgtgtcaggggttaggggtcagggtcagtggttaggggtcagggtcaggggtcagggtcaggggtcccactctgcgatttgtctatttactctgctgactgttccctttgccatgcaaaagctctttagtttaattaagtcccagctatttatctttgtttttattgcatttgcatttgggttcttggtcatgaaatccttgcctatgccaatgtctagaagggtttatccagtgttatcttctagaatttttacagttcaggaattaggtttaagttcttaatccatcttgagtagatttttgtataaggtgagagatgagaatccagttttattcccctacatgtggctcgccaattatcccaacttcatgtgttgaaaagggtgtcctttccccactttatgtttttgtttgctttgtcaaagatcagttggctgtaagtatttgggttaatttctgagttctctcttctgttccattggtctatgtgcctatttttaaaccagtaccatgctgttctggtaactatggccttattgtacagtttgaaatcaagtagtgtgatgcctccaggcttgttctttttgcttagccttggtttggctacatggcattcttttggttccatattaattttagaattgtttttgtaattctgtgagggatgatggtggtattcagatggggattgcattgaattcgtagattgcctttaacagaatggtaattttcacaatattggttctacccatccatgagcatggggatgtgtttccatttgtttgtgtcatctatgatttcttttctttcttgtttttttttttttttttttcagaggtagtttcgctcttgtcgctgaggtgggagtgcaatggtgtgatctcggctcactacaacttctgcctcccgggttcaagcgattctcctgcctcagtttcccgagtagctgggattataggcatgcgccaacgtgcttggctccatctatgatttctttcagcagtgttttgtaattttcattgtagaggtcttttgattactttgctaggtatattcctaagttttgtttgtttgttttttgcagctattgtaaaaggggttgagttcttgatgtgattctcagcttggtagctgttgatgtatagaagagctactgatttgtgtacattaatctcgtatctggaaactttgctgaattcttttatcagttctaggagctttctagaggagtccgtagggttttcaaggcgaaagatcatatcgtcagcaaccagtaacagtctgacttcctcttcaccgatttcgatttcctctatttccttcttttgtctgattgctctggctaggacctccagtactatgttgaaaaggagtggtgagagtaggctcttcgtcttgttccagttctcaaagggaatgctttcaccttttccccattcagtattatgttggctgtgggtctgtcatagatggcttttattacattaaggtatgtcccttgtatgcctattttgctgagagctttaatcataaagcaatgctagattttttcaaatgctttttctgcatctgttgataaaatcatgtgagtttttttttaaattctgtttatttggtgtatcacatttattgacttgcatatgttaaaccattcctgtgtcactggtatgaaacccacttgatcatggtggattatctttttgatatgttgttggattcagttagatagtattttgttaaggattttggcatctgtgttcatcatggatattggtctgtagttttcttttttggttatgtcctttcatggttttggtattagggtgatgctggcttcatagaaagaagggagtgtttcttctttctctgtcttgtggaatagtgtgaaaggattagtatcatttcttctttgaatgaaagaaaatattctttgaatgtctggtagaattctgctgtgaatctgtctggtcctcggctttttttgttggtaattttaaaattaccatttcaatcttgctgcttgttttattggtctgcttggggtatctacttcttcctgatttaagctaggagggttgtatttttccaggaatttatgcaactcttctgggttttctagtttttgtgccaaaaggtgttcatagtacccttgaataatctttaatatttcagtggtgtcagttgtaatatcccctgtttcatttcttagtgaggttatttggatttcctctcttcttttcttggttaatcttataatggtctatcgattttgtttatcttttcaaataaccaactttttgttttattcatgttttgtatttgttgttgttgttgttgctgtgtcaatttcctttagttctgctctgatcttggttatttcctttgtttgctgggattgggtttggcttgttcctgcttctccagttctctgagatgtgaacttagattgtctgtttgtgctctttcatactttttgacataggtgtttagggctacaaactttcctcttagcactgcctttgctgtatcccagaggtcttgattggttgtgtcatccagttcaaagaaattttttccatttccatcttgattttgtttttcacccagtgctcattcaggagcaggttatttaatttccatgtatttgcatggttttgaagattccttttggagttgattttcagttttattccactgtgatctgagacagtgcatggtacaatttcaattttcttaaatttattgagactcatttcatggcctatcatatggtctatcttggagaaaattccatgtgctgttgcatggaatgtgtattctgtggttgttggatgaaatgttcttatatatctgttaagtccatttgttccaaagtatagtttaaatccagtgtttctttgttgactttctgtcttgatgacctgtctagtgctgtcagtggagtaatgaagtcccccactattattgtgttgctgtctatcttatttcttatgtttactagtgattgttttataaatttgggagctccagtgttaggttcatgtatgtttaggattgtcatgtttttctgttgaatgagacctttaccattatatactgtctgtctttgtctcttttagctactgttgctttaaagtttgttttgtctcatatgagaatagctaccgctggtggcttttggtgtccatttgcatgaaatgcctttttctaccactttccttaagtttatgtaggtcgttatgtgttaggtgagtctcctgaaggcagcagatagttagttggtgagttattatccattctgtggttctgtatcttgtaagtggagcattgaagccatttacaaccaacattagtattaaaaagtgaggtaccattgctttcatcatgctctctgttgcctctgtactttgtttttgttttttgtttttgctttttaacttgtatttttgttttataggtcttgtgtgatttatgctttaatgaagttctgttttgatgtgtttccagggtttgtttcatgatttagagctccttttagcagttcttacagtgctggtttggtaatggcaaattctgtcagcatttgtttgtctgaaaatgactgtatctttctttcatatatgatgtttagttttgctggatacagaattcttggctgataattgttttgtttgaggaggctgaagaaagggccccaatcccatctagcttttaaggtttctgctgcaaaatctgctgttagtttgataggttttcctttataggttacctagtgcttctgtctcacagctcttaagattctttcttttgtcttaactttgggtaacccaatgacaatgtgcctaggctaagatctttttgtgatgaatttcccaggtgttatttgtgcttcttgtatttggatgtctaggtctctcacaaggccacggaagttttccttgattattcccccaaatatgttttcctagcctttagaattcacttctccctcaggtacaccaattagtcttaggtttcattgtcttaggccccaccactggggccgctacacgtgacatgggatgtgggccatcgggcaaagggcgcggagatggggcgctgccaagggagccaaggaggaaagagagcaatttccaaattgtcttccagggtttcaatgtgcattttattaactcagaatctgtcgggaataatactagggagctacctttccctggagatgggtcttgtcagtggagtgagataggctggggggaggaagaggaatgggaggctcagtttataaatattaagatcagcaagggtgtgctgctggcaggagcagagggagcctggagatttgggtggctgccgttggtaagtggttgcaatccagagagtgggattgagttcctcccttgtcatgttagcatcccgtttcctgggcgtgggtctaatgccctgcaggtggtcatttcactcatggtggctttgtctctcttctgccatctccagactcagcttcgcactccagggctgcgtaccaccagccactgtcatgttaaccccttcccaggccaatgtgtccttggcctggagcccaatctgctggacagcttgggaccgtccattttcggggtggtgggcaacctggtggccatcgtggtgctgtgcaagtcgcgcaaggagcagaaggagaccaccttctacacagttatgcggctggctgccaccgacctgttgttcactttgctggtgagccaggtgaccatcgccatgtacatgaagggcgggtaacctgggggccagctgctgtgtgagtacagcatcttcagcctgttcttcttcagtcagtccggcctcagcatcgtctgtgccatgatatctatacaggtaatttgtgttagacattcttagaagagtttcaaaagttttatgtttttatctgggttataaacagagtcctcaaatgcatacaaaggaaatcatgccatgattgaatttcagcaggaataagtttattttacctattcaaaattaaaatacttttgttgtgtttgaaaatctgttttaaagatatgtttttgaaaaaagtttaagtaaatatttaatcatgtccccttttctatcccaagaaataatttcatatatagtttatttaaattttttaacaaaaatgtagcataatttttttaaattgtatattttatttaacccaatatatatccaaaatattgggtcaatatataatcaatataaaaattattagagatagtttgcattcttttttcatatgaaatctttgaaatccattgtgtattttacattttaggatgtctcaactcaaatgtgaaattttcatggagaatatttgaactgtatttagattaatacaaattgcagttaaaaagtttaatatagatttaccagggggcgtgcagccctcttgccaatcagatcgttgctgagcggtcccgcagccaacccccgaagagcagcctgctggcttccccagcgcccaggagttggggatgtcctacaaacctaccacccctgcccccagcagcacccccggcttcagcacccctgggccaggcactccggtccctacaggaagcgtcccgtcgccgtcgggctcagggccgggagccactgccccttgcagaccgctgtttaaagactttggaccgcctaccgtcggttgtatgcaggccatgaaaccacctggtgcccagggctcccagagcacctacacggaactgctgttggtcacaggggagatgggcaaagggatccggcccacctatgctggcagcaagagcgccgcggagcgcctgaagagaggtatcatccatccctagtcagagtgcctggtagagacagagcggaacgcccacacttaacaggaagctcctaggcctctgtgtctggacttcagagcacctgcttctccctggccttcatccctagttgcactaaccatcctgggcttcctgtcctgtgtcccttgatgggtgccctccaggaaccaaggggcggttctcactgcaggtggcagcactaaggacccccctccccaccccaccccgccaacgcaacaagagttagcagcgaggtccccgtgagtcccacccatgacctgcagacagtgttgcccactggaactttctgtggcccccaccactcagcccttcccagcacttgtccagagcctctttctccctcagcacagctcagacctcaggcctgacacttccttgccttgtgtcttttgctaaatatgacctttctatattaataaaagatgctttggagttgtgctctctaaaaaaaagtttaatataaaggagaaataaaaggaaatttagcaaagaaatatgtagatgaatatttaaatactcagaggtgacattactaccagacataatgagattatcagatgtttcatttacttatgattaatatgtttgtatttattttttattcattttattttatttatgtatttatttatttttattatactttaagttctagggtacatgtgcacaacgtgcaggtttgttacatctgtatacatgtgctgtgttggtttgctgcacccattaacttgttatttacattaggtatttctcctaatgctctccctcccccagccccccaccccatgacaggccccagtgtgtgatgttcccctgcctgtgtccaagtattctcattgtttaatttccacctatgagtgagaatatgcagtgtttggttttctgaccttgcgatagtttaaacaaactaggaagttcagaagtcactttacaagagaaataaagaaaaataaagtattaatgacattggtaacaataaaaattagagttagacaaagtattaacaagcaagcttatatatttataagagatgggaaaatattagaaaggaataaatcatgtcttgtcaacatgaagaaaaagtgtatttttttgttaacttattattgtgtttccttgtataattttcacttggttttgttggttttactacttgcttcattctttcaaaaactgcatcttcatagaccatttcagcttttgctatgtgggcagaattataaaacccaatttcaaaatttcagctgaacgttgtcagcatttttctttgggctttttatcggaaaaaaaacctaagtaattgtgtgtgtgtgtattttagtattaccatgaatgtaataacaataaaatcaaacaaaaacaaatggatatgcaatatgttggactagcatctcaaatatgaaaaaggcattgccaacagtgatataattttttttcataatggtaagctttttaaagtataatcttattttaacctaaaatcttactatcagaaaatgcagtgtacattaaaatgttctgaaatgctttattcacatttattaaatggttgtactcactcagatatctacaaattggtttttcacttatgtaattatcttatagaatgttcaaaagtcatgcagaatgtgagataactttctattgaatatgattgttttatcattgcaagacatcaaacatccctgtttcctgccaaatgaatgtacaatagcaataaatgtaaagatgtgttttttggaaaagacacatttttgagttataaaacaaggattttaaaacttgaattgttacagtgagcatgtcttaatataggctacagtcactttagataaaaaattacctcacatctattttcaatattacttaaagatgttcatttagtggcaaatattttttttttgcctggaggcagatattttgccacatggctatttatgaaactgtatttaaatgcatgtacacatataaaagctgccactgtggctgtaaactattacaagttatcaagattaaaaaataaacaaaaaatatttcagtttttctatgaaatgtctttactcgagtccaaatttagaggtttaaaatgcttcaaattaataaaaccaagtgtttcacatatttcagttggaatggcgtttgtcctagttttattagtgaagcagcagactgcattttttcactcatacaccttcaaaagatggacagaaaaatttgataaaacttctagggcattatctgatgaaacacattaaacactaaaggagatatacaacttcattgcttgtaaaagacatataagaaggaaacctacatacatatatctatcagttttgtattttcaggaaatatttgccttaaagtgagcttcataacagtatgtattctccaacaaagccaaggaaagtaagtttgacacaaggatctggaagtctacctgtgtggcataattacattgaatacattccacaaataaggcagaaatgtatagtagagtgtccattatagaggaacactcaataaatatttaataaagtgcttaaaatttctcattattgacctgaacaatgagtatacttattacgtttgccagtgacagatattaaaagtggagattgaaggaaaaatgatgtatagaagagagattttaccttcaaagtgacataaataatttgaagaaattgagggaagtgacttgcttaaatatccatacagtaaatatttattgtgtgcttactgtgtgcactgggaattaagcagtgaaaaaaatacaaaggaaaacatcaacaacgtctcttctatcatggagcttacattctaccagtaagagaaagaccatcaacaaatacatatgtagtataacatgactatgaatggtatggagaaaaataagaacagtaagggggatgtgggggcctggggatttattttatataaggatagacaacaaaggcctcattactaagtaattttatgcaatccttttttcaatttatttatttgttgattccataatacttatttatgtatttatgtatttttaatttattttttatttttagaatcagggtctcactctgtcacccaggctgaagtgcaggggtgtgatcatagttcactgtaaccttactcctgggctcaattgatcctcccatctcagcctcccaagtatcttggtctacaggcacctaccaccatgcttggctaattaaaaaaaaaaaattagagatggggttgtgctatgttgcccaggcaggtgtcaaaatcttggcctcaagcaatgctcctgctttggcctgtctaagcattgggattataggcatgggccaccgtgcctggccctgtaatatgcatttagcatatacactgtgataagcacaagaaagtctctgatagttcagtaaaaaactgcagtgatgtttgcaacaggtaattaagtttggccacgattcttttgagtgtcataacactgtcctaagaaaaagtctatatttccactttactgggtgtgtgaaactcaaactcaaggttaaaaagctctgatttttggttgaaatcataatccaactaaaaaccagaaatgtggagccattttttttattttaagtgaatcataagcagtcttgtatttaagacagataaaattattgtacagtattatgttttctgtacttaaaatgagagaaaaccatgagggttgttaatgtttgaaaaaagaaggcatctatgaggaagctttatattggtagaaagtgtgaaagaaaaataaaatctcaggaccccaaactcactatgacaaaggaaaattaagcttggaacctgagtcatgcaaaaactgccatccttttgttcccaaacagctgtaatttcatatgcttactttaacttatgtaaaatgtagatttcctgagagagaggatgaatgcacaactgactccttcctcctgtttttgccacatgtaacatatagattcactgagcgctaatcagagcctcacaagaatgtagccattagctttcttgccttccctctctccttcttttcctcccctgttttaatttcctgcctgcttcctctttctcctttaaatattgaagttcccaaaaccctctttagaaaaagcacaggacatcacctacttgtgacttgtgatcctttttcccaggtgtatcctccaccttgcaaagcaaaatctctaaatcacttgagatctgcctcattcacttattggtttacaaaaggaagttggaaaaaaccactcatcttgcaatgcacaaatgacttttatagtaactttattgcctatgcaatcaatcacatatttgatataattatagtatcagatgataaatatagatgtaaaaaatctatctgtaaaagtgacttttcttatttcccctctctccttttctcccctactgtgctttgaattctttattttcatattcactttgctggcttcggatcatttccaaacctactctaatggtagcatgatagcatccagtgagtttgttgttgttgctgttgtgataggaccatagactttcacatctagttgtgatatcacatgctcacattgtctaactacttcattttacagttgaagaaattgagacacaaggtaaggtgacctgcccagttccaatctagttatataataaaagaatggctaatatttaataaataatatgagtcaggcactgggaaaataaggcactttttttttttttgagacggagtctccttctgtcgcacaggctggagtacagtggcgcgatctcgactcactgcaagctccgcctcccgtgttcatgccattctcctgcctcagcctccccagtagctgggactacaggcgcccaccaccacgcccggctaattttttgcatttttagtagagatgggttttcaccttgttagccaggatgctctcgatcacctgacttcgtgatccttccgcctcggcctcccaaagtgctgggattataggcgtgagccatcgcgcccagctaattttttgcatttttaatagagatggggtttcgccgtgttagccaggatggtctcaatctcctgaactcatgatccgcctgcctcggcctcccaaactactgggattataggcttgagccaccgcgcccggcagtaaggcactatttttatctctatttaaaaatgtagaaactgagccaaagagaggatatggtatttgcctgggatcataggattagtaaatgtctgagttggtatttaaaggcaggcttccagatttcatagcccatccacaatcgcatgccactgaagtcttctggctccgacttctctgcaatttacacagccctacactgccttcctcctaaactctccaacctcctatttttttcagctctaaactttgattccctaaacacagcagtcagggactggtggaagattgttgtgaaaagaacaggcaagcagcattacggtttagcctgtttttatatctattttattctacagattagtgtacttttctcaattatgcatacttttccattctgccaaaaatttattttaaggctgttaaagctgtagtcaattttctcactttgatcttccaaaggaacctgctgtatctttttcattctgtgcaaaataggcattttaggatccactcaatgctaaagtcactgagtagctacagacttgctatttgtttctccattgttatattttcatagttttagaatctgagcagcatttaatttgtctatgctttatattttcctttagagaaagaacacagtgatacttgctcatagtgttagaggaataatcccaaagagagaaattattcttcgaatatccaccatgactgaatacttagtaatactgaaacctacttataaaacaaaacagaaaacctccaaaaaaccaaataaacaacaaaaaaaacttaaaaccaaaaaagtactggaagtctcagaagtatttagcagttattcttgctccttcaaatgaaaagatgctttatcgtatcctctatggagagaattctgacagtatttatcaaagaccttacatttattcaccttttgccctaaaaatttcataacttaaaaatacatacaacaatttataatatagcattttttgtaaagggaaataatcagaaagagcctaagtgttcaacaatagggcacttgttgaattatgatacaatcacaaaataaggtcttcatagagcccattaaaatgatgttattgatatttatttattaataggagaaatcatttagaatttttggttaagacctttaactaagcacaaagtctatgaaataatgtgcacaacattccatattttcataaggggaatgacttttaaaactaccctgcaatcatctcattttacacaaatgtctaagcaggtttgttacccgggtatattgtgccatgctgaggtttcgggtatgactgatctcatcatacagatacgaagcttagtaccctgtagtttttcaaccctggctgccctccctactgcctctactagtctccattgtctattatagtcatcttttctttttttaaaaaaaatctgtttttctgattttttattaggtaaaaaatggaaaaacaaaatataattttcattcaatacatatttcatctttatgcgttattttttgagaaagtgaagtccatttagaatgatagcagttcatcaaccaaataattcatcttcacacagtttcaattacttcagaaattttcttcatctctctctctgtagaaattctcaaactgtggaatggtcatctttatcgtcataaatactgtcatctttatgtccaagagtatccaacatttagctaccaaactactacccaaatctgattaattgatcatgttgattctgtcacattctacttgtcatatcagatttttattaaagaaatcattagcttatctattattgttactggggctgtaagaaaattttataagtcatttggatcaatcctcttctttatggtcttatttgagaataaaacttggttctgtcttagcctgtcattgaataagccagtgacctggggcaaatctaactgcttcatctgtaaactatgaataataatagagtccctctgcctgtcacacatgggtatagtaaggttccattttaaaaatggctcttattatgttacctgaaaggcattctataatgatgagtggcaaggtggtcttagcaacagtgtagtgaaaattgggaccattttctgtcgctatcatttctatttttgtgataccctctttaaattagtcttaggatgtaattcaaaggagtgatgtaattggaattttcttcttttttttttttttttttttttgagacagagtttccctctgtcgcccaggttggagtgcagtggcgcaatctgggcgcaccgcaagctccgcctcctgggttcacgccattctcctgcctcagccttgtgagtagctgagactacaggcgcccgccaccgcacctggctaattttttgtatgtttggttgagacggggtttcaccatgttacccaggatggcctcgatctcctgacctcatgatccgcccagctcggcctcccaaagtgctgggattacaggcgtgaaccacggcgcccggcccataattggaaatgtttgtactgttagatctaagagtattttatgtgatataataaaagattaatttagtgaacctcattagataattagcctggaatacattatgcactgccatgcaggggcctaagagaatggtccacacgtcttgcgaagttgatatgaagacaggcaacaagacagtctagctgagtaaaagtctgtagacatctctaaggaggagtggttagagaatgccctgacggtggatagctggcatattttaccccagaaagaagagcacagagtggcagagagtacttgagatttaaataagaaaagaggatgaaaaaattactttcactaattataaattttctcaagaatggacttattctctattttctattgcctcttgagaaatcattattttgcattcagtcaacataattattaagactaattgtggagggtgttcaaaatggaaaaacagcggtccctaggattatattgtatttatgaatgatcactcatttgtaacttttccttcagttagatgttttttaatgcaaaaataccttttaagcaccagtacaatttgtgaaacgaaatgtgaaattcaggcatatatgtaattttatgtgtaaaatattccatttttttctgttaatgaagtaagtatgtttaacatgagatatatcctcttaataaatttttaactgtgcaatacaatcttgttaactataggtgctctgttgacagcagatctctagaacttattcatctgttataactgaattttatacccattgaacagcaaccccaatttcccctccttccagaccctggcaaccagtattctactctatttctaggagtttaactattttagatatcttacgtaagtggaatcaggcagtattaaaacatactttcaattagtaatgactataattcggataatttaaataagagaaagcaaacatcactactactagcttttgggggaaaatattacaaatagggatattgtgataaaagtgtacaatattttttatgtttgtgcacttagatctgtgttcaaactttgccacctatacatgtatagcacatttgaatatgtgctacagtatgccatttataaagactgaaaataacattttataaaatattattatttatttggcaacctcatgagctttggcttcaaaaatacctgatttacaaagcataatcctagtgctggagaacagatcagtggctgccaaaggttagggttggttggaagatgtgattagtgaggggtaacatgaaaacatgtactttctttgtggtgatagagcagttctgcatccagattatggtgatggttacataaatccgcacttcatagatctatacacacacatcacacatacactcacacacacctacacaagagtacatgtaaaatccttagaaatatgaatagggtctgaacctaagttaatggtatggaaacaatgtcaatttcctgattttggcaacatactgggttaagttagatataattattggggaaagttggctgaaaataacacggtcattctttttactattttttaacttcttgtgagtcaaattatttaaaaataattggtattaaacacagacaaaaaatctaaaatttctaaaatcaaagcctttatgaatttgagcatattatttgatttcttttgtagaccttgatttcttcacctgtaaaaatggaatgatagtagaatttctatctcattattgtcatgcttaaaccataccatttatgtaagtgcccagtaccatgtctggtgaacaataatgcttaaacactgagttccccacttttttgtggctgttggtttacaggtggtttttaagttcctaagtggaagtttgtttaaaaagaggcagtcaaaataaacagcaatgtctcagagcatcatctgaacaagaaaggaaggtgttctccatcccttgaagtggtctcagtcctcttttattgtttagctctcatgtaagtcttcacaaataacctcaagaattgctacaacaccaacagagaattaactctcattgagtttttagctcagtagattctgggtcctaaaatttatggactcacctgctttttaaatttttcccatttagaaatattcaatttaaatcttccttcagtaagtaattgttaactattaacaatcctaacattataataaagtcagaagtaacatttattacttttgttttccactcatactgtttgcagtccataagcatacagcattttggtctttccaaatatctaaaggaagataatcaaaatcaaaactaagaaatcctactctgaagtcatatctctctaactagattgtatatttattgagggtgatgactatattttcttttccagaagaataaaacaaatacaaggttgggacgaattgaattcagtgggggatggagaggggaaggagtcaaggttcttcatccttttccatgctttgataactttatctatgagatcctagttaaaagaacatgactatctaaagaagtaagtgcttgaaaggcccactgtattaggagattgggaattgttagcttgaaaagacataaatggaaagaaaacataatacagagacaaaatacatgaaatttgtattgtggtacacatgtgctttgtgatcatatttctgtgtcataaacaaaaaaaaaagtagaaagcttaaccaagagaaatttagggcacatagaagcatttacgtgttttcatactatgagcttgggctaaggtgtcctttaccatgacagctagtgaagcataagaacaaatcaattcacaaatgttctggtaaattccaatttccacatcttaaatcatagacctaagtcagtcaaagtcagtcatatatatagatatgtgtgtgtgtgtatgtatatatatatatatatatatatatatatatatatatatatatatacaggcacctacttaagtggtatgatttaagcatagcaataatgagataggaatcatactattattccatttttacaggtgaagaaatcaaggtctacaaaagaaatcaaataatatgtccaaattcatatgggctttgatttttgaactttcaaatttttgtctttgcttaataccttttgttttaaaataatttgactcataagaagttaaaaaaagaagtaaaatgaatgaccatgctattttcaggcaactttccccaatgattatatctaacttaacctagtacattgccaaaatcaggaaattgacattgtttccataccattaacttaggttcagaccctattcatatttctaaggattttacatgtacagatgtgtttgaatgtatgtgtgatgtgtgtgtatagatctatgaagtgtggatttatgtaaccattaccattatctggatgcagaactgctctatcaccacaaacaaagtacatgttttcacgttatccctcactaatcacatcttccagccgaccctaacccttggcagctactgttctgttctccagcactgggattatgctatgtaattcaggtatttttgaaaccaagcttatgaggttgctaaataaataataatgtttataaactattattttcagtctttataaatggcatactgtagcacatattccaatgtgctatacatgtataggtgagccaaagtttgaacatggatctaagcgcacaaacataaaaaatattgtatgcttttatcataatatctctatttgtaatctttttccccaaatactagtagtagtgatgtttgctttctcttatttaaactatcagaatctttaaactttctcttatttaaactatagtcattactaattgaaagtatgtttgaatactgcctgattccacttacacaagagagatatacatatcagtcatatatatgtgtgtgtatatatttatatatatgtcagtcatatatatgtgtgtgtatatatttatatatatgtcagtcatatatatgtgtgtatatatttctatatatcacatacacacatatatagatggagttaggtctatgatctctgtatatatttatatacacacatatgtatttttaaactattacatgaagcaaatagtacagttgatttcatataacaagagttattggatttatatgggcaaaagttaatgcatatgggcaaataaattgatgaacttacagactcatttatttgacatatatttattgtgtggtctctattgaatgctgggtatcttccaggagtctaaaattcagcagtgaatgtaacaggctcaaatccttgtactcaagtagctaatattctaatcgagggagaagacaataaacaaagttaataagcaaaatattcaacatactagttgataggaagctctgtggtgaaaaataaagtaagaggaaaagaatgagaggaagctctaaaagcaactgaagatttacatgaggaagctgcccaggcgttggcccagagtgagaggaagcgccatgagttcaacaggcaggtcccagttcagtggaaagaaaaggatttccagggcatgttggagtgccgcaaagagggcgaggccctcctcatcctcaacctggtgacagacttgaagccccagatgctgttggacacagtgccctgtctctccgcctacatcctctacatgtgcatccggctcgcggaccaaaccaacgatgatctcaaggtgcactccctgatgacctccaccaccaacggcattaagaaagtcctgaagaagcacagtgatgactttgagatgacgtcattcctgttatccaacacctgccaccttcttcactgtctgaagcagtacagcggggatgagggcttcatgactcagaatacagcaaagcacaacgaacactgccttaagaactttgacctcaccgaataccgtcaggtactgagcgacctttccattcagatctaccagcagctctttaaaattgccgagggtgtgttacagccgatgatagtttctgccatgttggaaaatgacagcattcagggtctatctggtgtgaagcccactggctcccagaagcactcctccagcatggcagatggggataactcataccgcctggaagctatcatccgccagatgaatgcctttcatacagtcatgtgtgaccagggcttggaccctgagatcatcctgcaggtattcaaacagctcttctacatgatcaacgcagtgactcttaatgacctagctcctgcggaaggacgtctgctcttggagcacaggcatgcaactcaggtacaatataagtcagcttgaggagtggctttggggaagaaaccttcaccagagtggagtagttcagaccatggaacctctgatccaagcagcccagctcctgcaattaaagaagaaaacccaggaggatgcagaggccatctgctccctgtgtgcctctctcagcacccagcagattgtccaaattttaaacctttagcctcccctgaatgaatttgaagaacaggtaacagtggcctttatacaaacgatccaggcacaactacaagagcagaatgaccctcagcaactgctgttagatgccaagcacatgtttcctgttttgtttccatttcatccatcttccctaaccatggagtcaatcccagcatgtctcaatctggagttcctcaatgaagtagatgcatgtttaatctgattcccaatgtgagcaaaaaggaagtatagacagtaaagtaaattcaaggatctgttaaatctggtaaaagtagttcaaatcagagattgacagcctgtggagggtgctgaactatacagaattaacacaactatggcgttattttttgtacgtactgctcagaataaaaacacttgaaatgtggaagattttaagtttgatttcagtccaacaaatatacataataatttatagacaccaagcagtccccatagccatataaaagatgccaattctataaaatgaagctgccgagttttaatctttgcatataactggagaatgtccaaattaaaatactaactatatataagtcacataaattgccttcaaagggcttttaacaaataatagtactaataaccatgataatgacatatactgacacttcccaaagtttgcaaaccataggtgtggtagagtttgtggtgagatgtgttaagaacaaaaatatggggatgagacttctgagaaatgtccccaaaatattctttaatggctgattatacaaagacagcagtgtaactgacctccaaaccagacattttgagtactggtttctgaagcaaaattagaagtgccagtcctcagtgtcctcaaacgcttttgtgtaatcttggtttaatggaagagatgattaaaatgctgctatctgaaactccaagtgagaaagatggaaaaataatttgtgtctgatgctagtccatacactttccaagtcccacaaaactctcacaaaaaaatgtatataagctaaatattacaaaatgataacaacttgttttatttatagatgtaaaaaacaaacaatgtgaaagcttttaatctcttaataccattaagcctccagtaagagcctcatataatgctctactattccaaacaactaaatagtaaaacaaactaactttgcacatcagattatctgaaaaaccttcaaaaatactcagttcagggattactattatacaaaagtctggggtttttttaagagaataaaatggcttaggtcaactttcccctttcaggttattttcaaagtttttcaaacgttgtaattcaaaattgtaaatatctctcctatgaaataaggattttaaaaatgaataattcagtaatataacagacgtagatgtttgctgctcttagaattttttgtttgtttgtttttgggctcttcaaaagcaagcattcagttagaaacccatattattctttccacactttttttattatacttaaagttctagggtacatgtgcacaatgtgcaggtttgttgcatatgtatacatgtgccatgttggtttgctgcacccactaactcgtcttttccattaggtatatctcctaatgctatccctcccccctccccccaccacacagcaggccctggtgtgtgatgttcgccttcctgtgtccaagtgttctcattgttcaattcccacctatgagtgagaacatgcggcgtttggttttttgtccttgcgatagtttgctgagaatgatggtttccagcttcatccacgtccctacaaaggacatgaactcatcattttttatggctgcatggtattccatattctttccacacatttttttttactgtcttttccctatttcttgatagcagtatgctgtttccatgataagaacaaatagtgtttgccaatcatagaagaacagcctctgtattacattgagaaaatgagatttatccatggattggaagtagaacagcctgcctccaccctcctttactcaaccacccaacttaaaaggctctaggaaacacagcacactccaagctaccttctgtactgtgcccttagaccacagcttcctcagtcattctctgcatctcctggggcttaacccagtcttagcctgtgttgaggctgctgacagttgtgttccaatcagttgccatggacattatcccttctacatccacattaaacatgccagcttctcttgggtgtctgcagagctgtgcctttttctttcagttacagttacataatcaatgacgtccacgacactcacacatggatccatgtgctgacttcatttagaaggccaatctaaaacaactgggtttgtggctacctctttaaagttgtttgtgaagtataatttgctttttgatgcactttagtttgaaactgagtcccttatgtaaggactgtccttaatcttaaaagaccaaaaatgccttgttagagtgttaaggagttttgacatgcagtggttccacaaatacagtggcttactgtccttatatactgtcttacaccatcattctctccatctctcttggtcactactgtctgctgtcactggttaatcactagatgccaagagcttactgaacaaaagcttggcaatcagaataaatggggaaggaaggaccttatgaattgtctacttagcctaagaaacggcaggtttagttcttctcttccaaaagatacaggtatatcactggaattgtacttaaaatttatagatgactagcaaatatatactttatatgtacttaacatttagatcaatcttatttaatacttggagattagaagaagcatctttaggggaactatataatattctgttagcattttctctgcatttttaaaaatcatttcatctcaaacacttatcagcgtcatgaaatcagtaatgactcttaaacaattcaacataaaggtttgaactctgcactagatgtctctttaactttttaatatttaaaatttagttcaggcttttcttaccaggtgcctttagtggtgactaagataactgacttctcaattgtttctctgaaaaaagtgttgctgtgggaataattttaatgttcaatgtgatatcatggtggagttttgtcttttaaaacattagaagcattttaaatactaagaatcaaatatttatagatcaaacacttgtgttttaagtattatacgggacctgtttacatatagtaaatgtgtatgcatacatgagttgttgctgaagccgacaagcatattacatacatgcattttccctgtgccatcatagttgcagttagagttctagtacctgtaggctcgcctgggaggcagattagacccaaaggtagacatttttccctttccctgaagcatgatggtggtagttgattctttgatttccttagtaccaaactttaaggcttttgtaaaaacaaaacgaaaaaactaggagcttggaacatttaaaaattaacgctgctaccatcaattcatcaaatatttacttagaaccttcatacattaagattctggtaaccaataaattagaatttatttcttctgcataaagtaaattttcatacactcgacctactgagacagcaaaggtgtcctaatttgaggcatttgtgtaatgcctacataactaaatggtaactaaaatgggacagcatggggcaagaccttgtagttcttcacagactatttgtcatcagtttctccaattaatttgctgcatgagccaaataaccataattcaccttttgtacccactggagccataattagagaatcagagggtgtagacagaggttaatgccaatgacaaacacagggcaggatttattattattataaagatcattacatacaaaagattttttttttaaattcctaattctaacaaaggggatcaaccagaaatgaaactaagctactttctgaagtgacactgtgtcagaataatccagatttgaatataacattttgccacccactgacatttagatgaaggactgcctctccggaagagttcagaacatattcaggggtgaacctaacaccagggaagaaagactactgatgaaaatatttttccactttgaacaaatctgtaaactacacctttctttatagaaaaatgcttggaatagtcactgtaatatttagctgtggataaaaatttgtgaaaataaatacttttgaattagaaaaagcaaggaagaagaatggggttgataggatgtatatttaaaatagattaaccaggaacaactgcactgtgttttatatatgtgtgataaaatatgtataattatatatcactatatataataactatatctttatatctggtgcaggtgagtaaataaccccatgcaaatatctggggaaggaatagtccaggcactacaggaatatcaaaaaggccaatatgacacaagcagagtaatgacagagtgatatggagtgaggagcagatgaaataataagaaaagtaggcaggtcgttttgaggggtatgtgtctcaaattctaatttgcatataaatcaccaaggtttcacattaaaataaagattctgattcaggtggtctggagagtttatatttcttacaagtttcaggggatgctggtgctactggtctgtgtatcacactttgaataccaaaggactggagatgcgtgcatggtaaggagctttgggatgtgagtaatgtgggttgaattgtgtcttccccaaaaagatgttcaaatcccaactctcagtacttgtaaatatgacattacttggaaataaaatcttgcctagtcaatcaagttaagtggattcagatgggcccttatcaaatgactagtgtgcttgtaagaacgtggatatttagaaaaacacacagtggataaagtatgtgaagatgaaggaagagagtggagtcatgtaactacaagccagagaatgccaaggattgatggcaactgtgagaagctaggaaaagacaaggaaggatcctcccctggagccttcagagaccatgaccctgatgacaccttactttcaactcctagcctccagaactgtgagagaataaatttctgtacttttaacctactcagttggtggtaatttgttgcagtagcctgaggaaactaataccttgagtgggatggagagtgaagtcattggagggttttaagagaagaatggctcggtctgacttattcttaaagaatcaccctaattgcagaaacaagaatagactgaaggcaaggggctacagggaagtaggaagaccagttaggcggctatagcagtaaacctaactggagagtggagagatggtggtttgaatcaggggggtagtgatggtggtgagacaggaacagaatctgaagatgttttgaattactactgataaaatttgttaacatagtatgagctataaaaaaatgagggtggctgggaatggtggcttactcctgtaatcacagcacttagggaggctgagatgggtggactacctgaggtcaggagtttgagaccagcctggccaacatggtgaaaccctgtctctactaaaaatacaaacattagccgggcatgttggcaggtgcctgtaatcccagctcctcaggaagctgaggcaagggaatcacttgaacccaggaggtggtgtttgcagtgagccaagatcatgccattgcactccaacctggatgacaagagtgaaactccatgtcaaaaaaaaaacgtagaatgatttataatactttgggtagaaacctagtaacgggattgctgggtcaaatggtgtttctggttctagaaccttgagaaatcaccacactgcctttcacaacagttgaactaacttacactcccatcaacagtgtaaaagcattcctatttctccatatcctctccagtgtctattgtttcctgactttttagtggtcgccattctaactggcttgggatggtatctcactgtggttttgatttgcatttctctaatgaccagtgatgtgggagatcggtcagggtggtgggagaagctataaggaaagacacaagccttcttgaaaggttggaaggtcttgcaaaagcttcatgagagaataaaggtgaaggaagaaaattctctttctctgaggctaagggtgagaagtaggtgcaaggaaaagtgaagaagtttatctaaatatgcttgtttacttatgtcatcaggaaactgacttttgaacttctgagcatgagactgctccctgtaagagggagcaaaaatgttaattacccagcaattgtgttgactccaggccttggacgttatgccagtactgaataaatacaagcagctctggcttatcgagactgctaactctcctctgcccctagggctcgcagcctcctagcctgctcttaccctgtatatttgtgtctgagtactcctttcttctgttgctcagccagggtctgcgggatggacccggcacagtgatgatgagctttttttcatgtttgttggccgcataaatttcttcttttgagaagtgtctgttcacaccctttgcccactttttgatggggttggcacaagcacatgtatgtttactgcagcactattcacaatagcaaagacttggaaccaacccaaatgcccatcaatgatagcagcctggataaagaaaatgtggcacatatataccatggaatattatgcagccataaaaaagaatgtgttcatgtcctttgcagggacatagatgaagctggaaaccacagtctcagcaaactaacacaggaacagaaaaccaaacactgcatattctcactcataagtgggagttgaacaataagaacacatggatacagggaggggaatattacacacaagggcctgtcagggggtggggggtaagggagggatagcattagcagaaatacctaatgtagatgacaggttgataggtgcagcaaaccaccatggcacatgtatacctatgtaacaaacctgcatgttctgcacctgtatcacaaaacttaaagtataattaaagaaaaaaatagggctgccaagggtataaacagggtgtttcgtggcttaataactgtataactataaggatggagtctattacctcctgatatgaggaacatgatgagagaaggtgagaatggggaagatgctgggtaagtggggagaatagtaggagattaagagctctttttgaggtatgttcgctttgagatgcctattttgcctgcaagtggagatagtaattaggctacttggcataagtctggagtccagagcataggtctccactggagatttatctgacatgagttattaagagaaattatgatgtttggcaagcatgtccttaagttgtgagattaacatcaagaaggacaatcatgtacttctaaaacatggtgttcagtgtcacttatttgaaaacatactgggccattatttgacctgtgacagttctgacattcattctaagactaccagatatgaaagtcaggagactgattagtttcttttttggtgcttttctcactctaaacttcaactttccatatcattaaagccactaaggtaaacaattagcctaagaggtatattcattacttttttgctgcctttaaatttgatgcctcattgtaaaaaatatgacctcacttgtatttgtgtggatgatattttaaaagatcatactgggcagagaatatggacactttcattatttaatactttagactaatgccaatcattcaaacatgaattcttcattcatctgtcttgtcaaagaaacagagctcatattgcatatgtgaaatatcacctagtgtctatttcaatcgtatatattttctgtttgtatcttagaaaaattatttcacctcaacaagcatattgcttgttggaattatctggatatagtgataaaataattattttcatcaacatctgaagaaaatgcctatgtatctgttgggatgggaggtgggatggagaggtgtgcagttgtctagcaccacttgtggctgggaaggtatgtgtgtctacagtaacagaaaaatctattgttaccacaaagattccccatagctcctttaaaaataaacctgccatcttgatctccatctgcctgaatctttgggtatctctcccttagttcaaaattctgacagagaatagaagcatatttatcaatccttcaagccccagtagaaacatcagagggagaaaacttacctattttgaaatggttgaccaattctcagtgacaaagctacagttacagtctgattttcttgtccattgccaagaaaaaatgattcagtctgactccaatttataagggcatgttgaaagcaagaatcctacttgtagagtttcttcttctaggcatgaggaatggttattccaggtaatggattcctaatttgcccttctgtggaactagatttgcatgacagatgacagaatatttgtcaccttaagattcttgaaaaattaatttaaagccatgctatttctaattgttttggcttatgctctgaagttttttttttgttttgttttttgttttttgtttttttgagacagagtctcgctctgtcgcccaggctggattgcagtggcgcaatctcggctcactgcaggctctgcctcccagattcacgccattctcctgcctcggcctcccgagtagctgggactacaggcgcccgccactacacctggctaattttctgtatttttagtagagagggggtttcaccgtgtttgccaggatggtctcgatctcctgacctcgtgacccgctcgcctcggcctcccaaagtactgggattacaggtgtgagccaccgtgcccggccctgaagtttttctaaggctgccaaaattgtggtcaccaacataataggtaacatttttccattatccagtgtaaaatatatataatatgttatataatatgaaacttaatatatctgctggtgcatatagctttattatcatataagctatatgaaagcagaaatatgcatttaaattcaacatttgcaaaatgtttccttttttttttttttcttgagacagagtctcgttctgtcgcccaggctggagtacagtggtgtgatctcggctcactgcaacctctgcctcccgggttcacgccactctcctgcctcagcctcctgagtagctgggactacaggcccccgccgccacacccaactaatttttttgtatttttagtagagacggggttcaccatgttagccaggatggtcttgatctcctgacctcgtgatccgcccacctcagcctcccaaagtgctgggattataggcatgagccaccgtgcccggcctgcttttagctcttacaatcgagggtaaatctacttataagggtggattgcagtatgcatgtatttgaagaaacctgatacacattgcttcattttttcatacagccttaagcagattattaaatttacctttttatttgagtactaacacttttcctacatagttagagagagctgtttgctcagttaatgcagcaaagggatgagggtaagaatgtgtgacagttagctcattctaatttgcttattgattgttggacatattccctcaattacttgacctcagctcctatattggggcttacattaggtgaacacccagggtctcagggctccacgtgggtgtttgaaatcacttgtctagatatataaaagagaacaggatatactcaccacttgcttggacacattttactgcctaaacggttcatttacactggccagtgatgcattacttcttgcccctaagtgtttctcaatctgtgttttgtatctaaaatacgcctttttctccataatcttttaagttgtctttttttgctagcattgcttataaaatctcattttctccaagaaatctctcttgaagcttagaaaaacaaaattggggtaatattttctaggtaaataggcacaattctataattctatattccatgatttgtattaaatataatataaatattgatacatattctttgtctttcagaataggtatgttatgttcatatgtgtcaggttggatcagtatttaaattttactactgagataaacaaagagttattagcaatttttaaaagttgctgtacaatttgtcatatttcattgtgcttcttaatgacaaatatgtccaagattatattgggagctgccattttctgtactttatccccagatttgggagtgatacttattacagctttcagaatttcaagaaatagtagcactacttttaactagactaaagtcttttgtttttcttttgtataactttctggacatttgtaaattcataggatgtcttcctcaaatcacaaaatgcctatcgtctaattcaattgggaggtcagataccggtttaattctggagccatatgaatattgcctgagttaatgttatagctgaatatcatgcaaatgtggaaaaagtctattgaatcaatgtcattttatacatggaaataagcaaacagttgtaaataatatggaatattaaaaatctttctagtaaaccaatgtttatgtttttcaattgtcttgctaaagaaacatagcttcttttaccatgatggaaaatattgtgctggaaataaagaaaataacaaattttgggtctcagcttaggttatcagttacctagtcttaaacaaatgatatatcaccagtgaaatttagcttttagacatcagtaaagtaagaaaataagccttgtttaccatgaaattttatgcaaaaattaggtaatatttaactggacttataaaggacttcttttttcaagaaacaataagaaaatgacctgaaatagtataagtttttattcataagtgaaattattgctaattcactttacaatagtctacttttattaatggagatccttgcatattaagacttacaatcctattaataattgctcacctacaaatgacatttgtcaagggatcaaagtcttcatgtaccacataaaatattattataacaaagtaaaccagctgtatgcctttgatcactacatcaatatctagatcttttagcttctatttctgttccattctgctagccaagggtctttataaaaatacaaaggaaaatgaacagctagtaacacatttgatgtgccactctgatggacttcagaatgcttaatatcatcttgtttaatttcatgtttcaaaaagcttctcaatggcaggatcaattactttcaatctccacatcaatcagtccagatggttctcatgatttgctaaggatagctgcaaactgaactttgtgaacccacgatgcatattgtgttaatccttgatatggaaggatccttctgcagaataagcggagctgaaaaaggtgtgcttactttcacaaactgaatgttatttaaggaataaaaggtattctttaaagtgttaaatccagatgaacactgaaaaatacagtcttcagaaaaatcaagtgatttcacttctgtattcattgctgaaatgagaacatcatttcatttctaattctaatttgaattttgatttaaggttaaaaacactttaggattgtttcgtattgcagaataatctgtaacttgttctgtaaacactagttgctaggctaaaacagtgagttatatttctttgtgtatgatactatttgtttattgtcaatttttcctgaactcaccagtagaatatattttaatttgaataatttaagaagcaatgtcaccaatatggctagaacaataatttcacttttgttactaatttaattaagaaggtgatttttagcaatatccatttctatttggttgtgtttttatctatttcaattattttctatattggaagtaattatgaattttaattttcatacagccctcttatcttttacttaaaaaatttaatgtttaatgaatttggagggagggccaaccttcattcttacatttatttatacattcaatgggaaagcagtactattctcctgaatgttcaaacaagcaatggaaatttgcaagagagaaataatttaaaattttcatcacattgtattgaaatttcttctttgtttccgttttttcaccagatcttgagctcttgaagatgcattgcccatagatggtcttcattaatttaagcaatgttttcagggcagttattctgtgaatatgcctgtaggatttaactggtctttgaattatggatattatttggaaagctggagaggagagcgaaggacactatataggtaggcaaacatcttgaaattttgaaacattgtgtaattattttacacataactgcctggacatgaccaacaggtataagaatagaatctgttggttgctaaaactacatttttagttaatgtccaacatgtaccaatagatgccactgaagatcttctatgaagttcctcctaagagtcataactggtgaacacagttcatccatggggaatacagactataacttactaatggatttaggaaggaatctacctagcatttttgggaaaatgtgaataaatcaacctgatcaatgtggtgggctcctctagaaaatagaaaaagagggttaggctaagtaatgtggagatttgagaagatagatctggggtgatagaatattagatataacaaaggcagtctcttcaactttaccaagtttttattgtcatttgtgctggtgtctatcaaattgtatgtgactgcttgctttcaatatggcaaatgcatcttcagaaacattataactaagataacttttccaatagagtgcaaaatgtgcatctctagaaaggtttactcagagaactctggcaatacaatgccacatacatgcagcgttatgatctttagtttgatttctccttcccttgaccctgaataggactctacagtcaaggaagttgaatggagaaggaatttgagacgtcaggctgtgtttgttaaaagggttttatgatgtcttctctttgagtaaatatactggctattgtatctttcttccttccttccttcattcctttattgtatcttccttccttccctccttctttccctgtttcctccctccctccctcccttccagccttccttctttccttccttcctccctccctccctccctccctccctcccttccttccttccttccttccttccttccttccttccttctctctctccttccttaactcccttctttccttccatccagaattatttttgagaaacgctgtgatgtgtcagttggtagcacattctctggagctggttgcttggattaaaatcataacccttcctcctattagctatgtgaccttgaacaagctactaggccataaattaggactaataatggcatcaatatgatcctgctatagactgaattgtatgagttaatgtatgtgaagcatttttatatggtaagaattggataaaatacagttactattttatttattgaatacttagcattttttagctttttattttgaaaagatcttagatccatagggagtttcaaatacagagaggtctcgtgtactattctacacagtttatttcaagagttacatcttgtataatttagtacaatatcaggaccaggcattgacatttatacaatgtgaattcataggtctatgccaattttatcacgtgttgattaatgtgaccattattacaattaagttacagaactcttccatcactaaaagtgtcttcctcacattttatagccatattcatctcacactcccataccatcactaacctctggaaatcactaatctgttttctatatgtatgttattttattaaagttatatacatgaaataatatgccatgtgtccttttgatatttgctttttttcactaagcataatgcccttcagatccatgcaagttattgcatgtgtcgaaagtatattcttttttatttctgggtagtatttaatcatatggatataccacagtttattcaaccagtcacctgtccaacatcttggatgtttccagtttttctctgttagaattaaaggtgctatgaaagatattaaagatcgcatataggtttacatttctcttagataaatttccaggggtgcaattgctggatcttattataaatatatgtttagtttttaaagaaactgataaattatttccagagtattataacattttacaattcaaataatgtatgaatgatacagtttcttcatcattgccagcttttgttgtcactatttttatgtttagttgtttcaataggtgtgtagttacctagtattttgataagagctgaggatacaaatttgagttgatcaagaagtcaaacaaatagaaagcaatcattaaagattacaataaaaataaacgaagtgaggagactgctaataaccagggaaggaactttaattaaggtatttcagaaaacttcttagccgagatttcaaagaacaatgatctaattttacaaaaagccacagaaagcttattttagaaagaaagagaaacaagcacaaaattctagaggcagaaaaagggttggcatatacaaagactgtggaaataattaagaatgttttgggtgtgataagaaaagaagggaagtgtatgacatgtggttggagaggtaggtagaaaacatcaagtcaggatctatggtcattaaaaagaagttggaaatttttctttatattagcagaggaaagccaaacaaggacttaaagcagaaagtagggaatgaagagtcaagatcttgtgtgctttaaaaaaaaaaaagccactctgactactgtgaaaatagagcatttagggaggagatgacaagaagggaggcagatttgcaatgcattgtggtattctgacagagagatgggtgtggctttgagaagtgttcacggaagaaatggaaatcttggaaatggagagtcatggggaaaaaaagaacctaggtcgacctctaggttttgggcatgagtcatacaggcacagtgtagtaccatttattgggatgagaaaagctgttgaaggaattttgttttgcttcgtttcagtgcgaacacgtgcagcagtcagcttgatttcagacatactaaatttgagttttctgttagatacgcaggagatttcaaataggagattggatatattagctaaaatattgcatctgcaagtctcttttttcaactgatcttagatggatggataaataagataaaccagttgaagtccagtggaaaaatattccattaaaataagacctatttgggcttctattatgatattttgccctttcttatctctgtgactagagtgaataataataatcagagatgcagttttctcacctgtgcaatagtaatatctattagatatgcatagtgtggaaaattagctaaactcattcatacaaagtaactctgacattgaaggttctaaaattaacaacatttagaattttaatcttccatctagttttaccatttggagtatataaggaaacctagaaagaaaccttatatccacttgtctatcctataatatttgcacattatagggtataatctcagggcataaatacaactttttataattcctatagagtgatactcttaggccaatattactgatcttgaaaagtggggtattgaggtattttacttggttgtaagccatcaacgtgttttacaaatgtgatattaggttttgatattagtaaaaaaaagaagcttcaaaatgtcctctctttctttgaatgcaatcacaatcatttcctttttgaattttaaatataagtaacctaaaacttaataacttgctcacaagtctagaagcagacaaaatatcacccacaaacctgatttataatactacgttaaactgacttaaggctttagacattcataaacatcttttaatctattccccttttgcatggatatgtaaatatatactccaggaggtataatttttgtagttattgtagtgcttttgtaatgaagaactaagtctattttcacagtgatagagaattgagttgagttcttttgaccctggatggatttgtctattttttaaggtgctacttaaaaatgtataggagaaaataaaaataaattatctctttcataagttaaaaatattttacatttcagcattctgaaagcacagaggattcaacaaaaatgatggtttagaatcaaattcaataaagaaacatcagcttgagatcagactctctgaggaatgtttttttttcctgatgaatctgagccattcaaggtccttataaataagtgagagcacctttgatttttgactttttatagttaacagtttcagtttgctaatacaaaagacctcatgccttttcatccagaaaacagagaacactttctattatgtaagagtattatgtttgaaggagtatgtttgcttcaactatgcgtgctatggtacagaaagaaaaaccacctccctgtaggtctaaatccaaggggttttcaatgtatttgggttaagttatgttgtaaggttatagctctctaagatttttacaagatgcattattaaacatgaatcttctgtaacgtgtacagcatatcttgtataaaacaatgcaatattttcttctaagtatgggatggctttggtcacccatgcttaaaaaaactttgaagagacaattcatctttttcctatgaagcaatttttattaattgacataattcttcagcagtcaagctattactgtcattaggtagtcctttcctttattcagaagcccaagaagttagtagaggtttgtatactacgcacctttcaccagaaaataaaaagggagaactttaagtatttgacatcatcaaaaattaggtgttatggtgctatgcttaagttttgatattatatattaattacatttcccttagtactacctcctctgaattcttgagcttgtcagtagttgaaaacatttgaacctaaaccatttttgcacattcagaactaaatgtctgggtaacttgggaattaatactctacaacctgtgatggagcagggagcagggtcagctgtccattagcatctcttgtgaggtctctccattttcataaagaggcttgagaaaatctccagatttgcctgagggtagacacaaagcaatactcagttatactcaatgttatcaacctactggacttggtataaaagactttttgagcactgtattgcctattaaaaaacagtaaagtgtaaaagatagttctttagacaaattgggccacggaaatgccaaatcattagttttggtgtctgtaatgcctcacaaagttataaacttttatgaataatttgctaagaaattagctctaatgacaggtagtttatgtatataccttgataacatctacaggtatcttatgcacatgacattatagaaatatttgtttgggtttttctcaaccagtcattttctacaccataattccagctcagcccactccacttgcaattgcttgctctcatcttctaactcctgtttattcttctcaatttctgctgtaatggcttcatttaacctgctcctctgtatcttgtatgctttttagttcactgcttatttccttcttcctgctggaaaacttggctaaatagctcgtattaatattttagcctcatttggctttaagattatctcataaggatatcatatataaatggtagttaatatttctgagcaccaacttcccttactccagctctcagacttcttcccattgttatgacaattgaaggctttttaaattcctgtcttaggaaaagtggcccaaaatttgccatagatctatgatgttttaattaatactgacctctgaatgatctagaaaataatggtaaaccatgtatacatatttgtgtgtgcacatgtgtgcatgtatccatagcatctgtgtgtgtgtacattttatagattttgtctttgtatgaagaaatatattgaatatccaaataagcataatttctatacaagtgaggtatgtgggttaaaatctagtgaacaaaatataactatacattcatgatttggaaaccttttaacatgattcctgaggaattactcaattgttaattgtttctgccttctctaccaaatgactaatatttggactgaaaagaaaaaaagagaacctcagtaaggaaaagtggaatttctgtaggtggtaactctggaatatcccaccaagagaatgaatcagattaaaataatgactgtagaaatttccttgttagtgaatattcagcctggccttaaggaaaatgtagctctctcttactgctttgtatcttatttcttttactatgtcaattctcaccttagtagaactactactagttctagtaccatggctatcatagatgcaaccattatattccatttagtttcttcctcaggttccctaacaattgtttgaaactgaatatatatgtttatgtatgtgtgtgtgttcactttcatgtatatggtgtatatgggatgtgtgcagttttcagttttatatgtattcatatatatacatgcatatatgtgtataatatacatatatacatgcatacacatgtataatatacatatatatacacatatatgcacacatataatcactgagttccaaagtgagtctttatttggtgcaattgtattctctcccctctgtctgctcactggcctttgcaagacatagcagttgcttgattttcctttggataagagtcttatcttcggcactcttgactctagccttaaatttagatttctattccagaatacctctcatatcaatcttaaaacctaagatgggtaaagaggtcataagatttttagtatgaaagagtttgcttagttaaattatatctcaggaaactcattcatctacaagttaaattgtaaaatattgtttgttgtatctgaaaaaatctttagaacaagaaatgtaactgggtagcctgttatatcaaagaaccctcgatttattaagcctcctcatagccatatccttatatagccctctctgacactgacttaatagacacttgacaaatgatagtaaatttaggcttgccaaattaaaatggcagcaatgccaaatgagaacctgatctactctaccagagagactaagtggaggagaacccagctgatagcaccagtgaagtgccagatatttgagtgatgtcactttggactatgtaggccttgtcagtcatataaggaaacctaggcaagactccgactattatcctcctgagcccaaccaaagttaacaaattgtgagtttgtgttttaagcaactaaatttgatgactgctaattacacagcaatggataattgaaataacaactaaagattaaagatgagataatgtgttgtgtttaaaaatttagcaagtgagtacttcatgaatatatttaccttgatggcattacaagctaaattttactgggctttattagaacaaattatttgagcattgatgagaaagtgaactttcaaactatcttatttacgtttatgtttcagttatcccacaaaagcaggaaattactttcaacaatgcacctgaggtattttatagtaactctctggttatttccatgtatcaggtggagaaatatggatcagacacaaagacaataagattcattgctctctagcggaatactttttcttaaatgggtttattagtaaattgagaacttgatttgatgtttactctgacgtgtgatgtaaagttcttcctaaagccccctttcttttcctttttaaaattattaacatagatgaatacagagaatgtgaacatattagctatacagatatcacaacaggagaacagtaaatgttatgttttagactatttcaaccctaaaatatggacacaggttggaatgaggatccaattcagcataatagcctctaatggagtaggaaacatataaaatcctgtgttgctttatgaaatgttgcttatttgctgcatggttttaaaaagtatcagttttatttaatagtgggatctttatgtcagtgattactgatgtttccagcaagctaattcataccagggagacaatgtaaacatttagaaaggggattatatttctgtactatctgcatatgtcagatgacaacgagagtttcaaagtacaatcttatgaagggttgtattgcagatttggcctagaagcccaaaaccattaaatttttatcaaaattatacctgaaaattcttcatgttgtttattagcagtcattatctttacaaagatataggaaataaagtgatttccatctgttgcaatcacttgccttttacaatagacaaaattgttattttcattagattttacaaaaggaatgatatataaatttttaaaaggcatgtttaggttttttcaccagagaaatttagattattcttgcataaaatcaataaacataatccagcacataaacagatccaaagacaaaaaccacatgattatctcaatagatgcagaaaaggcctttgacaaaactcaacaacacttcatgctaaaaactctcaataaattaggtattgatgggacatatctcataataataagaggtatctatgacaaacccacagcaaatatcatactgaatggacaaaaactggaagcattccctgtgaaaactggcacaagactgggatgccctctctcaccactcatattcaacatagtgttggaagttctggccagggcaatcaggcaggagaagggaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaacttacaaaaatcacaagcattcttatacaccaataacagacaaacagagagccaaatcaggagtgaactcccattcaaaattgcttcaaagagaataaaatacataggaatccaacatacaagggaggtgaaggacctcttcaaggagaactacaaaccattgctcaatgaaataaaagagtatacaaacaaatggaagaacattccatgctcatgggtaggaagaatcaatatcgtgaaaatggccatactgcccaaggtaatttatagattcaatgccatccccatcaagataccaatgactttcctcacagaaatggaaaaaaccactttaaagttcatatggaaccaaaaaagagcctgcatcaccaagtcaatcctaagccaaaagaacaaagctggaggcatcacgctacctgacttcaaactatactacaaggctacagtaaccaaaacagcatggtactggtaccaaaacagacatatagatcaatggaacagaagagagccctcagaaaaaatgccgcatatctacaaccatctgatctttgacaaagctgacaaaaacaagcaatggggaaaggattccctatttaataaatggtgctgggaaaactggctagccatatgtagaaagctgaaactggatcccttccttacaccttatacagaaattaattcaagatggattaaagacttacatgttagacctaaaaccataaaaaccctagaagaaaacctaggcaataccattcaggacataggcatgggcaaggacttcgtgtctaaaacaccaaaagcaatggcaacaaaagccaaaattgagaaatgggatctaattaaactaaagagcttctgaacagcaaaagaaactaccatcagaatgaacaggcaacctatagaatgggagaaaattttcacaacctactcatctgacaaagggctaatatccagaatctacaaagaactcaaacaaattgacaagaaaaaaacaaacaaccccatcaaaaagtgggtgaaggatatgaacagacacttctcaaaagaagacatttatgcagccaaaaaacccatgaaaaaatgctcatcatcactggccatcagagaaatgcaaatcaaaaccacaatgagataccatctcacaccagttagaatgacaaacactaaaaagtcaggaaacaacaggtgctggagaggatgtggaggaataggaacacttttacactgttggtgggactgtaaactagctcaaccattgtggaagtcagtgtggcaattcctcagggatctagaactagaaataccatttgacccagccatcccattactgggtatatacccaaaggattataaatcatgctgctataaagacacatacacacgtatgtttattgtggcactattcacaatagcaaagacttggaaccaacccaaatgtccaacaatgatagagtggattaagaaaatatggcacatatacaccatggaatactatgcagccataaaaaatgatgagttcatgtcctttgtagggacatggatgaagctggaaaccatcattcttagcaaactatcacaaggacaaaaaaacaaacactgcatgttctcactcataggtgggaattgaacaataacacatggacacaggaaggggaacatcacacaccagggacggttgtggggtggggggagtggggagggatagcattaggagatatacctaatggtaaatgacgagttaatgggtgcagcacaccaacatggcacatgtatacatatgtaacaaacctgcacgttgtgcacatgtaccctaaaacttaaagtataatagtaataaataaaataaaacaaaagaactagtttgttgagttcatttaggaactaagttgtaagaaatattgcaccagacaatttgttttctgagatgaagctcaagtaactatgagcacagtatcaggaatgacattcatttgttcccagctgtctctaggcattttgcactcttgaaaaatactaagttccctggacctgaagagattcatgaatcagtaagaatgtgagccccttgagtgttcaatatcccttcaaaccttagaaactgtaagtcaatgatggtgattatcatatcacaagagtatagttagcttcttttaaaagacataaaagacccctctgagttagccctagacacatattactccaactgcctgaagaaatgtttagcgatccatacagaattactctcaattagatttagagaaaacattctctctttgaagaacactagaattgaggaaaatatggtagagcatataggttattttgcctttgttactttgtagaccttaaatcatggagtgagttagaacacagtatatttgtgacaaccatgacagttcagagaaatgcagtgaggtcatttactctgaaactgaaagacactaatctctgctctgagacccacaaagtcagattatctgttttacctgtgtgatttctattcctctcattttgttgttctttttataaaacatctttgctaaataataaagttattactctaaggtagtgtccaggtctctttgataataatgaaatgtccatggccaaatcccattgctttgttttgacagtgtgctccaagaaaattactttgatatgccctctcatattagaataaacacattctacatacctattgcctacatcaagttttgaattataccattttcaggtttaacctggtcatacagcagattttcttaatggttggtgaacacggaataatagtttaatcattcagataaactattttgcagaaacatttaaaatcagaaattgcagaactactatctgaactttaaagggacactcttaaccatattttgttttatttagtactcacgctgacaagttgatttaccacctcattttcccaacaagtgtcaagatttcaatatgcagttaatggtttctaaaaacagtgactatttaattacatccttatagtttccccaaattgcttatagtttgccctcatttagttaggtctataatatttctcaattagtgtaaaaatttctactcctttttaatcattgatgcatataatgatgtataaaaattattgtgtagatagcccctccatgaaaacttaaaatcaaaagcttttagcatcaaagtatcagaatacaaactaaagaaaacacaccaattcagaaagattttctttaaatatattaaagtgaataaaatgttcacagagaatcactcacatctaaggatatagactttttcctaaagtgaaactatttttggctcactcagactctgagtagtgtttcactgattttgaatttcactggtcagaaccagtgttggtagtaagaattattgtcccagaagagaatagaaatgcttgccaactctactttcaacccttgctggaatccctatgttgtgggtagagatatgactaaattaagcagttttaagtctaagccagaaagatttaattattgatttattggttttacaattgttaaatattgcctttaaccgagtatatgttttatcatgtaataatcactttggcagcctcaaatgtcatgggttcacagggtaaatgttaaggtaatagctaaacaattgagcgtataggagatctatagtgagtgaaaaaaattcaagatgtaatacagagtccagtatgacagacttgagaaactttcaaaaactaggaaaagaaaaccaaaagtcattcttgcagtgtctctgattgcactgacttgatgcagaattggtgcattaacatatgtatacattacatatgtatacttgtgccatgctggtgtgctgcacccattaactcgacatttagccttaggcatatctcctaatgctatccctccccgctctccccaccccacaacagcccccagagtgtgatgttccccttcctgtgttcatgtgttctcattgttcaattcccacctataagtgagaacatgcggtgtttggttttttgtccttgcgatagttgactgagaatgatgaattaaaataaaaatgcatgcactttcaaatgtacttagtgcaacatattgaacttacattccagttttcctggaattacttgtgtcttgagctaaaggctgtatttggtataacagggaaggaaagaaattatttttcctataaaattagtttaaaaacacatataattaaacaaaataaaaatattatcccaccttttaaagaacatttactaagtcacagatattacccgaagtttagaaaatcacctaagaacaattgtttaaaaattatttacggaaaatgaagcaaaattgtttttacaatctgagattttaacagccagtgcactcctgttcttcagctgaatgtccccttcattctgaatgtctgcagtagaattgaattggggagcagttaggttccaggaacatattcactcctgttttgttctctccccaatctcagcctttcggtgactgtttgggcaaagcctcccttgtggtagaagatgcctcacttctggggagaggagactcctcatcttgcagacaagaagcagcacccactggttcctgctccaaaagccattaacattataaactggccaggtgtggtggctcaaacctgtaatcccagcaccacttgggaggttgaggcagaaggattgcttgagcccaggagtttgagaacagccttggcaacaaagtgagacccaatctctacaaaaactagagaaaaaatagcggggtgtggtggcactcacctatactaaggaggctgggctgggaggatctcttgagcccaggtggttgaggcttcagtgagccaagatcatgcctctgcacttgagcttgggtgacagagtaagatcctatctcaaaaaataaattataaactgattcacaataactttggttttgtcactaatatgctgaatattttcgttacaactaatatacaaaatgcaaactggctatcactaccattctgataatggaattagctgtcctacatacctgatgacctaatgcttaacctaatcttcctctttcccactttgatttggaaacttgttacaatagagttctttacctcaaagtcttaaggaattcaagacaagactagagtatgttaagataccacaaaaagaaaaaaatatatatatagcaagagctttcttgagtaagcaaattttatacatataaaaataatttacatgcaaatgaccaagaggaaaggttaagtgactctggtgtaaataattagtttactgattctgccagagcatattaagaaaaattcactttggcaaaataatatggatttaaagaagtaacaagtgggtttctctaaagcacagtttggctttttactagaatatcaagtcacctttttgggtgaggagagtacaatgggagtgggcagctggtgcaaataaacatttaaaattacttaaaacttcaacaaatgggatctgtatttaaatctgttttggtctgtcttccctttgttttttctaatccattccaacaatgcaaacctcagccactgtcaagggcaatctcagactggaggttgctgcctagggtgaggttctagcaagactgacaagcagagctcagggaaaagtctgcatgggaaaacagagccagacttagaaggcattgctgatgaattccattttcttactacagaagagctagcaaaaactgcaatatgatgtgtaaagtcagtgtaatcttatggacattataccaagtcacaacatgaggcatgagatacctcagatgttgttccctctaaatctcatgttgaattgtgatatccccaatgttggtggtaggtctggagggaggtgattggatcatgggggtggatttctcagaaatggtctagcatcctgtccctggtgctgtctttgtgatagtgagtgaattcttgcaagatctatttgtttaaaagtgtgtggtgcttcccctgccttgccaggtgatgtgcctgcctgctccttcttcatcttctgccgtgaataaagcctgctgaggcctcaccaggagctaggcagatgccagaatcatgtttgtacagcctgcagctatacaaacctcttttcaaacctcttttctttataaattacccagtctcaggtatttctttatagcaatgtaagaatggcctaatacagaaaattggtactgagacatggggcattgctataaaggtacttgaaaatgtggaagtgattttggaactaggtaatgggcaggagttggaagagtttggagggctcctaatacaggaagatgaaggaaagttctgaatttcttagaggctagttaaatggttgtgaccaaaatgctgatagtgatatggacggctgatgcggtctcagatgaaaatgaggaacttactgggacttggaataaaggtcatgcctgttatgcctttgcaaagaacttggctgcagtctgttcatgtactagggatctgaggaagtttgaacactcagatgcaggagcaaaaaaatgacttaaagttggaatttacaattcaatgggaagcagaccatacaagtatagaaaatttgcagcctgcccatttggcaaaggaagataaagcattttcaggggaagaatctaaacaggctgtggagcaaccacttattagagacatttgcataactgaaaaagagctaggtgctgatagccaagacaattaaaaaaaggccttgaaggcatttcagaaatctttgcagcagctcatcccagcacagacctagaggtctaggatgaaagaatggtttcttgtgtagtgggattttaaaaaataattaattaattaatttatttatttatttattttgagatggagcctcactctgtcacccaggctggagtgcagtggcacaatctcagctcactgcaagctctgcattccgggacatgccattctcctgtctcagcctcccaagtagttgggactacaggtgactgccaccatgcctggctaattttttgtatttttagtagagacgggttttcactgtcttagccatgatagtctcaatctcctgacctcgtgatctgccctcctcagcctcccaaagtgctgggattacaggcgtgagccaccgtgcccaggctgtagcgggattttttaaggaatcagagagactgatggggttgaggaggatatttattatttaggtgcaccggcccagtcagattaacaaccaaaggactgagtcctgaacaaagacttaagttaacttttaagcattttgtggggtggtggggagtggggagatctgtgcagggggaagcatattacagaagcgagaaacaaagacagttattcaattaattgagacatgcattatatcatttcttacttttcaaggaaaaacatgttttacgacttgagtttatctgtctagtgaccttgcagctgcacagctagggaaacagggtcttcacaatgcctgggaaaggaggagagatgaagctcactagccacagaaaaacaggcagttaatttttaaagggctccagctctttctctttctcagggggaactgggttttctcacatacaactgagtttctgcttacacattctttaatttcttttaattcctgttccacttggaccagggccagggcatcactgtcctgtaccacccccaggagggtgttccttgcatcctggcccttctagctccagccttggttcaaagggctgcagatagagctcaggtcatggcttcagagggtgcaaactataagccttggtggcttccatgtggtgttaagcctgcaggtgagcaaagtgcaagagtgaaggaggcttggcattctctgcctaaatttcagaggatgtatgagaaaggctggatgcccagggagaagactatgcaccactggagctctcaaagaggacctcttctagcacagtgccaagtggaaatgtggggttggaggccccactcggggtcctgactaggggggctgcctagtggagctgtgggaggggggccgctgccctccagatcccagaatgatagagccaccagcagctcatgccttcagtgtagaagagctgtgggagcagagcagccccaggccttgggagcccaccttatgcatcgtgggaatgctctatgttcccaggatgtgggacatggtttcaaagcagattattttggaacatcgagttttaatgactgccctgctgggatttgaacttgtgtggggcctgtagcccctttcttttggccaatttctctcttttgtaatgggaatgtttacccaatgcctgtaccccaattttatcttagaagtaaataacttgttttgattttacaggcgcatcagtggaaaggacttgccttgtctcagaagaaactgcactttcgagtgatgccgaaacagtttgagacttttgggggactattgagaagggatgattgtattttgcaatgtgagaagaacacgagatttgaagggccagggatggaatgaaatagtttggatgttgtaccctttaagtctcatgtcgaattgtaattcccagtgttggagttggggtctggtgggaggtgatgcggtcatgagggctgatttctcatgtttaacaccatcctcttggcactgtccttgcaagagtgagtgagttctcattacatctggctgtttaaaagtgtgtggcacctctccctgcttgctcctgctctggccatgtgacataccttcttttgcttcaccttctgccatgtgtaaaagctccctgaggacccttcttgaagccaagcaactgccaatgcaaagcttcctgtacagcctgcagaactgtgagccaagtcaatcttttttttcagtataaattatgtagtgcttaggtattcctttatagtaatgcaagaatgccataatacaaggcataatggtttgcattttaaaaatgaaaattaaatttttgtaatttatcatgaaaagatgaaatgagttaataatgagcaatatctacatgttgtcttagaggtgctgacaatctgtcaaggaattacatgcattgatcaagcagtttaccttcaagttgaataacaagatattcctatctaacataacaaaattttgacattatttgggagactggaaataatgctaaataatatcagattgtcaaagtcaaataaatatagacaaacatctgaaattaaaatgttttatttgagatacaagtattacaacttcacacatacatgcagaatgggtgtctttagtatgtacaaaacataaagagaaagttagaggttttataaaaaagggagacagagagaaaaacggtatgtatttctctttgagaaagttcactggcaccagtaaagtttttgagagctggcaggctctgataggtgagggacagtggtgggtaaagctagtcttagtgttcaagaggttgtttcagtagccatttgataaaactggtttcagcttaaagcaggtaatttcagcagccaggcatgcagagaattacgcttttggagtggtgtttttgccctgaatgcctcctccccctggctcgttgatggttttatttggtgtgataagaatgacccaattcatatgatcaattttcacatttaaccctttccatcaagatctttctcttaaagcatcaaccatgtttatagttgtacaacgactacaagttaggtttaatcatcccttagtgctaggatggacctgtcccagttgctctgtcccacatctgggaaaggtatggaggtctacatcaggtctatgtcaagatttatggcttaaaatgtctatccaaggaaaaaataaaactgaccagtaatcccaggagagaaacataccttggcaaattcgaagatatttctaattttatttaacaattttaaaattaattaatgtatcaaagattcacctaactcatgtcaaataaaatatgtttgcactaattaatatatattttatatgaacattcctttatttaaaccatccttttttcctagaatgatggattaggggctttcaatgtgcctcagccacttggaagtagaaaaataagcataaagataaactttgtgacttcaattcaagaagaaaaataggaattcacaggaatagagaagaacactccagatcctgtggatggggaggtgggaaagcagactctgtgatagcatttggttcataaaagggagtgaaactccagtatgagagaagagcagccagtctccctctgcaactcaccttttcactggggatttgtgcaatccagattaagggagaacactctgtttctcccaagccttggagctagcacaaaagtggctgagagatggggaaagaggaaagacactcagaaaagctgcaggcatttacctagacctgggactgagagaaggatgccctttttaatctgggctcatacaaagtcaatcattttttggtgcctggcaatggtggccactgcagacactttaatcttgggctaggaattggagtgcttgctctggagcaggggagcagcctcaacagccagaattgagtgttgagtgtggaaagtgccccagcagtaagtgttggaattaggctctttcctcttgcaggactgtagtgggaagagagttgctaaagcagaggtttctcaaggatggtgagacttgcagccaagaacagctttgcaacctggaactggtctgtgtgtgtcattgctgggtgtctcagcctgctcccttggtcagttgagagagtactccatcagttccaagaaacaagagggaggtgaaccccattccccaggagacctaaactttggtgaggaccagccctaagggaaggaggaatacagcttgccaaagccaccccttggatcaaaggaaacacgatcacgatatcagctgctgaaaggggcacaccaaagcctgggaacagatttagagaggtggttatctcttgccctctgtccccttcctagtgcactgctgcagatccagcagtggtcatcctgttgggacccaaggaacgtgggctgaaagaggctgcttcttaggtttctccagcagctctgcccctgctgaagactagtacacactgggacagggcgcttttggcactttgtcacttctgcacctgtcgaggacaagtacacagaggagaagaccctgcagccagctgttactcttaagcactgtctactggactgaagcctgaattacaccaccaaacaaaaatacatcaccacaccaagccaccacaggagcctatctgcaaccaaggaacttgtacagagccttggtcctctgaaagtacccagaaatgaagcaaaatgatcctatacaacatacaccacagtcatacccttaagagaaagaaagaatgaaaaattaaaaaaaaactccttccaaatgatagcaaattcaacaaaggaagcgtcaagtctctcagatgagaagaaaccatcacaagaactctggcaatacaaaaagccagaatgttccatcacctccaaaggattacaccagcaatctagcaatgagtcctaaccagaatgcaacgtctgaaatgacaggtatagtattcaagatataagtggcaaaaaaaatcaccaaaagccaacagaaagttgaaatccagcaacaaccccataacaacgatcctggatttgaatgacaacatagccatattgagaaagaaccaagcagagcttcttgcattgaaaaatttactataggaatttcaaaaaacagttcacagccttagcaacagactagaccaaatagaagaaataatttaagagctcaaagaccagacctttgaatcaacccagtcagacaaaaataaaaaaagaatttaaaaataatgaaccaaacttttgagaaatataggattaggtaaaggaacaaaatctatgacttattggaatttttttttttttttttgagacagaatctcactctgttacccagtctgtagtgcagtggcatgatcttggctcactgaaacctccacctcctgggttcaagcaattctcgtgcctcagcctcccaagtatctgagattacaggcgtgtgccagcatgcctcgctaatttttgtatttttagtaaagatggggtttcgccatgctggccagttagatctcaaacttctggcctcgggtgatcctcccaccttggcctcccaaagtgctgggattactggcatgagccactgtgcccggctgacttactggcttttctaacagagaagaagagaaagtgagcaacttggaaaacatttttgaggatataattcaggaaactgtcctcaatcttgctaaagaggtccacatgctgatacaagaaatccagagaactcccgtgagactgaaggtaggcagtgaagcaaatgcttgcattcttgtgtggctctgattagcatcaggatatctacattttacataggaaaggagggagcagaggaaacagttatgcgttcttctcacattcagtaaatctccattttacataagataaagtaagcatgtgaatatagggagtggagtagaggaaaactcaacgattcattcatctcaggataggcagagggatgatttctggtcctgaccttgtcccagaactatgaaaataagctggtaattgagattgtcagggtgaaattgagccgactcacttttagggatagtttaaggtgggatgtacattctgaaagatttaggggttcacagcaaattgtgagggaggacatctgaggagacatgcggccttctgtcactgtgtgaacctggcttatggatgaggctatgacacagggttgtgaagttatagctatgtgtttgagaacaaggaaggcagtattgcgtaactcagttcccaagcttaattttccctttgacacagtgagcttggggttggggtctctattctcttttctctcacaaaatcatatgggaacattccagaaaatgtgaggttctgtgctcactattaaataaaaatgaccaggagagccatgggtaagctccctcctcagtcatcaggaccccaacagagagttttcccctgtgtggacagggtcctgaattctgcaggatcccgtggggacacaagtgtcaggatagaggcactcattcagccaggtacagtgtctcacgcctgtaatgtcagctacactggaggctgaggtcaccttgaggccaggatttcaagaccagcctgggcaacatagcaagatcccataactaagaataaaattagccgggtgtggtggcatgcacctgtaatcctagttaattgggagggaggctgaggtaagaggattgcttgagcctaggcgttggaggctacaatgagctaggattacaccactgcactccagtctcggcaacagtaagactccatatgtgacaacaaccaacctattctgtgttttgagtgtaaattaccatagcctttgtaacagaaatgaggcagcaactcttatcattcaaaatgcataagaaatttggctaagcaattgtacttctagattatttatttatttatttattattgggacagagtctcactctgtcccgcagactggagtgcagtgacaggatctcagctcactgcaacctctgcctcgtgggttcaggcaattgtcctacctcagcctcccgagtagctggggctacaagtgcgcatcaccatacccagctaatttttgtattttttgtagaaacggggttttgccatgttggccaggctggtctcaaaacttctgacctcaggtgatccacccacctcgacctcccaaagtgctgggattacaggcactaggtccttaatttagagccatattgtttaatgtctaaaagcactcttgcatatttattactgcactgtttgaacttaaatatccacaacaggataacaggataattaaacagttaattgcactatggcacatccatctgttaacaaaatgaagtcgatctttttgtactgtggtggaaagattttctgaacatagttcaggtaaaaaaatgatcactgttgaataatgcttctggtataacacaaagtgtttgaaaatgtacacaatacactgtaatatccaatgcatacatcaaagtaaatatattttattctaggataattattaaaacattaagaaatactctttaatcatatatgttaaaacttgtagaaaatcaataacatacaagtaaagaagatcaagaagccaaaaaaagtaattccaagtgtagaaagcatggtgaaaagtgatggaagaaaactgcagaaatttaaaatgtgaaattaaaatatataattattaattaaaatacataagtcttaattaaaatacataattcttcattgaaccccaaatctgtcaggacatatgtgtgatcttggataacgcattcaacctcctgaacactgaattttcttgactgtaaaatgttttagagatgttcctcacctggttgcatgaagcaaacctctgtgtgttaaggcacttcccacagcatctgcgacacagaacagtggcagctgtgctcttcatagtccctgaacacagacccacagcagtatattgtgtgttttttttttaatataaaggctttgaaaatgtcccacagcttcctcagtaactgaatgtcaaaaggggcagccttcaaaagtagaattctggcaaatgtcttcaaaagacacaaaattctggcaatgggcacatttccctcccgccttgctcttctggatgcatccattctctcccacagcatagtcattttcttccactccactgtagaaattttccttctagtggcaagagtgacgtgagtgatatgtggaaatttctttccaagcgtgttggagaagcttcctctgcctgcttctttttggccacctcctgccagggtaagagcagagggcctccagggctgctctgtcacccccaacagcatggacctcactgcagtcactccggaagcttccctctaaaggaagcttgtgcaggaaacatcatgcatcgagcagcatggggacaggggctggccagctgggcaggtctcacactcctgacactcagactccaggatactcctctgtccccacccagggcagatccctgccctaaaagttttcccctcatgtccagcaaatgctgcatggagccctggatttctacgtggaaagctaggaggagggagagctgaaatgaggatgtaatcaccctttccaaagaggtcagtccagtactaccctgtgctcctgggcaagctctccaggttgaaggaacaggagcaggggttatgtcaggtgaaggttgaagtgagagacctcccaggaggtgtagaatattccactagggacatctcatacccttccaggattagaccttgaggcctggagatccccaggcaattagtattgaaggtcgaaaggccaatgacaggaataggaaggcccactgtgtcattcacaaagcacttccaaacccatcaccacaggtggccctcacaatcctgtgagacctgcaggacaggggctctcacaaaggaggagtcgggaatgtcaagattttaacaccttctccaagtcaggatcaggaaatgctgttccagcactgacctatattccctatgcttcctcccacaaaacagcttagggtgactgccaacttgtgggcagagaccctcacttccaatccccacaaggggctgtgcagtggggaggacgaggccccctcctctgactgtctcctccaagaccctgttttctgaggaaggtcactctgggaactgttggcctctgcagatggggacctggaccatgtggaaagatgatgtgaaggtcacacctggcaggcaccagcgctggagggcaaacctcacctttaaaactcacacttttttaaaaaatttatttttatttttaatttatatgagtacatggtaggtgtatatatttatggggtacatgagatagtttgacacaggcatgcaatgtgtaataatcacatcagggtaaatggggcattcatcacctcaagcaagggaaatgccagctgcttataaaaccatcagatcacatgagaactcacttactatcatgagaacagcatggggaaactgccgccatgattcagttacctctcactgggtccctcccaggacacatgaggattatggaaattacagttcaagatgagatttgggtggcaacgcagccaaaccatatcaccttataaaattaataatgtggaaatagcagcgggcctgagtcctgacacctgcagtgtgatgccccctcttgaggagggcctggcttctgtgccatgcagaaactttcctgtgcttcctgctggcttggggtgagccaggtcctcctgggggagctgggcacttgtgggacaggagagtccctggcctggggtctccatttgcctccttaccccatcagcaaaacaccagaggagccaactcaacaaacctcaatgcacggcacttcctggaccctaggtgctcagggccccctgagctgccctggggcagaacactgggcagtggccagtgctttcccaacaactcccccatgcacagatgcctggtggacacacttcccttaaccctgctcagctggagctcagcccccatcctagtacctctgcctcctcctccagggcaggaaaaggaaacccaactccaaacccatggagaatcctcatcttgggtgaggccctggctgggactcagctccttgtcaggcccttgaggagctccatcttcctctgtttccctgccccatgggaccctgggcctctgggaaagagttgagggtgtcatccactcagcaggtaccgcatgatctttgggaaggatttgtgttatacctactcctggtgggataggagcctccggagctgggcagtatttgggctgtagaaacctgagaagcccctgacccatcatgcatcagagcccactcccaagatgtggagccatcagctggaagagctgggcagtggcaggggaccccagaccctgaggccttcctcccttccatcaggtgaccctaccatgtggtctcagctctagggagatgggccctagctggaggcactgcacagcagcatcctgggtaaaggtgccaggagggcaggcctgcctttgaggctgtgaggcagggctggggcaggcagtggctagtggagggaaccgggtgggtgctgaaggactacatggccatctcctggacatggggtctggctaggggacatgggatgggcagacactgccatcttgacttcattggcccatctgtgggctaggggggcagctgggagtgtggccagctgggaggtaggaggactcttggggaagtgagagtcacctgcatgaactcagggctagagggctgtggctctgggacacacagggtggccagggggaggctgcagcgccctctgctgttgggaatgaaaggtgtccgccttgaagtgaaagggtccctgttcagctatgggcccctctgggacccccagcagggatgtcctgaaggctcctaacaagctggaaagcaaggaagctgccttgcctggaagtcaggatcgcccagccagggtggccgtcccatggcccagctgtgtgaggccctgggggtagctgtccacctaccctgcagggagtgcctctcctcagccatccgctgatccagtgcccagaagttgtcttcctctggcagatacaggaggaggatggcagttaggcagctcatgtccctgtagtagcccacctcctgcaagagccagagtcaccatggaagcatgtcacctgagagggctgaggccatctgggaggactcatgtcactggagaggacagaggtcacctgggagacctccctcaggccctaggggatttagggtgcagactctgcacccctcccctgaccctgggcatgaggactaagcaagtcccccacaactcagttgaaaagggacctggagggacttctgcagtgagtgtccaacctcacatggtctgaaggggcacaggcaaggatcattcacatcccctatcctgggccaggctgggaaggccagtgtgccaggactggggcagcacctgtgaactgcacccaccacaagggcaggtggtgggccactgatcaccacacagtgggtcctctgatggcccagaggctgcctgccaggcacaggagggcggctaggtccagaccacatgtgagcagcccatggagtgatctcagcggctctccctgcctggaatggtctgggaagtgggggccaagcaggaacagccacctgggtgacctcctccctgtctactgtgctcctacggggttaaggcaaaggggaaattggacccctgccaggtttccaataaaaaggcttcctcacgatgcaaactcatttcatgaaaaaaagcctggccccatcaggcacctcagcaacttgtcaaacatgtctcctgcaaggactatcttgtgtgcaacactgctaagctccttgtttggggtggcaccaggaggggagtgtcatttcttcttctgagacatggtggttgggtccaggtgacatcaacagtctgggccctgaaccctttccatctcagcgggaccccttgagacaccagcttcccttccttgcttgggtgtcgacgccagcagttctacctactacgttattacagtcagatcaggataaatgtcctctctctggaataaatgcagtgaccactgttctttgagcattatttatcttaaattattgttttaattagaaatgtatctaacttacattagccaaatttcctttcaatgtaaccaaatttcttttaagtgaaaattaaatatttaccttcatcaagcattctatgaatataaaatgtttatttttttcaactttagaagaaattgaaaatgtctacatgctactaatctaaaaaacaggctctgggtttatatggtgttaacctttcttccaaattttaaggaatagatatttaaatgccatccactttgtttgaaaatacataaaatgttttaagcttttgatctcaaaatttacgatagcacagctactccataatgaataaaccacagaatcaaaacgaagaaagattctacagaccagtctaaccaacaatacaattataaactagtggttcaaatatcaaaaaccaatttcaatgacaaatgcatggtatgtaaaccctgcaaatgtcaagtagaatatattatacttgaatgaaattatgagttgagagtaggaaacctatgtttaaccaagcaaattaaataaagtttatgaggaaattatactgctaatgttttattatttggcaagctattcagtggaacacaaagatattcttaatgaagttgaaaatatattttaaaatgtgactgaagtggattaaaaaataatgaggacatgaataactttaaaaagtattcagggataaagagagaaaaataaatttagatttcatacatacataaaatatatttaaaaagttgtgttttttggttgcttgaataaagggagcagatatttaaattccatgcctttcattttaaagtttaggaaatgcttatagctttccacactgacatttatactaacacagttaatctaatcgagggataacaaaatcaaaacaagcagaattctcttgaccaatctattttcttgatttttaaaagtcaatgtgctctcaaagaaacaaaactattattcatggattctgttatttgaaaatatttactgatcatttttaccttacaccaagtgatctccagctcgtggaaaaatatgtaaagttgcccagcttcattaagcttaaactcttctgaaggagaaaagaagcaatggagtagggacattaaagcaggagtgtggtgatatggctgagacttctacttgcacactgtggtagctgtgtggagactggattgaaaaaagggcaatgacagaagcttaaattagtatcaaatatggcaatcttataattttaagggtccttgaaataagaatgtataatagttctcattatttccccaagaaatctctgcacttggccttgtgagggaagtgctatagttaccaagtggtgggggtgggaaggtgaattttcaacaacatttggaattactacactttaaaggtaaagctggcaggaattccatacacatcagatctgaaaatgtgtgtgtgtgtgtgtgtgtgtgtctgtctgtctgtgcgtatttgtgtgtgtgtgaagcagggagagagagcaagagtgagagtgagcaagagagaggagagagggggagagaatcagacagatacaggaagagagtgacagagatatagagacagaattaaaaggggacaccaagaatattgagctgagaaactataaaatgggagttgccattaaacagaatggggaagagcaaatttggggagtttcagtggctccatacagacatattaattttgagattcctaactgatatccacgtggataagtcagggagtgttgggtgtagtgtccagtgtttaggtgtaatatgaaatatcaggaaattaatgacacaaaaattagtaagaaagcaaagataagaaagataagaagtgaaagtcctgagcctaatggtcctctaacatttgaaaaatagtaaagatgaaacctgcaaaaaaggactaggggtaattttcaaaaacgtggtggggggaaagtaagttaagtgttctggaattctataaaaaagttttacaaagagaaggtggagatagactgtgtgaaatgctgctgatatataaattaagatgaaggctgagaagttatggttcaatttataatttaacaatatggatagcacttatattttgatatgagcagctcgttggaatgagtaggtgagaaaccatattggagtggttgctgagatgaaagtctgatccctggattcttaaggaaaaattttattggactgcagaggcataaattggatttttaattctggagtcaggatgtgctcactaaacatgtgcccatcaatgcctcctcgcatttttttttagctaggtattctgttatcttttaataatataataattacctgcaaaacctacacccatgttgcagcaaaccaccatgacacatgtatacctgtgtaacaaaactgcatgttctgcacatttatcccagaacttaaagtagagagagagagagagagagagagagagagagagagagaaaacccagccaagtgcggtggctcatgactgtaatcccagagctttaggaggctgaaacaggtggaccatctgaggtcaggattgagaacagcttggccaatatggtgaaaccctgtctttactaaacatataaaaattagctgggtgtggtggggggcacctgtagtcccagctacttgagaggccaaggcaggagaatcacttgaacctggaaggcaaagactgcagtgagctaagatcacgcagcagcactacagcctgggtgacagggtgagacggtctcaaaaagaaaaacaaaaacaaaaaaacacccatttaattgacaaactttacaaagactgatactagaggttgttggagaggacgttgttccacatatcttatgagttaccgatggacaagtaagatggtaaaatgcctttgaaaaactgaccatacctgctatacttaaatattcagataccaaacacccagaaattccatcttgtcatttatttccacaagaaaaagcaagagacctgtattaaaatatccatttctattaaaaataatcacactaggtttcctgaaatttttttattggtagctcttgttttcagcagtacaacttctaacatatatgtgtatatatatttaatatatgtatatatgtatatatatttaatatatgtatatatgtatatatatttaatatatgtatatatgtatatatattagacagatatatatgtatattatacacatgcatatattatatattatgtatatatgtatataatacatatgcctatattatatattatgtatatatgtatataatacatatgcatatattatatattacgtatatatgtatatacacacatatgtatatgttatatatacacacatatgtatatatattatatatatacacacatatgtatatatgttatatatacacacatatgtatatatatacacacacatatgtatatatgtatctatgcataatatatgtatatgtattaggcagagttttgctcttgttgcccaggctggagtgcaatggtgcaatctcggctcactgccacctccacctcccgggttcaagcgattgtcctgcctctgcctcccgagtagctgggactacaggcttgtgccaccaccctcggctaattttgtatttttagtagagatggggtttcaccatgttggtcaggctggtctcgaactcctgacctcaggtgatccacctatcttggactcccaaagtgctgggattacaggtgtgagccactgtgcccggcctattttgtattttttaatctaccacactctaagaacacatattttaaatcaatttgtacattcagtgcctagaacaaaaccagcattttgtagattccaaagaattatttgttgtataaatgatgaataacttaaataagttattatttatcacatctatatacaaacaatatattacctgagaatacagtgataacatttgttatgtataaaatgatttcaatctcagttaaaaatattttttgcataagttattgtcatatgcagatgctcacattgttttgtttagatgaaaatgtttgtaactactatgcacatttttgttacttaagccttttggtcttgctgccgtagcaaatcctgtgcctcttaagaacatgaacctgttttacttcattttttagcagatttcttaatgaaatatataccatactattttgtttaacacataagcagacaccctgtcagaagcaaagagacatctactccaccattaccacccatgcctctgctaatgtggctgctgaagatgttacctagagcagaggactttgtgttcaacctaagcactttatatcctttattttcaattgggtaggagataaaataattcagcagcaataaaagtcacacttcttaaagttgcagtctcgccaatgcaccacaacgtagcagtctctcttgtgaggtatcatctggtgttcttcatctcaccaccaagatgattaagggacggggacacacaggtgaggtgggagtgaaagtttaacaagcaaaaggaggaagctctctgcagcagacaagggcgtccaagtggattgccgtttttacagttgaatcaaaaagcttttataagaaactcctctcagctatatataaaactgtcggcacaattccctttatatatccagctgtgggtatgtctctagtcaagcacaaagtgggcttctcttgtttctataactgtgggtttgttttaggtaagcccccctcctccctgcgcaagttcccacagagaccgccatgtatatgcctgaaaaagggaggaaaattttacctgggagcttgccaaatacacaaagaacagaaggcatctgtgctggaccctgcatgcttatctgttcagggcttatctgtaggtgcagtagttgtgatttttcaggcagacagcttccctgaggaccagtctcttacttgtttactcaaataattttcctttccttctccctcaacattgtgtagcaaaacagagtacacttctctttcccagtaaatcagtgttggtactccactctgaatacttgtattattggatttcttaggaaaaaaatatttgggatcataatttagatgccatcaatgaacaaaaatatgctacttcgtttcccctctcttctcttgttaccagacaatagctagttttcttttctctccaactccttttttctgtgcttctacctgattttttaaaaaaacttctacacatttccaatcttagtatagcagacatcaaatatgtggtcaaactacatacataagaagagttgaattatataattatattcaagcattttaaaataattccccttcagtttgttttgcagttattttacataatcaaatgtcttcctgatatacgtcccaacccagtggttgtcaagctctgctttgttttctaattgcatcagaattatccacaattctttttttttttttttttttttttttgagatggagtcttactgttgcccaggctggagtgcagtggtgtgatctcagctcactgtcatctctgcctccctgattcaagtgattctcctgcctcagcctcccaagtagctgggactacaggcatgtaccaccatgcctggctaatttttgtatttttagtagagatgaggtttcaccatgttggccaggctggttttgaattcctgacctcaagtgatccactgcctgggcctctcaaagtaagaattatccaaaattcttatgataaatatggataaatcagcacaactcaagatttaataaaaatttccaagagaagaaacccaggaatatgcattgaaaacgtctccctcaggtgattctgatgtgatatgtggtctgagtttaaaatgcaaggaaaattaccttccctgccctccagttggcccttatgtccagatgtccctcttcccctttctcattgtgctctctcctgtgcctttgttctattctccctccacttctcatccagatgccaagccctcttccatcaatttcctaaaactccaaatggtcagttgcctctgtcccatgaacaagttactcaggcaaacgtagaatttcggcttggaccaagctgaatcaagagctgcaattaaagatttccctaagcccagaggggaccagcaaatacttatagaagattttggatttcctccgaatgcataaggctctgggtaacctgatgctatagaccaaatgttattgtccctctcaaattcaagtgttgaaatctaattccctatgtgatgatatttggaggtagggccttggggaatgattagatcatgaaggcagggaccacatgagtgggattagtagcccctattgaaggcaccatagagagctccctcatctcttctgtcatgtgaggacatggtagaaacatggctatgaaccacaaagcaagcccacaccagacacagaatctgctaaccacttgaccttgaattttgccatctccagaactgagagaaacaaatttgtttataagcttcctcatctatggcattctgttttgaccccagattagctaaaaacaccaaaatatcaacttgtacaccaaattttcgaaatggatgctaaaactttgatggcaaaaggtgactgatctgcctgagaaatgaacctacatgatccctctttccacaaagctggagggagagtcaacacaagcaaaaataggtcaaagtcttctaaaagccgtacctgaagggttttcaatatcacttgatcagatggtaatttagtcacccaaagaaccacaacaaaacacacaactatcagaggttttcaacgtcacctcaaaaacaccatctacaatattagggagtgaaagaagtcatagaagtttcaaaaagtcaaactttatttcagtgttatggtagaaatttgaaattcttagttaagctatgaataaatccttgggcaggtgcaggcatggagattctggagtgctgctgctgagtttaagagcttcctttggagatgccccctggccccctcaacccctgtccacctgtcaagaagaggccatcctgggcagcacattagaggcaaatggcccagatgcccagctgagggcaaacctccattcctggaggaggaggtcacctctgggagccggaggacctgctggaacccctgctcacaggctccttttcttgctctccagcacctcctgcaggcaggcaaacacccccagcagcagtagcagcagggccttcagcagcagggctgctgctctgctgaatgagagaagtccctctccagtgaggcagaggagcccaggttgcacaccctggtctctgcctccatagcttccactgtgcccaggactgggagcagtgtgggagctgctggctggagctgtgctggtcaccccctctctgccacctctagctccagccacactttcagctccagggctgaggccggtggctctacaggaggtgccatggagtcaggcagcttctcactgggctggtcctgtgcagtcccagggcagcggcaggagggctctggagcttcctctagctccagcgctgtccctggaaggggctctgcccctggtgctggcactggctcaacagctggcactggaaatagctgtgtttctgcacctgaagcaggagctgaaaaaggagagaggtcaccaatatcactcactttccactggaatttccaaacatgaaaacaacctcactgaatttaaaggaatttcagcctgaaaacattgtccctggaaagacttccagactgcaggtgacctcaccatgtgcctgtgtctcaatgagctccagaggctccagctggacaaggacaatgtgcagatgtggccctggtgggatcactggtgaggcctggcctggtagctccatctggggcctgatgtctacctggtgactcctgtcctgtggtacctgggggggccttctgtcaaatggccagagacatctggggtgagggatgagcctacaagggcatcgttggaaaagaaaggctctcactcctgccattcctgaagcaggagacttgagatatggggatgcagcacaagaacatcttgctctcttgagcatttcccaccaagtgagctggctatggggctaactctaggatgtgggtgcctggttatcgggattcttttttttttttttttttttgagacattgtctcattctgttggccagggtggagtgcagtggcatgatctcggctcactgcaacttccgcctattgggttcaatcaattctcctgcctcagtctcctgagtagctgggattacaggcacgagacacgcaccacaacacctggctagtttttttgtgtttgttttttgtttgtttgtttgttttgagacagagtctcgctctgtcacccaggctggatggagtgcagtggcgtgatctgggctcactgcaagctccgtgtcctgggttcatgcctttctcctgcctcagcctcccgagtagctgggactataggcgcccaccactacccccggctaatttttgcatttttagtagagacggggtttcactgtgttagccaggatggtctcgatctcctgaccttgtttgctttttgtatttttagtagacatgtggttttaccatgttgttcaggctggtctcgatctcctgatttcatgatcctcctgcctcagcctcccaaagtgctgggattacaggtgtgagccaccgtgcctggcctggttaccagaattctaagttctgttagggtctgttgccaaagaagtgaggttgcttctttaaggttccatcccctcagcctcctccttccagaagacctactcaggaccccagtgggctgctgactgctcatcctccccacaggtcaactccttacctgtacacagttatgtccacccagggcctacttggacacctgcacctgatgttcaccaggggcctaggaatccacttggggcctgggatcctacaggggactaatgttaccctgcagattgagtagccacctggggaccaggtatcaacctggggactgtggttgacctgtgggttaatgtccacctggggactggttattcagctgaggcctgatgcgtacctggggccgaatgtccccctcagggtgaattccacctcagacctgtatgtccacctggggcctgatgtctgccttagatctatgtcccactggggccttgtgatcaccggggactggtatccagctgtggcctgatgacctactgcatcctgttgctcacctacggcctggtgtctacctggggcttggtgatcgcctgggaactggatatcaacctggggcctgggtgtccacttaaggcctgatgtgtgcctggggcctgactgtccacctggggactgggtgtccaccttgggtctgatgactacctgaagttaggtatctacctaaggcttggtgtctacctgtggcctgatgtccacatgagtctggggttcagttggggcctgctgtacatctgggaccttggtgtctatctgaggcctgatgtctacctggtgactgccatcctcttgaggcctgatatccacctgggaatggtttatccatggaaatggttatctccgcctggggctggatgttgcccaggggctagatgtccacctgtggccccgtgttcacctagtgcctgatgtccacctggggcatggtgttcacctgagacccgggtatttacatagggcctgatgtccagctggtgcctaggtgcccactgggggccttgtgttaacctggggactggtatccagctgggtcctaatgaccacctgggttgaattattcacctagagtttggtattcacttagggcttgagtgtcagccttggacatggtgtccacctgggccttggttatcaaacaaggggtttggtatccagttgagacatcatttgcacctggggtctgagtgttcgcatgaggccagatgaccactgggggcctgaatgtcaacctggtgtctgaaattcactggaagactaggtatctagctggggcctgatgtccacctgggactaggtgtcaacatgtggcctgatgtaaacctctagttgagtgtccaccttgggcctgatgtccactgggggactgatgttcccctttgatctgatgtctacctggaaaccgtgtattcacccatggcctgatggtcacctggggttgaatgtccaactgtggccagatgtgcacccggattctgggcatccacctggggcctgatgttcagctggggcctggagttcacctgaggcatgatgcctacctgaagcttaatgttcatctgagtgctggatgttcacctggggcctgatatccacctggacccttctcaggcctgatgtccacaagttggcctggtattcatctggggccttcgtgttaacctgtggcctaatgtactcctgggttctagtgtcctcttgggacctgatgtctaccaggatccaggtatccacctggggctcagtatccacctagggcttgatattcacctggggcctaggaatccacttgataactggtgccatcggggtcctgatgttcaccttgggactgggtaaccacctgaggcctgatgtccacttagggcataagtgtttatctggggtctagtgttcacatagggtctgatgtcaaccttgagactaggtattcaccaggggactagtgtccagctggggccagatgttcgcttggggcctggtgtcaacttggagcatggttgtcaacctaggatctgatgtccagtccagtgtccaccttgggcctgtttactacccagggcctctgtgtccacatagaccgtggtgtcaatctggggcctgggtatttaccgggcgcctggatattcattggtacattatgtctactggagtctttgtgtcaatctgagctctgatgtctacctagagattgggtatccatctaaggcctggtgtttacatggggcctgtaacatgaggttccagatgaactcagatgtccacctgaggcctgatgtccacctgagttctgagtgttcatatagggcctgctgtcaacttgggacctaagtatttacctagggcctgggtgtccacctggggcctgacttccaactagatcttgtgtcaacatggggcctgatgtccactttgggcctaggtaacttcctgatgactaatgcccacatggctcctaaggaccatctgaggcctggtattaatttagagactggtatccacctggggtccaggtatccacttgggacctgatgttcacctggagtgtaggaattcacgtggggcctggtatccaccttcagggtgtgtatccaattgagtgctggtgtccacctggagtcccgtgtatacctggggcctgatgtacacatggagcctgggagtccatccaggacctgatgttcagataagggctggcgttctcctggcctggtgtccacatggagcctgggtgtacacttgaagcctgatatcccaggtggatacctgggccccagtggtcatcagatcctaggaacctctcaggccccaggtgcacataaagctccaagtggccacctaggccacaggttgatacacagggtccaggtggacactggttgcaagttgaacaccaggcccctggtgaacaccaagccccaggtgtctgcctagtcctcaagtggacaccaggctctagattgacacacaggtaccaggtggatatcaggccacaggtgaacaccaggccccaggtggttgggttacttatagcataggtggccatcagttcccaggtctatatccactccccacttgaaaatcaggatccaggtggatacccacgtcctaggtgaacaccaggttccaaatgaacatcaggctccaagtgaacacacaggccccagttcaataccagcctcaggtagacatcaggccccaggtgcaccccaggcccaatgtgcatgcctagtctcttggaatacatcattttcaaggtggacacccagattcctcaaagacatctggtgccaggtggatatctggctgcaggtggacatcaggccccaggtggagacccagtacacaggtgtaaatcaggctccagtatttcatcaggccccagtttaacacttgactaaaggtgtgcatcaagacccaggttgacagccaggcttcaggtgcacactaggcccaaagtgtacacctgtgccaaggtgggcatcaggcccaaggtgtacaccagaccccaagtggacatcaggttccaggttgacaccagtctctaggtagatccttaaaccccagttggtcatcaggcccaaggtggataccttgaccccagggggtcaccaggtctcaggtcgacactaaaccctaggttcaaggtctgagatggtttcagcccccatgtggactttagtcataaggagcttacctaggccctaagtggacatcaggccccaggttgacacaatgaaccatgtagaagtcaggctgtaagtagacacccaggccctaggtaaatactttggtcccaagccaacatcaggccctatgtggacacccagactccaggcagatgtcaggccccaggtgaacactgaactcagggcggtcatcaggccctaggttgacacataggcctcaggtagacaacaggcacaggtgaacttcaggctccagatgaacgtcgggctccaggaagaaatctgtgccccagttaaacaccgggtcttaggtagacatcaggcctcaaatggatgcccaggccccaggtggatataaggcctcaggcaaacaccaggccccaggtagacattagacacgagatggacactcaagccacaagtgaacatctgtccccaggtggacatccacccaaggtggacatcaggccagagatgtacacccaggccccaggagaaccccaggccccaggaggacactcaagtgccagaaggacacccagtccctaggtaactacaaggccccaagtggacatgatattccagatggatatgaggccccaagtggatactaggcccaggtggaccccagatctcaggggcacaccaggccccaggggaacaccaggccctaggtaagcatgcagtcccaggtggacatcagttgccaggaggacaccaggacccagttgctcatcaagccacagctgaacaccagttccccatgaacaccagtcctcaggtgggcacctagtcctcttgtgtgcatcaggtgccaggctgacataggcaccagctgaactctgggcctcaggtgaacatcagatcccaggttgtcacccaggccccaggtgaacaccaggttttaggtggacatgaggccctaggtggatgtctatgctcctggtgaacctcaggccctagtggacactcaggccctttatagacatctggctccatgtgcactcccagggcccaggtagacatgaggccccagaggaacgccagtccttaatcacctaagactgaattcccctagggctggagactgagtattcaccttgggccaaggaatctacctggggccagatgtcgatctggggcctgatgtctactcaggttcagctgtccacctagggcagggtgtttttctgggacccagagtctacctgaaatcttggtatcaacctagggcctatgtgtccacttggagtctgatgtgcacctgaagcctgagttttcacctgggatctgatgagcacctggggcccaggtttccatctgaaacatcaggctctagttatacatctgggccccaggtatacactaggcaccaaaagaactccagcccctatcttaacatgaggtcctaggtgaatgcccaggcctcatgtctacataaggcctcaggtagacatgactccaggcgggcatcaggcctgatattggctctatgtctccacccaaatctcatgttgaattgtaatccccacgggttgaagaatgggcctggtgaatggtgattgaatcatgggggcagacttcccacttggtgttctcgtgatagagttcttacaagacctggttatttgaaagtgtgtagcacatccccattctgtctccctcctcctcccacatggtaaaaagggcttacttcctcttggctttacatcatgattgtaagtgtcctgagcccgcccagtcatgctccctattaagcctgaagaactgtgggtcagttaaacctcttttcctcataagttgcctaatatcaggtagttttttataactgtgaaaatggactaatacaaggccttaggataacaaccatgcttcaggccataggtggacatctggctgcaactggacactattccccaggtggatacctaggctcaaggttgacattagtccccaggtaaacaacaagccccaggtgaatacctatgccctagtagacatcaggcctcaggctgacactcagtctaacctcaacattaggctccaggtggacgcccagactccaggtggatactagaccccaggggtacaccagactcctggtaggcataaggccccaggaggacactagaatccaggtgtacataaagccactggttgacaccaagccctcagatgaacaccaggccaactagtggatgttaggcacatgagaatacttgggcaccaggtaggtatcaggccccaggtaaacatcaaacttcaggtggacatcattctccatgtgaactctagccccagctaaacatcaggctccaggtggaagcccagaccccaggagcacttctggccacagttgaacatctgtctccaggtgaatatcagaccatggatggatagcaagtccccaggtggacatcaggtcaaaagtgaatataagtctctaggaagacatctggccccaggtggatactgaactagaggtttacatcaggccctaggttgacagcaaggcccaggtagaccgcaggccccaggcgaagaccaggcccaggtggatactgaactagaggtttacatcagaccccagattgacattcagtccccaggtggtcatgacacctcaactggacaccaagtccgtaggtgtcccaggtgtacaccaggtcaaagatgaacacaagacctaaggttgacactgaagccccaagtggacatgaggccctaggtgaataatatgacccaggggatcattaggacccagcttcataccagtccccaggtttacacgaggcccccagtaggttcctaagctctagttggacatgaggtctccagtagacacccaggagtaaggtggacatcaagcatcagatggacgtctggccatggatgaacatcaagcctcacatggatacctagtccgcaggtagacatcaggccccagtttgacatcagtttctggatggatccccaagccccaggtggatatccagtctccagctgaacatcagcccctcgtggacacccaggccccaggtggatatcaggtgtcaggtgaacacaagtccctaggcagacgtcaggcaccaggtgcacactcagaccccaagaggacatctgtccccaggttgacatcactctcaaggtgtacattaggcaacagatatacactcaggtccaaggcagacacgagtccctagtaaaactcaaggccccaggaggatactcaagccctaggtggatgcccagaacccaggtaattacaaggccccaggtggatatcagattcccgatgaacattaggccccaagtggatacctaggcaccaggtagacaccaggccccaggtgcataccccagtctcaggtgcacactaggcccccagtgaacactggctccaggtgagcacccagtccaaggtagacaccgtgacccaggtggtcattaggccacagctgaacaccaatcttgagtgaataccagatcccaggtgggtacctagtccaggtggatattgggccccaagtggacacccagcccccaggtgaacatcaagcttcaggtggacatcatgcctcaggtgaactccgggtcccagcccagctgaacatcaggctgcaggtggatgcctaggttccaggtgcacaacaagtcacagttggacattcagccccaggtgaacatcaggccatgggtggataaacagtccacaggtggacatcaggtcaaaggtgaacatcagtactcaggtggacatcaggctccaggttgacatcaagcccaaggtggacactgaactagaggtttacatcaggccccaggttgacacccaggctcaggtggacaataggccccaggtggatacctaggcccctagtaaacctcagattctaggttgacattcaggcccccagtagtcatttggccccaagtggacactcaggcgccaggttcacatgatgtcttaactggacaccaaggggccagtttgatacccaatcctatgtgggtgccaggtccaaggttacactcaagccccaagtggacaccaggccccaggtgaataatacaacccaggtggtcattaggccccagaatgacaccagtccccaggttaacaggaagcccccagtgggtacctaggccccagctggacaccaggcctaatgtggacaaacaggatcaagatggacatcaggactcaggtggacatctggtgacaggtggacaacaagcctggtgtgtaccttgtccccgggtggtcatcaggccccagttcaacaccagtccctgagtggattcctcggctccaggtggacatccggtcttcagctgaacatcagaccccaggtgaacaccaggtcttaggtggacattaggcccctggtggatataaagtaccagtggacatccatgctgcaggtggacacccagggcccagatgggcatcaggccccgtttggacattgaggccccaggtggatatcaggcctcaggtgaaccctaggtccaacatagacatcaggccttaggttgacactcaagcaccagatggactgctgcacctaagcagaaaacagacccttatctggatatctaagatacatgtatacaacaagccccaggctgacatccagaccccaggtggacaccataccccaggtgaacagcaggcaacagtttggcaccaagtacctaagtgaaacaaagccttaggtgattaccaggccataggtagtcattagtctccagctgaacaatagtccctaggtggatacccaggccccaggtggacactagaccccagattaacacaaaaaccaagtaaaaaatcaagccccaagtggacaaccaggccctaggtaaatacacaaatctcaagctgacaccaggccctatttggacacccaagccctaggtggacttcggaccccaggtgaacactgaactctagaaggtcttcaggccctgtgttgactacctggccccaaggagacaccaggcatagatgaacttcaggcaccagctgtacatcaggttccaggcaaatgtccaggccccaggtggatatcacacctcagatgaacaccaggccccaggtagacatcaaaaaccaggtggacactcaggcccctactgaatatccgtccccaggtggacatctgtcccaaggtggacacgaggccacagatgtacacttaagcctaaggcagaccccagtccccaggaaaactccaggctccatgagggcactcagaccccagatggatgcactggtcctaggtaaatacaaggccccaggtagacagcaggccccagtgaacactggagcccaggtgggtacctagtccccaggtgtgcatcaggcagaaggttgacccagtccccagctgaactctgggccccagctgaacatcataacccagatggtcacccaggctccaggtgaacacatggtcttaggtggacatcaggccccacatgaacacccaagccccaggtagagatcaggccttaggtgtacaccagacctcaggtgggcctctggctccagatggccataggtggataactaagcctctcgtggatatcaggccccaggtgggcaccaggctccaggcgaacatctagccccagggggacatccagcccctggtggacatcagggctcacatggataaacagtttacagatggacacctgccacaggtgcctcacctctacttcctgaaacctcacttcccctcatgggccttctgtccgacttgcggtacccctagccgccctaggaacacactggactcgaaccaggggtgccagggtccctggggctcagcgcaagggttcatgggaatacactttcgtccgtgggggacccagtcctcacttctcggcggcgcagtttttttttttctctgccccaggtgcctcaccttcccctcatgggccttctgtccaccttgtggtacccctggcggcccgaggcgcaccctgggctcgaaccagggatgccagggtccccagggcacagcgcaagggctgatggggagacactttcttccgtgggggtcccaggccccgcttctccgtggcgcgtttttttttccctctgccccaggtgggtcaccttcccctcatgggtcttctgcccgctttggggtacccctagtggccccaggcacacgctgggctcaaataagggtcgccagggtccccggggcccagcgcaagggttgatgggaagacactttcacccgtgggggacccaggccccgcttctccgcagcgctgtgttttttttttttttctctaccccaggtgactcaccttcccctcatgggccttctgcccgctttgggttacccctagcaggccagaggcgcaccctggattcgagccagggacgacagggtccccggggcccagcacaagggcggatgagacggcactttcgtccttgggggacccaggccctgcttctctgtggcgcggttttttttttcttttatgccacaggtgccatacctctcctccctcaaacctcaccttcccctcataggctttctgcccgccatggggtaccccaagaggcccgaagcgcaccctggtcttgaaccagggatgccagggtcccctgggcccagctcaggggctgatgggaagacactttcttccgtgggggacccaggccccgcttctccgcggcacagttttttttttctctgcctcaggtgcctcacctacccctcatgggccttctgcccgcttctgggtacccctagcgggcccaaggcgcaccctgggctcaaaccagggtcgccagtgtccgcgaggtccagcgcaatgcctgatgggaaggcactttcgtcagtgggggacacaggcccagcttcactgcggcgcggttttttttttttctgccacaggtgcctcaccttcccctcatgggctttctgtccgccttggggtacccccagcggcccgaggcgcaccctgggctcgaaccagggatgccagggtccctggggcctagcaccgggtctgatgggaaggcactttctttcgtggggaacccaggcctcccttctccgtggcgaggttttttccttttttctctgccccaggtgcctcaccttcccctcatgggcttctgcccactttggggtacggctagcggcccgaggcgcacactgggttcgaaccagggtcgccagggtgcacggggccaagcgcaggggctaatggtaaagcactttcgtccgtgggggacccaggccccccttctccgtggcgcgttttttttttctgccataggtgcctcacctcccttccctcaaacctccccttcgcctcataggccttctgcccgccttggggtacccctagcggcccgaggcgaaccatggggtcgaaccagggacgccagggttcccggggcccagtgcaagggctgataggaagacactttcgtccgtgggggacccaggcaccgcttctccgcggcgcagttttttttttcttttggctgccccaggtacctcaccttcccctcatgagccatctgcctgctttggggtacccctagtggaccgaggcgcaccctcggctcgaatcagggtcgtcagggtccccggggcgcagcgcaagggctgatgggaagacactttcgtccgtggcggacccaggccccgcttctctgcggtgcggttttttttttttttttttttttttgtctgccacaggtgcctcacctctcctccctcaaacctcaacttcccctcatgggctttctgcctgcctcggggtacccctaacggcccgaggcgcaccgtgggtttgagtcaaggtcgccagggtccacggggctcagcgcagggcctgatgggaaggcaccttcgtccgtgggggacccatgccctgcttctccgtggcgcgttttttttttctgccacaggtgcctcaccgctcctccctcaaacctcaccttcccctcatgggccttctgtctgccttggggtacacctagcggcccgaggtgcactgtgggctcgaaccagggaagccagggtccctgtggcccagcgcaagggctgatgggaagacactttcgtccgtggggggacccagtccccgcttctccgcggcgaggtgttttttttttttctctgccccaggtgcctcaccttcccctcataggccttctgcacactttggggtacccctagcggcccgaggcgcaccctgggctcgaaccatggaggccaggttccatggggccaagcgcagtggctgatgggaaggcactttcgtccctgggagacccaggcaccaattctccgctgcgcgttttttttttttttttttttttttttttttttttctgccacaggtgcctcatctctcctgcctcaaacctcagctgaaacttttgggccttctttcctccttggggtactcgtagcagcctgaggcgcagcgtgggctcgaaccagggatgtcagcgtcctcgggacccagctcaagggctgacggaaagacactttcgtcagtgggggacccaggccccgcttctccgctgcgcggtttttcttctttctctgccgcagatgcctcaccttcccctcatgggctttctgctctccttggggtacccctagcgggtccaaggtgtaccctggtttccagccagggacaccaggttccccagggcccagcgcaggggctgatgggaaggcaccttcgtccgtggaggagccaggccccgcttttctgcaagcgcggttttttttttcctttgccccaggtgtcttaccttcctctcatgggccttctgccggcttctgggtaaccctagcgggcgcgaagcgcacctggggctcgaaccagggttgccagggtccatggggcccagggcaggggctgatgggaagacactttcatccgtgggggacccaggtcccgcttctttgcggcgcggtttttttttttctctgccccaggtgtctcaccttcccctaatgagcattctgcccgctttgggatacccttattgggcacgaggcgcaccctgggctctaaccagggtcgccagtgtccatggggcccagcgcaggggctgatgggaaggcactttcgtccgttggggacccaggccccgcttctccgcggcgtgtttttttttttttttttttttcctgccacagttgcctcacgtctcctccctcaaacctcaccttcccctcatgggccttctgtccgacttggggtacccctagtggccagacgcacaccctgggttcgaaactgggacaccagggtccccggggcccagcgcaagggctgatgcgaagacactttcttcctcggggacccaggctctgcttctctgcgacgtttttgtttttgtttttttcgcttttccccaggtgcctcaccttcccctcatgggctttctgcccaccttgaggtaccactagcgggcctgaagcgcaccctggtttcgagccagggacgctagggtctccggggcccagttcagggctgatgggtagggacgttcgtctgtgggggacccaggccccacttctgggcggcgcagtttttttatttttttctctgccccaggtgtctcacctttccctcatgggccttctgtctgccttggggtacccctagcaggccgaggcgcacgctgggctcgagccagggataccagggtccctggggcgcagcgcaagcgctgatgtgaggacagtttcttctgtgggggagccaggccccgcttataggcggcgcggttttttttttttttttttttctctgccccaggtgcatcaccttcccctcatgggccttctgcccgcttttgggcacccctagcggcctgaagcgcaccctggtctcgaaccaggaatgccagggtcacctgggcccagcgcaagggctaatgggaagacacttttgtccgttggggacccaggctctgcttctccgtggtgcggtttttttttttttctgccacaggtgcctcacctcgccttcctcaaacctcaactgcccctcatgggatttctgcccgcttgtcttccgaggctgcggtgtggatctcgcactgcggccgcctcgccttggctggggagaacctcggtgggtaggattcagaggggcttttggtttcccgttttccacactgaacacttctaactggtctctgaccctgattattaagggctgcaaacaggaaggattttattcaccactgatgcggctccgagtagtcccaaagcgaggcagtgcccacaaggtctgtgctgagaacgctgctctgccttcgcggtgtctcccgggtgtgtgctgagcagaacgcagctccgccctcgcggtgcccctggcccgccctcccgggtctgtgctgaggagaacatgctccgcttcgctgtatctccgaagtctgtgcagaggagaactcagctccgccctggcaatgctctccgggtctgtgctgaggagaaggcagctccgccctcgcaaaggcacagggcgccggcgcaggcgcagagaggcgcacgggggtacccctagcgggctcgaggcccacccgtggcttgaaccagggtctccagggtccacagggcccagagcaggagctgatgggaaggcattttcatcgtgggggacccaggccctgcttctctgtggcgcgggttgtttttttttctttttctgtgacaggtgcctcaccactcctccctcaaaactcactttccctcatgggctttgtgctcccaaagctccccttggggtgcacgtagcggctgaggcacaccctgagctcgaaccagggacaccagggtccccgggtcccagtgcagggactgatgggaagacactttcgtccgtggggaatcaggccgcgcttctctgcggcgaagttttttttttctctgccccaggtgcctcgccttccccttatgggctttctgcccaccttggggtaacactagtggcccgaggcgtaccctgggatcaaaccagggacgccagggacctcactgccaagcgaacgggctaaggagaagacaatttcctccgtgagggacccaggcactgcttctcggcggcgcgtttctttactttctctgcctcaggtgcctcaccttccgctcatggaccatttgttcactttctggtaaccgcaagcggtcccgaagcgcaccctgggctcgaaccagggtcgtcactgtccactctgcccagggtacagcataatgggaaggcactttcatccatgggggacccaggccccgcttgtctgaggcgaggtctcctgttttttttctgcccctggtgcctcacctctattcccacaaacttcaaattcaactcatgggccttctgtccgagttggggtacccctagtggcccgacgcgcaccctgggcgccaacgacggatgccagggtccctggggaccagcgcaagggctgatgggaagacattttcgtcagtagatgacccagaaacctcttggcaatgcatttttttctctgccccaggtgcctcaacttccccccatcagcctcctgtctctctgcacctgcgccggcgccgtgctcttctctgcgccgccaccgttgctcggggatgggtccctgagacttggcgaagtaggagtactggactcgtgcacaggccctgtctcgcaggttttcaggtgagcttggcgtttcctccgctttgaggggcaggtctccagtggcccccgggcgcaggcctggacatcactgtccgtctcgtcgtcgcccactacggcctcagagacacaggctcactgcatgtgctcttgggggacgtcagtgccacgtgtggtcacactggctccggctcggactagcctctgtctctctttgcccgtgtctccagaagccgcgtcgagatgccggagcccccgggccttggagatgaaggcaggcccctgctccacccaggaaggagggaggcagtgggctcgtgggtcagtgcctttgcaggcgacagcacgccttgcggccctggggatctttctgtgccccggcgagagcctttccgcctcactgcattgtaaccccattcccgatcaccgggtgggatccatcatcggatcccaagaggagtccgcgcagcccagccaacacccgaagctcctccttcaccgagaacccaagcagaagaccgatcaaggaggtcctgacgacaggactcctatgggtccgaccctgggtctcccgcaggcccctctggtagtcctcttcccacccgccgcccggggctgcgccgcagccgccgccgcaacctccagcaccgccgcaccagtccccgcagccgccgcgtcgccgccattttttaaagggtccgcagcctgactctgccgagtaaggggggtggggcgggtgagtcggcctcgccagtgcgcatgcgcgaggcccgagccgccgctttggtcacagtgaccgccaccgttgcccgggtatgggtccctgagacttggcgaagtaggagccctgtgtgatcgtgcgtcagagtcggggctgagaccagccctggccagggcagttaccaggacggtctccggaggccgggattcgcggagggtccaccagcaggaagaaaccccaggaggaagaaacctcagacagatcgccggggaggcagcgcgggatcccagcctcaggcgtgcgcggacggtgtgcgggtgagtctccccaaaagtggcgcccttgtgatgtcaaggacaggtctccctgtgtgcccgtgggctgctgtctcaccggtggctcgtagtcgcggagactagaacccggcagcttcaggggctgcctgggggtgggtgttacctgctgtatgtctgtgtccgttatgggggtgtgtgtgtgtctgtgtgtctgcgtgtgtgtgtgcgcgcgcgcgcgtgtctgtgtgcccactaccgtctctctcttaagtctctctctctctctctctctctctccctctctcccttctcgctctttccgtcgccctctctttctgtctctgtccgtctgtgtgtgcgtgcgccttgggacacatgttccctgtgcgccggaggctgggtttcttgcacgtcggcctttcttctggtcagcctctccccgcgtctctgcctgggtgttgtggccggttggcaatcgttttcccggcggttccggcttgggggtctgtgaaggcctgggcaacgtgggcatctgcgtcggagccgcaggggttttcattccctccccatccggagcagcctctttgctaggctagatccagacgaccgctccccaaccaaggacaacggcctcccaggcgctcattgtccacccgcaggagggtgcccgcagaccttccagaagatgcttctcacgcctcttgccctgccctctgccctcatggagaaatctagccacagctcgacgcagggacggagaaggaagccggcaaggggatggggcaagcctctctctcactcaaaggcagtatagaagtccaccacagaggcatatccagtatggtgcccaccacctcatcttggggctgggtgaagggcaagtggcactgcaggaaatagtagccttgttctctgtcctcaatttgttccaagattgcggcccacaccagtgcttgggcttgtgagaatggagggctctccaacagttcagaaacaagcagtctgccgcagaggtgagaagagcaaaagacacccccacctgtgcttttccatggaacatcaagtccctcagagtataatgtctgctgggttcttgcttccttatttttctgtgttcaaatttcttcttgtggtgctctagcacacttccgtctatatagatattggaattaacgattatttatccataactttgctttctctttctgagaataactagagtcaaatatctatagtcagtcatattgaagaaaaacctcagaaatatacttcttagtaactcaacacccaagagcaaatcataatggaaattataaaatatttttaattaaaaaatgtatactacattataaaatgtgtcattttagaggaaaatgtagaaccttaaattcttattttatgaggacaacaaattaatttttaaaatgttttgaatttattggtagaagttagaaatatcaacagaaataaaaggaaataataaatacatgcatagtgattaagaatacagggaaagaaaagtcaagaaatatggccaaaagtttgttagttgttgtaggagccatacaataacaaaactctggagaaatggcttgataaaattaagagaagaaacaagtatgccatctcaggaatcaaaataggaaataattatacatcaggtgtcaagaattttttttgttttttggaaaggatctgttggtaattattttaggtttttgggctatatggtttgttgcaactaatcaattctattgttgtggcataaattgacagtatgtcaatgaatgagcatgacagtgttccagtaatactttatttataaatactgtctggcttatttgccacagtttattgagttttgttataaataatacaaatatcaagaaggtaaattagtgtagtatgaaaacgtttaattcaataaatttggaaatatatgtaaaatgtgtacaattacttgaaacatgcatttttccaaaagtaacctaaagtgaaaagaaaaatctgaattgtgctacaacaaatgcatgtaatcagtagtcagaaatcatatcataaagataatttcaagccatgatgactttactggcaagttgtttcaaacatgaaacaaaacaataattccaatcttacatacaattctttctgagcatgaaacaggaaagaacatactctattttattttattatgctattatgactctgatattataacctgacaaggatagtaaagggaaagtaaattaaacaccaatgtaatttatgaaaatattgaaggaaaacttaaaaaagttccatgcagaaataagcaatgcattaaaatgtaagacatcacagccaatgtttattctaagaaaccctgggaagcaataatggcctcatgtaaaggtatcaattaatatgatacaccacaacaaataacttaacaatattataagcatatttaattttattttcttaaaaagtcatacattttaacaacccgaaattaaaagagaatctagtttaactgataacatttgttttcaaaagttctattgaaattataacacttaacaatggaatgttcaaatatttcctttgtgattgggaacaaaataaacatagatggtacaagcaattttatttatccttttgcaggtcttagacactgggataggattgtaaatattaaaaaaataagaattatgaaagagaaaacagattactatgttaccgatgacactaagtacacagaaaattcaaaatgattctaagatacattatactaatgaatatgagcttttagcaagatgctttgacacaaatatattatgcaatattgaaatgcatttcaaataagtagagaactttatttagatgtgtcagtgtggcttactctcacaaacataatatttagtggcatgattaagtcacaaaagaatatgtacagtataactcagtttaaataaagttcaaataaacatagacataacattgacataaatatattcttgaattgaaagactttaatgaaatcacttctccccaaaattaatctttgtaactagtgcatccaaagtaaaacccagtaaggtttgatttagatattgacaagctaattctagaatttatgtaaactctaaaaatattaaaattcagttaataatttattgaggaaggaaaaatatattacaggaaatataagaattaatgcaatgtggtattaacaaagtaataaataatcaatgaaatggaataggtagactacagtaaggaaaatataagaacccatgatatgtaagaaagctagtattatagatcagtggtgaaaaataaatttgccaataaatgagagtgagaaaactggctatacatatggaaaataattaaagtgattctttaccttatataatatttaacaatcaattccttggcaatcaatatttaaatgtaaagccaggcaaaaattacagaaaacccgacagtaaaacaaagaaaatggcttgcacatgtgctttataaaatgtacaatgtaagtgtccaccatacatatttagaatcactttaacttatttttaacacaaaaatgcaaatgaaaatgttttatatgtacattattacttatacaagagattgaccaaaaacggtctgacaagacagacttctggcaaacatatagagcaataataatttcatatgctttcctggaaatggaaattatatccgttttaaaaagaggcttgtattacccagtaatattgaagatgaccatatattctaatcagcaattggctttcactccttattttgtatgtacatggttggccattaagaaatgtaatccaaaatatttacaggctcagttaagtactataagcaatgcaaaagttaaacaacagtagaatgtggtagattcatacagtggaatactacactttagaaaaaaaatagataactttatttagatatgttaatgtggcttactctcacaaacataatatgcagtggtatgattaagtcacaaaagaatatgtacaatataattcagtttaaataaagttcaagaacacaaaacagcaagttggattgtttataaaaggtttactggacactaaatctataaagataataatagaaattattttaacacatccttcaattacctttcattcctccagaaatttgttgaaacctcttgaatgcctatgacctttctcatttcctccactgtttaatttccttttatactttgtttaaaactttgaatggacatatgagagatgaagtcatatttttctaaataagttcaaaaatattttgctttaaaatataagtagtgattaaatttctaagaattgagcaatagttgaatgttataaatttagttttcatgaatatttctctctccacatttcttcttctcaacttgctcatatcccttcaaatgacaaaatacttagaagtatttgagtcaagttagatatatttttgaagatattatttgcttatttatctatgagaggtcaacaacaacttccatgaatattaggaaagcaaatgtcggtagctctattcacttcaatattgaattcacctatatctgaaatttaaatgtcagtgataagactgacagaaagcgtcacacactttaggtaacacagcactaagtggcaacactttaatattgtcactattacatttttcagatatacaatatatactttaccaagaatcctagtctattatgttctaaggatgagctgtctttatacaaattcacaataaatagctgtgtaaataagagttaccatttttattttatagcataaaatgtatttcaattagttgtacaaatcagatatgttataaaagaaacatctttcctattattgaattacccaaagttgcttacctaacatagaatcttgtggaggaaaataggccagtgaaattcagtgattattcattatgatcaaggtgattagtacagaaatctccatgactattctgtgcagtgtcttttctttaacaatattttataatcattcttatttttactttctgtagacaaatcctttcttgttttgcctccttttaggtacttttgagattataaaagtatatagtaaaaacaaatgcacacacaaaactattcggttggtatacttaattttgttagaatagatttagtccaggtatattccagtggtttcttactgagagttcatcctagtcccctgattattacttgagtgttcactgatggtttttccttcttgttaacaggaaatagttttggtttctgctaaaaatggcagttgccaccattctgctaaaaatggcagttgtgtgagttttatttcttagaaaataactatattttatatttggtgaatatcttagttttgcatttaatttgctaagcagaatcaatgcaatcactatcatattctatagtttttcctaacagattgatagagtaaaatgtatggtttttctaatttttagcatttgtgtccaataaaatgactttatataatttttttcttgttggttcattttttttccggtcaaagtttcttctttagtttctcatataattgattcaaaactcctaagtgatgatcacagtaaccttaggtatttcttaattctccataataaatatagcatctgagtctaatttcttctgggagatttattaacttttaagatagcatgtgtcacttacataatctaacaatgcattttgcatactaaaatgatgaaacattcttaatgaatttaaatagctactttatcagaaacaggagtcataggttgaatttttatgtgggtagtagagctaagaatatttgtaaaacagctctccatgatgggctccaacaggatgaagtaagaccacctaccaaggaagtaagatcagttccaaaatgaactgtacatgaaattctgctctaagatctttttgctttttaacatgatttcagaaaaggctaatttttgtaatggactacaatacttgttttgctacataagctttcaggattttttttcttttatttttattttaaaattaatttttgagcagcattcttgactgcaagaaagcttctgtcagtttcccaaattactcaaataacatgtattttacactgaaaatcatgagctccttaactcaaagcttttccttgttgtttttgtaactatttaccatacaattacttgtaaatgaaatgtataacataaatatgcgctaacataaaggaagatgtttaaatattttttagacttctgaaaaaagataaaactctcggtttttaagaacattgtatctttcattttatctttctttctcctccaaatatattaataactatccttctatttgttacgttcctttacttaaagggactaaagtataaatcaggtaattaatacacaaaactttattctgtcccttgcttgtagcactacttcattccagtttcctcagagtttattatataaatcagacagatttgtaaataagtattttacagtctacatttatttgattatgaaaatggaaacagaataaaatgtgaaaagataacaaactttacttctttgtttctccatcttttcaagttgatcaggtatatggatggcattttaaataatgtgttaaatttagagaatacattaaatagaaaagaaaattgtgggaaataggaaagcctttccattaagggtttagatataaaatgttctattcagttacaaactaaacctaaaatgagagggtttttttgtttaactgaaagagctagagagtaattaaaggtaattggcatgttattattcttaaaaggttcgcttttctgttctaagaataccagggaacaattgaatagataaaaagcaaactataaattgccaaatagatcttttgtataataatacatctcccaagacaaaagatatttcagacccataaaaaataagggaagtgtatttgcctgactggtcttgcatcttgcctgaccacaatgaatttgcatcagattttaaactcacagagttataaaatatcttaatgtgttaagagggaatcaaaagtgaatgtgattaacttgaaggaactagttggcagactttaacattaggctagcagaaactatttaataaataaaactgaaagcagaaaaatacttttcttaaataattattagtggcagattgatactgttaatattattgattcaatctgggaagtcctccctcttgccttttctctacccagatcttgcattcttttgcaaaataagaacaatacaaactcattattattattattattttttttttttttttttttttggagacagagtctcgctctatcgcccaggctggagtgtagtggcgcgatcttggctcactcaacctccgcctcccgggttcacgccattctcctgcctcagcctcccgactagctgggactgcaggctcccgccaccatgcccggctaattttttgtattttgtttagtagagacggggtttcaccgtgttagccaggatggtcttgatcccctgacctcgtgatccgcccgcctcggcctcccaaagtgctgggattacacgcttgagccactgcgcccggcaacaaactcattattaagtcacttatttactattctattcctcaatgaactcttttgtagacttctaccccatctataaccaatgcagtggtactcctccctctcatatttagtttctcagctcaagtaagacttcctcagaggtttaatctaattaatcttaatctaattaaaatagaaacccttacccatttattctgtccaaagcaacatgtttcccctcccctccccttcccctccccttctcctccccttctcttccccttctcttccccttcccttccccttcccttccacttcctttccttccccttctttccccttgccttccttcctgccttctttcttttccttctttctgtcttttctaatacaaggcttgaccactggggtaaaattgtcaaaatgtaaaaaggagataattaaaaaataaatagtacctaagtagtatgctaaaatatacatggggcaagatcatctttgcattttatgcttgggtgcattctggaccaccttaatctttttttttcttccctaagacagagtctctctctgtcatgcaggctggaatgcagtggcaccatgatgactcactacagcctccacctccgaggctcaagtgattaatcttaaatagtgcaattattctatttaatcacaaatgtcagcatctctttagttttggcacatggttttcaccttttatcctctctctctctccatgcttcattatattagttccctaggctatcacaacaaattgacacaaactaaatgacttcaacaacagcaatgcattctaaaacagttctagaggctagaagtcctaaatacagtggggccacactcgctctgaggtccctagagagaatccattctgtggatcttccagcttctgggggctgccagcattcctttactcatgcgagcattcctttaccccagcttctgggggctgcaccactccaatctctgctccctggtcacattgcctcctcttctgtgtgtcaagtctccctctgactcactcttaaaagaacatttgtcaggccaggcacagtggctcatgcctgtaatcccagcaatttgggaggccgaggagggcgaataacttgaggtcaggagtttgagaccagcctggctaacatggtgaaacccttcctctaataaaagtataaaaattatctgggcatgatggcaggcgcttgtaatcccactcctcaggaggctgaggcaggagagttgcttgaacctgggaggcagaggttgcagtgagcagagattgcaccactgcactccaccagcctgggcgaaagaacaagactccatctcaaaaaaaaaaaaaaaagaagaacatttgtcattgaattaaagacccgtgagtatatttcagaataagccccttcccttaaagtccttaacttaatcacaagcattgccatataaggtaatattcactgtttaacgtgtcattatattcaaagattccaaggattaacgcatcacatatcttttagaaaaaactattcggcctactaaactcgatgagtcttcatctactgagactcaggccgagtcagataaaaagctttacaatattccacacctctctctacacgtgttaaaaacaaggagaaagagtttctcttaaaattttaagttcactaaaaatagaacaaaagcagaaacaattgaggtttttgtggttgttgctgtttgtgtctttatttttaaagattctactttgtaccatatatacatggtaaattattcattatcatatctgcttcttttttttcatttgaagtaatcatatgccatggaaaatatttaaattcccaggcattgttagctgtagagctcataaaatgttcaatgcttcagtgagttgcaaattgaaaacagaaataaattcttggagaaacttgacagtattctacacactttgctcttgattgatgtcatgtggtgattccaataaatgacttttttcaaacaacttaagctataactgatttaagtaaatgggggtgcaatggttctttcttatagatctcatctgctgagatgctatacacagaatttcaatcatcttaccctatgatttttcaaaggtgtataagtatgaataataatattattattcattattatttattctaaaaataaaaataattatattcattattctaaaaataaatttttgtttattattaataaaataacatataaggatacatttatttattacaatcatgaagatatttagaatgtaccattttctaggtagtaaactagtgcttcacatatttttgttcatttaatctttatttttataagtcaacaactatagatattattttatattatttatactttataaaatataataaatacattttaaaatatatatcaaatatatattataaagtattacattataaaatactatattttataaagtagatgactatcgatatagtcattatatagatgagtaaactgaggcatattgtttctataaaaaccttaagagcgcacataaaataaatgctgcagtcaatgagccaaaacatcatactaaggattttgcttccagaagctgcactcctaactactaggctctaatgcctctttttatataaatgatatcatactgtttgttctcttttgatctagcttctattaattagcatatttattgagattaatctattttatagtatggatgaaagtttcatttcttttattgcttgtagtatttcaaaatatggatatatcaaagcttgcttattcatttatctgttaatgaatatttgattgttacatgctcttcactattagcccctctctcctataaaaaagtgctgtgaatgttttggtacaagttttttatttacatatactttcatttccctacaaattgattggcagtcatatgataggtgcatacgtcaaaatattttaaaaactgacaagcctttttccagagtcattgtactaatttccattaccattagcagtgcatgtatgttggttgtcctctatagtattgccaacacttggcatgaccagcctttttaactttagccattcttttttctttctttttttttttgagacgaagtttcactcttgttgcccaggctggagttcaatggcgcgatctcggctcactgcaatctacacctcccgagttcaaacagttctcctgcctcagcctcccaagtagctgggatataggcgcgcatcaccatgcccagctaatttttgtatttttagtagagatggggtttcagcatgttggtcaggctggtctcgatctcttgacctcaggtgatccacccaccttgacctcccagagtgctgcgattacaggtgtgagccactgcgcctggcctctttttttcttttttgagatgggttcttgctctgtcacgcaggctggagtgcattggcacaaccatagttcactgcaggctccacctcctgggctcaagtgattctcccacctcagcttccgagtagctggtactacaagcatgtgccaccatgcctagctaaatagagacaccatgccatgtctctttcttttttgtagagacaggatctcactatgttgcccaggctgctctctaactcctggggtcaagaaaccctgctgccttgaccttccaaagtgctgggattacaggcttgagcaactgtacccaactcatttttgacagacacagattaattccctaatgactaatgatattgaggatctttccatgtgtttactttctatctacatatgttctttagagaagaagtattcatttaagtcatttgcctacttttattagagttgttagatttattatcaagttttgagagttcttatgttttctggacacaacttttttgccagacatatattttgcaaatattgttctcagtagtgtcttatatttctatttgttttacagtgtttcctgaggaacatatgttttacattttgatgaactcaagttgtcaatttctactttgatgaaacggtgtttgtgtcatgtctaagtagtatttactagcctgaggtcaaatacttttctatattttctcctatacataatttttcttccttttttttcactttgtttttacattttacatttaggcatatgatctgtactaaattaatttttgtatcatgagttacgtgttaaagttctactttttgcatatgagtatctaattgttccagcagaatttgttgaagggctatcttttatttactgaattacctttgtatctttggagaacaccaatttaccaaaattctgtacatatatttctgaattttctattatcttccaatgacatttctgtctatctttatgccaatatcacactattttcattactgtagccttataagctttggtattagattgtgctaatccttcaaaaatattcttatttttaaggattattttggctattttagactctttgcatttctactgaagttttaaaattagtgtgtaaattcctataaaacaatgcctaataatattttaattgggactgtattgaatctatatttagggataatcacattttaccatgtgaattttctaacccatattcatattacatctttccatttatttaagtcttctttaactttctgcagtgttttgagttttagtgtaccagactcttacatcatttgatagattaattcctaattcttctacatttttcatgatattattaatagtacttttattttaattttttattgttcattgctggtatatggaaatattagtttaatatgttgctttttttcttttttatgttgctaactcacttattatagccagcagtgtttttgtagatttcagtggactttctacatagacatgccgtctataaataaacccaatctacattttcctttcccgtctgtaattcttttgtttatgttttttgtctattttacttggtagaacgtctagtgaaatgttaaaacaaagtgctaagagttaatggactcatcttgttcctgaaatcgggggaaataaactgatttttcttcattaggtatgatgccagctattgtttttacatagatatcttttattaggatattcttgaatttcttctagacagtaataacttagatcttgtttcattgatccaatctgcttttaaattggtatatttagaccatttatatgtaatgtggttatgtgtgcatatatacatatttttttttctttttttttttttttttttttttttttgagacagagtctggctctgttgcccaggctggagtgcaatgcgatgatcttggctcactgcaacctctgcttcctgggttcaagccattctcctgcctcagccttctgagtagctggcattacaggtgcccgccaccatgcctggctaattttttgtatttttagtagagacagggtttcactatgttggccaggctggtctcgaactcctgacctcatgatctgcccacctcagtctcccaaagtgctgggattataggcgtgagccaccgcacctggatatttttagttttaaacctattattttgcttttgctttctatctttcctgaaggaattcagaaccagatacccccaaacatgccactttggcatattgatttttttgagttaaagacacttgaaaaatagcagatgcaagaaaagcactctgattttcctttaaagcactctgattttcctttttcttaaaagtaggaggtaaaatttctacatgaaagttgccctctttatacaagaaggaaagtaacagtctcatcacccaggatgagaagttgaggcaagggaaacctgtacaaacagaccttgttaaaccaacccttatcctgttaatcacctcttcacccaattaactacactagttccagctcctttgtcttgtcatatttcacaatttactactctgtgtctacttcagaacataagtgattatgtcatggagtcttccttccttaaagaatctcgcatgccacataatacatgcattaaataaatttgtatgcattttcctgttgatctgtcttatatcaatttaattctcaggcttagcagaggaaaaaaaaaaaactaagaagatggtaataaaattttgcttcccctaccatcccatctgttttttgcttattttccctcttgtttgccttcttttctatgaatcaaatatattttatggtttcatcttatctccttttttacttgagaattaaaactctatattgttaattttaatggttgcttttgagtttgtagtatacatgtttaactcatcacattctaccttcaaattataatatactactttacatacagtatcatgaagtaacaacattttcattattttatcctaactgttgttctgttattgtcattaatttatttttatatatgttgtaaactcattataaattgttattattcttgtttaaattagaggttaataatgttgttttcttctctctcttttttttttttttttttgagacagagtctagctttgtaccaggctgcagtgcagtagtgccatctcagctcactgcaacctctgcctcctgggttcaagcgattgtcctgcctcagcctcccgagtagctgggattacaggcacatgccaccacacccagctaatgtttgtatttttagtagatacggggtttcatcatgttgcccaggatggtcttaatttcctgacctcgtgatccgcccatctcggcctcccaaaatgctgggattacaggcatgagccaccagaaccggacatgctttccttaaaagctaaatattttaggcttgtgtgccattaggctctgttacaactacttaattctgcttttgtaattctatagcacccattgataatacataaacaaatgagcatgaatgtgtctcagtaaaaatttgttcacataaacaggcagtccacccatgaagctatagcttgctgaccccttgtttaaacaatcaattgaattcaaacagaaataaaaggatcttatatatttaaccatgttgataccatttccagtgcttttcattcttctatgtagatccaaatttccttttgatattattttacttctgcctgaaactttttctttaacattttttatagtgttgttttactggtgatgatttctttcaggttctaagtgcctgaaaaaatctttatttcacctacatcctgaaagatagtttctctgagtctacaattcccagctgacaatgtttatcttccagtactttaaagatgttgcttcattatcttctaattttctttgtttctaataaaatgtttgctggcattttttgttcctctgtgcaaactgtgtttttgtcattggccactttgagaatttttctttatcactagttttaagcaattttattttagtgtattttgtgcacaagacaaggatgccctctctcaccactcctgttcaacatagtattggaagtccttgccaaaacagttaggcaagagaaagaaataaagggtacccaaataggaagaaaggacgtcaaactatccctgtctgtagattacatgatcctatatgtagaaaactttataggcccaaaagcttaaggcccgaaagctccttaagatgaaaaacacctttggcagagtctcaggatacaaaaagaacatacaaaaattactcgcattcccatacaccaacaagagtcaagcggagagccaaatcaggaatgcaatctgattcacaattgctgcaaaaagaatcaaatacctaggaatacagctaactagtgaggtgaaagatctctgtaagaactaaaaacaccaaagatatcagagaggatgaaacaaatgaaaaaacattctatgctcatggataggaagaatcaatatcattaaaatggccatattgtccttattttcaagtatgctattgcactctatgactgatccaaactcctgccagatataattctaaaaatctgtttgttaattttattattttatttttggatttttaaatgcttgggaattgggagatatgcacaattgtctttgctttgtccacaaaattaaatgcgtatttgggtacttataggacactatttgtaaaaacatttatttcttcagacattgatggtcttgtcccagttattaacaacatctacatgtttaagaataaattttcttttctatctacttcttattccattgaaaattacctttctatcctcctactctggaagtctttatgattctgtcctaatcattagtatcccattgcttcttcaagagatgtctgtcagtagaatttctccattaatataagttcatacttctatgaaaactttaaatctcaaatctacagtatttctagttctaaaaaatatttaaattagttctttaattatttccatctttatgtttactttcctttttttctagcattttaaacaactttacgtcaacaattctttatcttcactttacctccctttacctttcttcattttttcctagccattggattcagagaaaattattcaacttttaaacttcaaacttgctagatctatatttaactatgtctattgttctcttcagaacatctgttgagtttttaatccaagagctattatcagtattttctaaaatgcaacctcttcttgcatgtctctgaagatatgaattacacttactgtaattacatttgtttcttttcttaattctgattctctgaaattacttattctgtttgctaagttttgtatcttctttcttgtttttcttaaaagttgggtgacaatattttacatgggtagtttttctgttaatcatagcttatctccaatgattaggaaaataacaactatgaagtaggacaaagtaacctggtttcttgtgttttagcattgctgctccctgttccttcctggttttgttaattacctgagactctgccctgttgatgttagtcagattctaagactcaccttgccaagcaagcactgctttgttattccaaagtgaagttcattcttactttgtctggaaagcagtctctgcatcttttaccttattatttccctcctttcatattatgtttcttcctttaccaattttaatggagcttccccttttttgtctctaagatctccttctctatctcaaaaacaaaacaaaaaaacattatcagcattaacatatacaacagagagcttcattgatgtggtttggctgtgtccccacccaaatctcatcttgaattcccatacgttgtgggaggaacctggtgggaggtaattgaatcatggaggtaggcttttcctgtgctgttttcctgatagtgagtaagtctcatgaggtctgatggttattataagggggagttttcctgcacaagctctctttgcctgctgccatccacgtaagatacgacttgctcctctttgccttccaccatgattgtgaggcttccccagctacatgaaactgtaagtccaattaaaccttttttcttttgtcaattgcccagtcttgggtatgtctttatcagcagcattaaaacagactaatacagtaaactggtatcagtagagtgggatgctgctgaaaagatacctgaaaatgcagaagcaattttggaactgcgtaacaggcaggggttggaacagtttgaagggctcagcagaagacaggaaaatgcaggaaagtttggaacttcctagagacgttttgaatggctttgaccaaaacgctgataatgatgtgaacaatgagatccaggctgatgtggtctcagatggagttgaggaacttgttagaaactagagcaaagttgactcttgttatgttttagcaaagagactggcagcattttgcccgtgccctaaagattagtgaaacttagaacttgacagaagaattagggtatctgacagaagaaatttctaaacagcaaagcattgaagaagtgacttgggtgcttttaaaggcattcattttataaggcaagcagagcataaaagttcagaaaatttgcagcctgacaatgtgatagaagagaaaaacccattttctgaggagaaagttaagctggctgcagaaatttgcataagtaacgaggaactgaatgtcaatccccaagacaatggtgaaaatgtctcctgggcatgtcagaagtcttcacagcagcccttcccatcacagtctcagaggcctagaataaaacggttttgctgggcccagggtccccatgctgtgtgcagtgtagggtgttggtgccctgcatcccagccactccagctgtgactaaaagggaccaaagtatagcttgagctgttgcttcatagggtggaagccccaagccttggcagcttccacgtggtgttgagcctgtggatgcacagaaatcaagaattgaggtttgggaacatctgcttagatttcagaagatatatggaaacacctggatgccgatgcaaaagtttgctgcagagatggggccctcattgataacctctgctagggcagtgaggaagggaaatgttgggtgggagcccccacacagagtccctactggggtaccgcctggtggacctgtgggaagagggccaccatcctccagacctcagaatgttagatccaccaacaacaccatgtgcctgggaaagccacagacactcaacaccagcccacaaaagcagccagaaggcaggctatatcccgcaaagccacaggggcagagctgcccaataccatgggaacccacctcttgcatctgcatgatcaggatgtgagacatggagtcaaaggagatcattttggagctttaagatttggctgcccctctggatttcggacttgcatggggtcaagaaatgaaaagcataaaaattgaaaagtgaaaagaaaaaatatttttattcacagaacatatatatgtatattgtatatgaagaaaatcctaatatatttatttaaaaagctgtgaataataagaatcaaattcaataatggtgcagaatgtgtagaatgcaaggtcaatacacaaaatacaatatggaaaattaatggaatttctaaatactagaaataaacaattgagaatacatttaaaagtaaaattttaatggtataaaaatagttaagaataatttaagtgaaacctttaaaaatctttcacactaaaactttttaaaatttcttgtagagaaacattacagaagacttaaataaatgtaaagatctaccatgttcttagatttgaagatgcaacattgatgtgaattctctggaagttaatctttagaatcaatgcagtagcggctgggcgcagttgctcatgcctgtaatcccagcactttgggaggccaaggtgggcggatcacaaggtcaggagatcaagactatactggctaacacgataaaaccctgtctctactaaaaaaaaaaaatacaaaaaaattagccaggcatggtggcacgggcctgtagtcccagctactcaggaggctgaggcaggataattgcttgaatctgggaggctgaggttgcagtgagccaagattgtgccactgcactccaacctgggtgacaaggtgagattctgtctcaaaaaaaaaaaaaaaaaaaaaagcatcaatgcaatctatagtttgtaatttattgactacaatgaattctatatctatttactacaactctgtagtaaattgtggcaaacattttgagagaaattcacaagctattgccaaaatttgtttggaaaattcacaggacctagaattttgagaaaaaaatagagccaattttcagacatctaagaaagctgcagtatcaaagcatcataacacaaaaataataaggataaagaagggttcaaaattagacctccacctatgcagtaaattaaatgtttataagggcatgtagataattcagtggggaaagtaagtctttaacaaaggcttttgaaataaatgcattctcatattaaaaaaatacatgcatcagtcctttgtatacacaaaactagtccaatatttttaatgtaggcataaaaatgaaaaagcaaaattcagaaagcttttaaaagaaaaaaattaaacaatatctgtgagctattataataggaaaagtatttctgaacagagaaagcactatcataagagtaaaaattgataaattgtagatattaaaaatgtatcctaataaagctgcaaaatgtaagaaaatataattttaagccatagactgtgataaattattccatatatgtatgagaaaaaaattgcgtgttcaaaacgcacagagtactcctgagatccactaaatagttataagaatcttgaacaggtatttcacaaaacaagagatacaagtggcttataggaatgtgaaaagatgctcagtgttattagataaggggaaatgcaaccaaaatgcatcgaaactggaaagactaccatttaaaatgataatactaatattggcaaatatgtggggaaactagaagtcgtgtctatttcttgtgagagtgtaaaatagaacaactggctgggcgcggtggctcatgcctgtaatcccagcactttggggggccgaggcgggcggatcacggggtcatgagatcgagactatcctggctatcatggtgaaaccccgtctctactaaaaatccaaaaaaaaaaaaaaaaaaaaaaaaattagccgggtatggtggcgggcgcctgtagtcccaactaatcaggaagctgaggcaggagaatggcgtgaacctgagaagtggagcttgcggtgagcccagattacgccagtgcactccagcccagacgacagcgcgagactgtgtctcaaaaaaaaaaaaaaagtggaacaaccgctttgaaaaataattcgcctctcaataaggccaacatacatctaccctatagcacagcaatgtcaattctagaaatttatccaacaaaaataaaagcatatatttacacaaaaacctgtttgagaatgcacctaagtcctttatttgtaaaagctaattctgaaagcaatctgaatattcactaacagactaatgaataagcaaactctgacaaatacgtaggcaactcagaaatatgaggaaaaataaacaaatgatacacacaaatatttggctaaatctcaaatatgtatttatgctaaagaaaataaaccagatacacactcacacacacatcctgtaggaattctaattattggaatttgaagatgaacaaaattaatcaatcatgatagaaattataagggtttaatccgagttatttgggatgctgaagccggagaatcgcttgaacccgggaggcggaggttgcagtgacctcacattgtaccactgcactctagcctgggtaacagagtaagactacgtcttaaaacaaacaaacaaaccaacgaaattatacaggtttgcctctgaagaagagaagagaagtttgaataagcacaatagtattttctagatttagtgtaattaggtaaatatatcaatttataaaaagtacgaaaccacatttttgacacgtttattatatttaaaatatagcgcaataaaataaggttaggaaatgattgcatattactctctgagaggaagaatgttatctgttggtagaattaataaagttactcatttcttataagaagtaaagatatattggccgggtgcggtggctcgcgcctataatcccagcactttgggaggctgaggcaggcggatcacaatgtcaagagattgagaccatcctggctaacacggtgaaaccctatcgctactaaaaatacaaaaaataagacgggcgtggtggcgggcacctgtagtcccagctattcaggaggctgaggtaggaggacaccgtgaacttgggaggcagagcttgcagtgagccgagatcatgtcactgcactccaacctgggctgcagagtgagactccgtctcaaaaaaaaagaaaaaagaagtaaagatatatctattaacctgtataggtatatataagctaaaaacaaccattcaacttttgtgggcatagtagtctgtgtcaggcatttttgtataaatcataaacatttaattctcattcaaataataaatatattatcttacggttataaaggtataataagtacaattttaaaaaatagacaaacttttctgaatatttccagtacagtggtatatcatttttttccgatagaataaatagaaaaatactcaaactctgggtaatattttgcagaaaatgaattagttacacttattcaagttgaattattctagttcctcaattttatattccagaaaaatatatgctgactatatttttaatgctttttttattagagaagtttgtttattgatatgtgcatcgcttttactaattcagttttgagcaaggtgtgactctttattcaattttccaaagagttccaaaccaaaacttgtggatttccagttgatctgtatatcaccttgctacctctggcttttttctctctaatacaggtataagaataacatttaacaataaatgatttgtgaagccagttgaaaaatgttcatgctatattaatcaacttgataaaatgcattaaatttatgaatttctacaggtttgttagtgcctggaatctgtaggtagagacacccataaaaaagtcttataatataagctatataacttagtgaaaaatcagtaaggcatactgatgtttgcataggatgacaacctggtcatattaatttttctgagaaaataatctcaaatgaaaaatcacttccctaaagcattatttgtttttatatcagatttatttcagttcaaccaacattgcacgctctaagtattagatattgtgattggtcctgggaatgctaagataaaaatttctccttttctaaccttgaactcacagagaggtagaagcaagagaagcataaacatataatttcaatgcaatatgggaagtaaaatgatagtggtactttttctgaattttcagatatcaattatttatttataaacagttctttagagggtgatttattttctctatagatgtcaacaagatacacttgccttgtatggcaaaaataaattaattttagctttgtgcagatatatcctattgagttacaaagtgatgctatcaaacaccattgacaacaacaaattcaggatttatggctctctttgtctctgtttctctctcctctctctctctgtgtatatatatacatatatgtatattatacatatatagtttaggatacatgtgtatttatatataattttattttttagaacaaaattaaaaataaagtgtctttaaatgaaagtctgtgtttgtaacacaatcttatgacatcagcattaaaaaggctattcagaacacttcctcaaattgaaactattaccaatactgagttaaatattttaggactacttcattatctaggaaatttgagaagcaaattaactctttgctcagagtattgtgataccatatcttttcttgtaaaataagatattgtttaattataaaatattgtcaaatttctgaaaaagtgtttatataagtgttaggaatatgttagctctgggagccatgtgttacttatcattgtacagatcttcttgctgacacaactgggtatggtagacggcctgatatgattaactgcaagtaaagcagaaattattaaaaacaatattgaggccaggcaaggtggctcatgcctgtagttccagcactttgggaggtcgaggcaggtggatcacgaggtcaggcattcaagactagcctgaccaagacggtgaaaccccgtctttactaaaaatacaaaattaggtgggcatggtggtgggttcctgtaatcccaggctgaggaagataattgcttgaacccagaaggtggaggtggaggttgcagtgagtcgagatcacaccaccgcactctagcctgggtgacagagtaagacaacgtctcaaaaacaaaaacaaaaacaaaacaaacaaacaaactaaattaactggatgttaaatgtggtttctttacatttaccagaatttctgccaaggtcctaatggccccaaataataggtgctacattatcaagcagatatatcaagagattgtgataatgttaatgaaacccctttgctcatcactcatttccaaaatttatattttcaaagggaattttgtacagagttcctaaaaaaagggatcatgatgccagtgtattgcctcactgattgctaaatgaagaggactatactgaagcattcaaagaacgtgatgtgcctctggggcaactgaaggattgctatctgacttatgcatttaaaaccttcaaagtggaagtttgtctggaatggcttaggcaaacagactgggttggattgagaattgaatgtatacataaaatttggtttggtcagatgagaacaccaaatgtggtagctagctcacctttatttatgagatttttattgggttgatttgtcttgaaagaatcaaatctaagagaaatgtttggaatggctagatgatcctaacagaagaaatcttacaggtctttactgctaaacctaaggagatgagagtaaacagtaagtggccaactcaaagaagcatggactatgttgaaacatggactatagctgcaatttcccagtggtgcagttttcaagcgctttaccccaggagagaaaaaaataaataaatgaaaagtagccatttcaccattcagaggatagatactgttgcccagtgaaaactgcatgaattatgtaatagttttatgcttgtttcccccactcaccattccaaaactgtaagacttcaagatagaacaggaggtatgaaattttaacagcacataaaaaaatagtgaacattctatccccgcacttcattgccgttactaaggctaaggcaggactgagtttagaatgcagcaaagctttgaaatgtataagagataatatctctaatattcaaatacaccataaactcaaaacttagaatcaatcctatttttaaaatactgaatgtgactagaaacgttataaaagttttcaagatatcagtatatgatagaaagagatgtattgctttagcacaaatcattctacaaaaaaaaaaattcttctaaaataaattacttatccatatcctacaaattttcttttttctttttctttctttctttctttttttttttttttttttttgagacagagtttcactcttgttgcccaggctgtagtgcagtggcttgatctcagcttactgcaaactctgcctcccgggttcaagcaattctcctgcctcggcctcccaagtagctgggattacaggtgccagccaccatgcccagctatttttttgtatttttagtagagatggggtttcaccgtgttggccaggctggtcttggatgcctgacttcagctgatccaccggctttggcctcccgaaatgctgggattgcaggcatgagttgccgtgcccagccacaaattttcttttaccttggaaaacatatatgcaaatatacttgtcaactatccgacaaaggtctttggtatgtatgtatggattcattgaactttgtttctttttacataatgaatattttatgatttttagctttggttttttgaaatgaaccaataaattgaagagacacaagaagtaatatgtgtgtaaataccagcacgcttagcccctcaaataaacctcttacaggtgtctgactcctaaatccaatttgatattttttcagaacttgtctttatcaattatttacattctgcttcattttctgatttgtttttttactttcacactcacttatcatttttttacacaatagttgtttactacagtaacaattatatctgacataaatgtactgaggaacaaaacaaccatcttatggcatacaaattagcagtgggagaaggctaaccccaaacatatgccaagccaggagccaggaaatccagggatgtggttaggcagaaactgggaagacactttatagcgattcctatctttgttacagacatgaaggagataaattataatatgaaaaaatggccctcgcagttctaaagagattaactaaaagtctagtaccttttaaagatctgaataggaaacacttgtcatttattgtctctaagggcagccactgtaagacttcaaaagaaccttggtctccacagtcttttatcttaacctgaacattccctttctatcattcccaggtcttgaatcaaactcaaccaattatcaaccagaaaatgtttaaattcacctatagcctggaaccaacccccaaaccccaatatcctcccatcccccaacccccctgccagccccaacccctcccacccccactccctctgctttgagttgtcccacctttctggatcaaactgatgtatttcttaagtgtagttaattgatgtctcatgcctctctaaaatgtataaaagcaagctgcatcccaaccaccttgggcacatgttctcaggacctcctgagtgctgtgtcactggccatggttactcatatttggcttagaataaatctcttcaaatatatttttttaaagaagaaagaaaaaggaaaaacaaatgcttttgcagaagccaagaaggaagtgaagggaaataaatgagagtggaaaaatgagagatcaattgtggtgagatatgctttttttggcaattaattgcaaccagtgcccaaaatgccaattataacatagtttgctatctaccattgctttatttaactgaagtattcaaccatagatatggaaaaaagactgacctagtttagaaaagttctatcctgatacatttaagcactagagagtatacacaaataaaaacacaaacttaacttttcttaaaaacttttactgagtcaaatattaaaagagaacacttgtttgtaaagcatctcatgaagttgatttttgatttttcagtccttcagtaactaataatctttattttgacattgatggttatccaatggaagactaactgcaagatattaataatagaaatcatttgcatcagccgggtacagtggctcactcctgtaatcccagaacactgggaggccaaggtgggcagatcacttcagcccacgagttggagaccagcctgggcaatgtggcaaaaccttgtttctactaaagatacaaaaattagctgggcatggtggcatgtgcctgtagtcccagttactcaggaggctgagatgggaggattgcatgagcacactgcacttcagcctgggcaacatagtaagatcctgtcacaaaaaaaaaaaaaaatcatttgtgtcaaatgatttttgtatcaaagctttcagaaaaaggagtggaaagaaaatttaaaaagcttttgtccatcattcttagatgtcatat

SEQ ID NO: 1814 - DNA, 1763 bp, Homo sapiens
aatgctccacatgaaaatccctatttggattgaaaactataaagaatgtttcccttgacatatagttaagtcttatatattatattttggataatttgaagaaatggttttagtaaattaatgagaaaatgcttcagaatatactttatagtacatcaaaggcaatgtattttcaaatccaggctgtattatttgtttgtttggttttttttttttttttttttggttttgaactatatgtaggcattttgttgacaggactttttgagaatccattgcaagcctgcacagctacgttaaatatatgaatataaaataggactcaaccttatcaatttgacacgtgtgtgtgtgtgtgtgtgtgtgtgtgtgtgtgtgaatgtggtaaaacatctgcatttgtcatcaatttttggaaatattcgaaagacttttgtgaatcaaaaacctataaattatttggtatttcagatagagatcatggaatcctattaaatgatatatgtccagggttttgcaggtcacaacttgaattttattcgaagagatataatagtcattaaaaaataagagaaaaaaagaaccctggggacagaaattttaatttaaattcagggcaggcatgtagtacctgatattccatgtattcacagaatgacagaaaaccatccttacctgcatggaatgatggcagtgattgtttagtgtccattcaaaacagtaactggttgcagttgaagtagtacttttaatcatatggacacttgttccccaagaattgacctggagccaccaaaacataaacacagactattgagcacagaaggagccagtaattactttcaatcactccttgtcaaaatggtttgaattcaaaccaatcattcataagagaggagctacctcattaatagttttcttagttcaagatcaagaaaaatgataagccatattaaaaattgtttgtgtttgcaagcattcaggagaatgacatttgaaacacaattaccaaaacaaaataaaagcagctaacttataattcaattagagcctttccaatatttgtcaaataaaaaagagcaaatttcagtgaagaaaatcaatgaaggaaaccatttagaacatgcttattgctgtttgacttttgtcagttgcaagaaagggaaatagttgaaatattggcagtaaataaattttacagttattacttgtttcttctaattttctctcccttattgacttctcatttctggtaatatggcaataaacaatatgtaaagagctcagcactggatgtgattaatgtatgcagtatctgcagttaaaacattcttctctactgatgtctgtgtcatgatcctccttttttctcattttccttcaatgttgatttgcctcctcttaccttttttcttctgttattatctactttttacaactttaacaatgaccctgcatatccttcactggcctctctttcaaagaacccatcctacaaatatgcccagctacctactagacatgttcactggaatatgtccatgttaccctaacatctcccctcctttatgttgtgtcctgtctcctatccccttccctctaagtaaccaaaatcaactcattgcttttgattttctaattagttaattctggcacttaagtcaaaatcaccattgtctttgatttttgcctgcagacacttccttgttgaatatgtttgtgcaaacttctatcagataaatgtacctgaaacacacttctca

SEQ ID NO: 1815 - DNA, 2003 bp, Homo sapiens
gtatgcaatggaaaacctatcttcaagatttctaatggcaaactcttagatttgtgggctgataattgaagttgacgagagcacagagcagaaatgtgtagaagcttaaaatcgaagagagtatatcatgcaaattagcaataaacactataaaatgtaacggataatagaaagagtttagactaaatggaaaatatcatttaaaatattcccttggtgtgggtgtgcatgcttgtactaatttaatgccatatctacctcacttagattatgtatgtaggaaatacttaatgtaataactaaatggcagattttgaaatgatgtgatctaggatatggaaactaggaatggaattaagaataatgagataaatttatgccaaaaaaaatcattgtaatacatgccacatatatcatgtgtagctttaattaacacagaaaaaaatgcaggacatcccattaaaagtaaaacaaagaacaaattgaaaatgctttctgaaacacagttatatgttcacaaggactgaccaatcctgatggtctaattcattagtgtcatgtgactgtcagtctggaagtgttatattttactcacgtacaatctaatagcttttcagcttgcctgaaggtgttatctgcagtatgttcatcgttacttggtagagcactttaacactactttgaaagtgaaaaatatttgggaaaatagactgtattctatcttttagttttatgcagcataactataagtctctgtattattattgttgttgtttttcagcccctctgactgataagccacccaagcttttgtatcctatggaaagtaaactgacaattcaggagacccagctgggtgagtaattccttaattctagttaatatgctgctctcgttacattgtgacagttaataagcctagattgtaacccgatgtaatactcgcagctaaatccatttgtattcatagggaacagaattagaaaatgctagcatacctagccatttcattccttacagtgcgtgccttaggacccagttggacatatggatgtaaaaactcacatgctatttagatggttattggaaaatgagataggctgatgattttagtgatggtattacagcactgtcttacaaggtttgaattggttttcaaacagacactatggaacaatttgatttataatatctattaataggttaagatgcaatttctgaaatttaggggaaagggttcaaatttattaaaataaatgtcaccattatggttaaaaaacattttaagtgtaatcaaatataatataaattttgctagttatattttggataatctattaataaaatatgaccaagtgacttttggttaagggactagcagatttgggacataaggctatagacaaaatatgtattgaaaaaatgtacaattatatacgaatcagaattctgacttatcttagaggttcatctagaaattttgagtttgatttagctatattcagttatactaaattatgaaaaatttccctcttaattataaatatatacatagcaattctgttatattctcttaggtcttattttatttgaaatgtagtatgcaggcatatgccataaactttggcagaagagtttttgtttgtagtggtgcattataaaaggttatcaaaaatatgaatttaaatgaatatccatgtttgttaaggaatttcttcttagattaatcatacaagagtgaaaatgcatgtactgtatataactaaaaagaatcagtataccatcccttaagttattaatgttattcttattcctggagtgagaatttgcatcaaaattgtaaattcattttccaaatgaagattacagatgtgataatctttactaataacatacccaaagttatagtacacaaagatatgatgatggttttagcacctataaaattattgtggtcaatggctttctagcacttgaaatgcttatatttgctaagtttaaag

SEQ ID NO: 1816 - DNA, 2646 bp, Homo sapiens
tccttccaaataaatatttcagtcagccatttaccttctattctctgtaacatgttcactaactaggagcatgttctctcacatttaataaagtaaaaaatgcatcagcttttcaatgttttccccaactttctattctatttaacaaatatttcttgaatagctactatgtgcggagcatcacaatagacattgtatgggatgcaaagtcaagagtgaggccactggtcttagaatcaggaaacttgccttctaatcctatttttgccagttacttgtatgacctagagattcacttctcattttagagccaaagtcctggatttaatgatgtctgaggtctttttcagctatattgtaatccaacctaatgagtaaaaccatttgtttcccctaaaactttacagtattctatggggggtcgaaactattacagaaataactatgaaagaaagcagaatgttatcggtaatttcaagagagagttacaaagtgatgtaggccattaatagcttcatggagggagtgaccttgagggattaggttttgataggcagaaataggggtcataagaacaactctgttcctattgtgggctttctccatcctggatattactcagaatttgtcagtggcaaaacaaaagtagtagaaagttagcctttgaaggatttttatcagtctgtttccgaactagccaatgagtgtagattggagctgtaagcaatgaagtaaaagtaaaagagatgaacatgaaacatagggaggggtcatagaaatggaatttcttcacaaatgctaatagcaactatcccttacatttgtataatggttaaaaatccaggatatgagggtatgacagagctgttaagagcatggccgaatatgctcctaacatggactaaaccagacctgggtttctatccctgctctgacatttaccagtggtagaaccttgtacagtcacttagcctgttgcacctcagtttcatcatttgtaaagtggagataacaactactccatgagatggctgtaagattaaaataagattgtgtatttaaagcagttatcaaaaggactgacacatagaacttactcaaaaagggtagctaggaggtagtatgtcaggtattgttctttcctttcaacagaaagtcaaaactggggctctgagattctgaatcatttattagaatccagtattctttctattacaagagtgactcctaacctgagttttctgcccacaccctatccctggggggcatctgtgaaggtaataatgagaatctatgagttattttcaatatttgaaagaagcctaacagagagcattaatttactcgtgataaattacacaacctgactaatatgtcaagtttctttgcttttgcctgaaattatatcaactcattttggtaatactggctatctcatgctgatgggaaactgattggcagctatatatgcctttgatgaatagaaatgaggaaaacgaattttatatcataaatgcagttgatctgggagatattcttttcagcttgggagaacatagagaaaaataaaatgctcctttgttgctgaaactattgagaagcactgtattttacaccatgctttctgattcaagggaaaagggggtttaaggggcttagaaagataggcagttgtggtcagagagaatttcagactttgagagcttatgggtaaattgttttcatataacatacctgattgaaaggaggatatgacgtgtttttcttctgtgagaaagagatgaggcaactgaggcctaaagagggataatgaatcagccaagttaaaaaagcagcttgtaacagaaccaatatttcaacccagtcttgtgactctgttccatagctctctctactctgaatcaaagaaatatagtcatcttgtcttgattttgccacaatgtccaaaaaaacattttctcaggtctgattttaatattgactttttctagtgaaagagagaaaacactgttagaagatgaatgaaaatgaagttagggacttacagacagctgacatacaaaggtctcctttgtattgattggcttctttattgatttgacaatatagatcaatatctcttcctctgaggctgtagtgttatagtgtgaattctctgggttccatttcactctgcagaattgatacaaatacaacaggtgcagaggtaatagggggatgaattatcatattagctattatttactatgtgcccactatggccaggaatgttattcaggcatctatatttattgagtgcttgctgtgggcgaaatgctagtctaggaagtgacagagtaatgaacaagacagagaaaagtccctacccccatagagctcatattttatcattctaagtatttttgtatggattaccttacaacaaccctgtaagtttggtactgttagtactctcaatttacaaatgagaaagtggagacagagttagtaagttacttgcacagggtcacacagctaggaatattaaatttggaagttgatgtaagatctgtctgactcctaaatgtacatttttctattattcttttcaagttttattccccactgtgctacttcatcagacagcttctttctgccattcttctc

SEQ ID NO: 1817 - DNA, 206652 bp, Homo sapiens
aggaaatatgaatgcttccaaaatcttgctacaaacatgactgaaatttggacacgatgaccagatgaacaaagccctcagcatgttttgcatgaatgccacaaaacagggtcactggtctaaaattcaaatacactggtggaaaagtgtgtctgtctgacaattacactcaagtttaccttctggttaacatttttattatatatttccttttaaaattcattcaagacaaaaaagaaaacaaagacgatggccccggaaggaatgcacaatttgttttagtttacagcacagagatctttctctcaatgggaattgtgctcttggtttcagcaataagtgaaggaaaaaagatcttgcccttttgaagttctgaggggaggtgtagggtgtccacgttagtacggttggataggatatgctctcatggtaacgcgtccaagttggaatggtcttccagtctccatggcatccacatgctgttttaaacagagtttaaagaaatgtgaaaagaggcagagaatctaagtgcagacgcacagccaggtcactgctcttcccatcactgcatgagtgtctgcagctgagggcacgtgacttcagctttctgtaaacgtttcccacaacacaattccaaatcaatgctacatcaacatttatctagaaaccgttaatgacaacttcaaatgttctatgagaaacacgcacagttctcctcagagaagggcatttgggctgctgcattacctactggcgttagttccagatcttgaggaagctatcccaggaccctgtcgccacagccatgccatcgtcagtcacgcccaggcagctgacgcggttgtcatgcccagccaagacacctgggagcaaacaacagcagaatcacaccaaagcccagaggcatcgatctcacctgtgtgccatgttgtgacgaggacggatggtgcatctctcatgggacaagacccagagtctcccacggccaggaagggagggaaagttgcatccacgtggggaattaacctgcagcatatggccagccttgttaaaattcaaagacacgcacacacacgcaatcgataaatccagagcccctggcattgacttctcagcactcacttataaaacttaaaaaaagaagcaaaggccactatcaaaaaaatcaaaactatcatcagacgcagtggcttaggcctgtaatcccagcacgttggaaggccgaggcaggcagatcatgaggtcaggactttgagaccagcctggccaatatggtgaaaccccatttctactaaaaatacaaaaaccagcagggcgtggtggtgcgggccgtagtcccagctactcaggaggctagggtaggagaatcattggaacccaggaggtggagcttgcagtgagccaagatcgtgccagtgctctccagcctgggcgacagagcgagactccatctcaaaaaaaaaaaaaaaaaatcaaaaccgccccaatctcaaagcaatctgtaacacaggagcttagaggcatgagccgtttttcctttgtctgtgatccctagagcccagcacaaggcacagaacacaggagtagcgatggtggctgagaccactggcactgcactgtcactgtcatgtgatgagggggccttctgtcaacactcccaataaccttggcttggatcatcaccagccagaagctccacttcctcccagggggatccgaaggcccatttcagccaccctcctccacctcctgcagccaccacacagctgagtacaggggccggcgtgtgctctgccaaggcctgggctggcttccaccgcccttcaacagcactgtgactgtgagacttggctggaaatggctccactctggtccccccaggctggggagaaaaagaaatgtgtttaaccaggaggtgggagtggcacccatccggaagcaggaagccccggtaagggccaagacctggagccatgctcccttctgtcctcccaggtactgagacaaatgaatctaagtctgtaagtgtcaacagttctcaaattcaaatgcccaaatgaccatttttagtaaggaagtctcatcttttgtacacctggcaataacacgcttgcctttgatatgttaactgtaacggcacccagaggtgtccctgcatggaactcctccccctgaagcagagttcagaggggaaagcacggggctgggccctggagcctgcacagctgaccctctcctgcccactgactctccccagagccctccccgacgcatgtgggaagatctgctggtactcctcggagtccacttgcctggagggtcagagctgggccatcagtttgcgactgtcactcctgctacgccatgccacagtcccaccgatactaaaacactgcagcttatgcaaccactctgtgtttgctctaaagataccacgtaaatgtccacaagacacagaaaggccccatggccacgtacctgcccggtcggctttgagtgcatcccagacgttgcagttgaagtcgtcgtacccagcaaggaggaggcgcccgctcttggagaaggagacagaggtgatcccgcagatgatgttgtcatgggagtaagtcatgagctcctggtcagcacgaaggtcaaacagcctgcaggtggcgtcgtctgagccagtggcaaatgcattgccatttggaaagaactggaaagagaaagcaaatcaagacatcatgtaaacgctcagaaagaaacattgggaatatggattgctcaatggtagggctgcagagaacacagcaggcaaagaccagcaagactgtgctctggtaagaacagagggctgggccgggtgcggtggctcatgcctgtaatcccagcactttgggaggctgacgcgggtggatcacctgagatggggagtttgagaccagcctgaccaacatagagaaaccccatctatactaaaaatacaaaattagctgggcgtggcggcgtgcgcctgtaatcccagctactcaagaggctgaagcaggagaactgcttgaaaccgggaggcggcggaggctgcggtgagccaagattgcaccattgcaccccagcctgggcaacaagagcaaaactccgtctcaaaaaaaaaaaaaaaagggtggggggatgggggaggaactacaggggactgggatgggaggggatttgcactggggaggcacacaaacactgtgatcttggacactgtgattactgtccccaaagagtagaatttattccaaaggatagtgagaaagtagtcatcactgacaggtgtgcatgttgctgtagctgccagccatcagggctaatctcatggaggaaggagggaagcgggctgaccaaggctgtggtcaggactgcagcagagctctgtccaaccaacagatacatccttctaagtctcctcacaaggccaggggctggaaacactgcctagccatccgcgtgctaaagaggagggcaggttccctggttagctgtgcccctgaccagtaaggctctgtaaccactggtggcctgagttatcttactgtctttcccctccaggatcccaaccactgctcagctgtagaggtgggaacggggactggcatacaacaccctgtgagtatctgtgagacaagtggtcaacacagagaagtttcccatcgggagttttctgtatccccatctgtacatgaggttgtataaggatcagaaaggagaacatctaatccagaaaagtttaaaatttagcaatctgaacggctagcagagacggcagaggacccgaccccacacctccacccagactcacgcaaatggcattgatgtcagactcgtggccagtgaaggtctgccggcacatgccttctcgcacatcccagagtttggctgaagcatcacaagcaccagagacgaacagtctggtgtcaggagcaagagaaaggctcatgacatctccagtgtgtccggtaaacgtggtcgtctgctggccggtctcgatgtcccacagggcactggagcaggagcgaatgacaaggggacatcagccttaacttcttgggtggctagtcatgtgacagacaatctgtccttcaaaccacccagggccacagtgagcctctgcactgttactttaaaaacgtaaattgtttaaagacaaatttaaatgtaatacaactttggaagggaaacaaagcaaagcaagcaaaattatacagagatgagcacagggcctgggcttcagaatgacgggatcgctacctcaactcaaatgccagcaaacagggagctgggggcacttttcaagcagcaccactgaggctgtgccccctctttggtcatggatgggcatggaaggggtggcaggaagctacgtggaggccctggatggcggaggggacgcgactctatctgtggctgctccctctgtgccctcccttggcctcccctccacagggtctcagaaaaggcaggcaggagaaggccaatgccaggtaaacaaatggctcacagcaattctgaggtcctcctgccctttcctggaatcacaaacaggagagcagctgagttctcagtgatcacacctggtattttttttttttttttgagaccgaatttcactcttgttgcccaggctggagtgcaatggcgcgatcttggctcaccacaacctccgcctcccgagttcaagcgattctcctgcctcagcctctccagtagctgggattacaggcatgcgccaccatgcccggctaattttgtttgtatttttagtagagacggggtttctccatattggtcagactggtctcgaactcctgacctcaggtgatccgcccgcctcggcctcccaaagtgctgggattacaggcatgagccaccgcgcccggccatacctggtattctatcacatttctgcttaacaagctgtcaaaaggtgagacgctgacagagccctgcacagagcagaagcctggctcaggtgtaaggacagctgtgagggccacacgcccaccaacatactattctcctgtgcctcgacccatggaaggcaacaccagagagcactgtccgttcatgtcagcctcagaggaaagcctggctgggcctggcaatgcaaatccaatcagccaatctcaacagacactgcacagggagcctcctctctagggcctgagggactgactgcagaagggaagcaagatacgtaaaagagtctgaaaaaaatgattaatgaacagaagcactttaaaaatatcttctaataaataaagtcttctcaagattgacaatctaggtgacaaatcttttgtaaatctatgaaatttatacaacgaggacaccttataataccacagatgctttgctgacaagttggttaagggcccatgtctcggtgaaccccaccaactgcgtgactaggggtctgtgccctgggctgggcacagctcctgccaccaaatcatgcctcagaagaccagaaaaacccacatggccagctgaagtctaaaatgactctcataaaataactatctggacatttaatttagtactttgatgccacaaatgaaaaaattctagcatttaagtgggcttccgtttacctgtaaggtgaaaacactaaaaatgaagtctgatggaatcacttgaattgtgacgtctgttatttttagtctgtgctcattgttcacaatgacatgatgctatcagaaagggacaatcaaaacccaccctactcccacctatcatcacctaaggaggtacaaatatatagaggggaaaaaaaagaagagcaggtactttgagcctgattgtagttaaaatatctatgttggccaggcatgggggctcacacctgtaatcccagcactttcagaggctgacgcaggcagatcacgaggtcaacggataagagaccatcctggccaacgtggtgaaatcccgtctctactgaaaatacaaaaattagctgggtgtggtggcgcacacctgtagttcccagctactcgggaggctgagaggggagaattgcttgaatctgggaggcagaggttgcaatgagccgagatcacgccactccactctagcctggagacagagagagactctatctcaaaaaaaaaaaaaaaaagaaaaaaatgtgtattttagttctcagctgctgaaaattaaactttgtaaatttattagaagtataatgaggctaggcacggaggctcacgcctgtaatcccagcactttgggaggccgaggtgggcaggtcacctgaggtcaggagttcaggaccagcctggccaatgtggtgaaacctggtctctactaaaaatacaaaaattagtcaggcgtggtggcgggcacctgtaatcccagctattcaggaggatgaggcaggagaatcatttaaacccggcaggcagatgtcgcagagccaagattgagccattgtactccagcctgggtgacaagaacaaaactccatctcaaaaaaaaaaaaagtataatgaattcacacattgctactatgtgttttaaatcttaaggccacttaaattacagatggcctaatattatgtcaagaaccttatttcctccatgttcacagaggaatgtgccaggggctgtgggttctcaaggcactgcctgccccgggtcaggtacttaccacgtggtgtctccagagctggtgacgatctgattgtcatccaggaatcggcagcaggacaggtaacctggcaaagaacaggcctaagtgatgagctgaatccagcaggccttgcacccagcctcatacatagagaaacacattggcccggtggaagctctacgtctaaggtaagaccagcaccatgctagtgaccttttattcccatctgtgcacacagcagaaggtccacacgcactgctggtgagggtgagagcctggccaggcaggacagcacgtcccacagagacccacagctccgtgatgggggcagaagcagaaaccacacccatgaaacatacacatctttcatctgctttactgtttgacccatcaaaggctggggatccctcgtctatttactcattcagggcacgctgactccagtgcccaggaagcagccttaaccagacagacacctcctgctctcctacagcccacgctcagcagggacagagaatgagaatcactgaaagaggacatcagaaagggagtgctaggggaaggaagaggacaaagtaggggcctcacaagatggaagccaggagaggagggaggacgagagtagactcagagaaggaggatccaaacagagggcccagccagggcaggaggcggcgaggccacagggtcagggtggcaagggcctgcaggtcatggaagggataacgaaggcaacaggaacgcggcatggcagcaacactgcagacacgggggtgctcgtgaatatgtgtgggtgggtttgttttcttggggacagtggctgtgacacccacatcagcgtgggcacaattctgtgtctctgagtattcccacccactcccactgggaaggaagcatcagaggcgagagcaggacacaccaagatgccccgtcctaaacaacttccaaaatgaggaaaagcaacaacaaaaaatcagtccgcaatatccacacatgatgactggtctctactaaaaatacaaaaattaagcgtggtggcgggcacctgtaatcccagctactcaggagggtgaggcaggagaatcatttgaacccggcagttcaagttgttaatgacttctgttgaccattatttcttttgtacattgatcacagttctggtatttactgtggaactaaaagcatagggtcaacaaaccagttagtgtgtgcccaggattggtgacagactggccctaatctgaagattcaggggttccagtggcactggtgattcttgggatacctgtttagatttgagtgtttactgaaaagccttccccccaactacaccccagggagtcatgcgacactgcgtgaatcagcaaacaacaaaaataaaatgcaccaaaagaagaaacccactggggttttaatgtagaaagtgtaagattacagagaaaacaaagcatttatttaacaaacattattatcactattttttgagacagagtctcgtgctgtcgccaggctggagtgcagtgatgtgatctcggctcaccgcaacctccacctcccaggtcaagcgattctcctgcctcagcctcccaagtagctgggactacaggtgcacgccaccacacacagctaatttttgtatttttagtagagatggggtttcaccatgttggtcaggatggtcttgatctcttgaccttgtgatccacccacctcggcttcccaaagtgctaggattacaggcgtgagccaccatgcctggccaacaaacattattaaactggctctgacagaagaaaaatatgcatagatgacagagctcaaaatattaactacgtgcctacgaaagtatgcgtggtcaaatacttcctggaggccacaccacagggacactagggaccacaaaggtgaacccaagtccagctcagaggaggatagccctgcatacctggcgccccctgtagtgccctgcagcttgctgtcgtgccccgcagctcactgtcatgctcccgggtctccacccgagccctcctccactggcttcctggttcacactcacccttgcttcagggaagcacccccaccccgtcagatgcccatccagaccaggccaccgagccttgtagcacttagcctgtttgaatgtgagcacagaagggcaggaaagaagagtcatggagacctcagcacagcctgcatctcacacaggggaccaggcggaggcactcccaagtttactgcatgaaagaatcatgaccttggctggacgcggtggctcatgactgtaatcccagcacttggggaggctgaggtcaggagtttgagaccagcctggccaacatggtgaaaccccgtctctactaaaaatataaaaattagccagctgtggtggtgggtgctgggtctgtaatcccagctactcgagaggctgaggcaggagaatcgcttgaacccaggaggcagaggttgcagtgagccgagttcacagcggtgcactccagcctgggcaacagagtgagactctgcctcaaaaaaacaaaaaacatgacctcataggtctcaaagatgacctctctgtcccaccctgtgcaggctgtagtgaagctacacagaatccatcagcttcttactccaagaaccagagactgaaccctaaaatcacagctctcaagcgctgataaaatgatgtggacaagcatcagctgacaggaactatgaaggacaaggggaatgaccgaatgtataagccacacatggcccctgacttacaattttgtgactttatgatggtttgaaagacacacgcatttaataggaaaaccatgctccaagtacccatacaactattctgtgttttcattttcaggagtgtccaataatttacatgagatgttcaactttttcttataagatatgtattatgttagatggttctgcccaaccagaggccactctaagtgtctgtgcatgttcaggttggggggtgaggtgtgtccagtgcggctggagagcaggatgggtggtgcaatgcccagggtgcaagcatactccatgaggcccagtctgtgaacagagaccaggtctaaccccttcttccaggaaagcctcgtagggccttctggccaagaggccacgagtggtgaagactgcagactctgaaatcagaaatacctgggctccactgtcagcatggcagctgaggaagagtgaaaattcctctaagttcttttagaagtcccagcctccccatgtaactggggaactgatgggaggagcagagctgtctgtgcacataagaagttctcagtaaatggagacagttactatttctgttattattgaatttgaacaaattccctgggtatgtgtggggggacacttcaggtgaaaacacgcccctcctcccctggtgcgggggcctgtgctgccaccctctggaagcctgcagaggggcagggaaaacagaccctgaacaaaagtgtgcacccagtgaggaggtgcaagggcacaaaggtggcaccaagtgcctcaaggagaggctgaaacgcggcctggggacctcgcagtggtctggtcatataggcagtgggtgtgaagggctgtcctgtgtctcatagggaccactggctatagggacaaggctgttaaagtccaggagagagggggtggcttgaagagaggcacggcagagagtggaagcgtaggagaaagatgggctcctgggcatgtggtgtcagcagaggtgcctcaaggatagagtgagtccagagtctagaaaggagcagatcaccaggctctgggaagagcacagcatgggtgcacacactgctctacccagcatggctgccgacccaaagacagcaaagccaagaaggacacacaagcgtggccagatgcagccctgtgaggaaacttacccaagaacgggacgatgggcttgagaaaccatccatctacaaggatggcgtttgctgcagcaatgtttataataaattgtgggaaactgtgaactgcctaaatgtctcacaataggaacaaattagtgcaccacaccatgaaactctctacagctcctgagttacagaacgacagtataatactatagttatataatactgtataatactactgcataactattgtataatactgtatttctggatggaattatagggtctcccaacataaaagatgatgattcaaagttcctttccaaaattcctttttttttttgagatggagtctcgctctgccacccaggctggagtgcagtggtgcggcctctgctcactgcaacctccgccaccccggttcagcacttctcctgcttcagcctcccaagtagctgggactacaggcacctgccaccacatccagctaatttttgtatttttagtagagatggggttttgccatgttggcaggctggtcttgcactcctaacatcaggtgatccacctgcctcagcctcccaaagtgctgggattataggcatgagccaccgcgcccagccccctttccaaaatttctacaatgaacacactttgaaaggtttagttctcctacctgcaccctggagaacatccctgttgggagcaggggcaaggagaccccacccaagggaggcgcacaggacacactgaaaggcaggcgggcaaatgccaagaagtcagccatgaccacgcccagtccctcactagtcctcctccgacaggtggtttcaggagcacctgtgccgccccaggatcggctccaaggagcaaaaacaagaccgtgctggcgagggacaggctcagcctagacctggagggaaaggtgcccagccctgcaccgaggcatgcacttggagagcagaggtgttttcttcaagttcagtaagaaggaaaatgaaagagatgaggaagtaacttgaagatgtgaaagtgaggctcagagggttgcacagaggagtgcccgggcaccatgagtgcctccatgatggtgtgaggctgtgaggcccaccagtgcagccaagatactggggctggtaacagtgagcctcaagcagacatcccagtcaccagctgccctgttgtggctcctgaagcagggtttacggggagacaacatatatccccttctgtgtccaagcttgtgaggcctgtcagaaaaaaatccgctattttcatgaatatagaaaatgttctgcttctcactatatgaagacaccgtgcctaaaaatgccaagttttggccaccacagtgggctctgtcactgacagctgtgcacgctgtatcatgaaggccttaggctggacttctgatcaatgcttatgtatctgtagccatcttgatcagaatgatccaggcaagggccgccgtgtctccactgcccgagaggtatgcaaagaacaaagctctaagagcaagcgttgagtctccctgcattggcccttagggatctgctttgataaaaatctgagactggatcagagggctggaaataagctttttttggagacggagtttcgctcttgttgcccaggctggagtgtagtggagcgatctcagctcactgcaaccttgcctgctgggttcaagtgattctcctgcctcaggatcccgagtagctgggactacaagtgcatgccaccacatccaactagtttttgtattttttgtagaggcgggtctccctatgtcacccagactcacaaacactcttttttttttttttgagacggagtctcgctgtcgcccaggttggagtgcggtggcgcgatctcggctcactgcaggctccgccccccggggttcacgccattctcctgcctcagccttttgagtagctgggactacaggtgcccgccacctcgcccggctaattttttgtatttttagtagagatggggtttcaccgtgttagccaggatggtctcgatctcctgacctcgtgatccgcctgcctcggcctcccaaagtgctgggattacaggcgtgagccaccgcgcccagcccacaaacactcttaagaggccaaatgtgtgtgtgtgttttttttaaataacacaactccttagaagtaaaatttcatgaaatatgaaggaaataaaatttctaaaatattcctactaataccagtttttttattttcttgagtatttttggcttttctttctttggtttcaaagacaaatacagtcagtgttaaatccagcaacctttgattaccaatggaaacagatgcacagactctgacggtcatgggaagggactgctgaacatagagaacacctttccaaaaagggtgctgcgtcagacagagctgtgtggtttacagggtcagtgtgagctgcctggctggactcccagcgatggccaggggctcctatctgtaggcattaccttctcacagaaacaactataagcactgcacaaactacaaaacgaaacacctgaaagcatgaaaacaggagcaggtagaaactggaggagtctcccctgggagaaaagaaaggcaggacatggtttgttcttaaggagctttctctgaggaggggactgtctgtgacaaccccagggctacagcctcacacacaagacctgtggccaaggtcttcaagagccagtagacagattactgggcaaccacagccagaaagcgaaaggataacaactacaaagaagaaagccacagaaagggagtcccaaactacacacacggctgaccagatatccgacacctgaagtgcacaggcatgcagcccagccagcgcagaaaagctgaacagaggtttctgctgctgccacacaagaaagacagagatagactgcctgatacaatgacactaaacatcagttagttctggagaatgtaaccggacacaaagtctctatgacacaacatttacaatgtccagaatacaatttgaaattactacatgtactaaaaaaatagcaaaatgtcactcagaatccagaggagagatccacaaggaccaacctcaggaagatgagatgctgggatcagcagacaagaactctaaaggcagctattaaactctccttgtggatgcaaaataaaacatgctattatacaaggacagggaatctcagcaggaaaataaaaaatttctaaataaaagcaatagaaactctacaactgcagaaggaatatctgacataaagaacctgctggatagccttagtttatcagaggtaacaagtacatgaacttgaatggaaataaaaaggttaaaagcaagtaagtggtgctaacaacaacaaaaaggaacaaatctgaagaagtgggaaagtgatgaacaaaccccagccccctgagcctcggggacagcacagatgcgtgtgtattgcagcacagaggggcagggactaaggacagaagatgcatttgaagacatggtctaaaacttcccaaatttggtgaaagacaaatttatagattcaagatgccaaagtgcaataaatgcaaagaaaatcacaccgaggcacctacgtgcaaactgctaaaaaccaaatctttagattgttaaaaaaaaaaaaaaaaaagaaaaataaattaaaaaaagagtcaacccataattctagatatccagcaaaaatacccttcaagaataaaggcaaaatataaatcttagagaaatgaacactaagtgctttgctagcagcagacctgagaactgcattaaccatgacttgttccgggtagggctcccggccgaaaggacgcccgcagaaggcgcctttgcaggagagcgggaagggcactggacatggaagatctctctggagggcagagtagatttacttcattcttttctctttgagacggagtctcactctgttacccaggctggaggtgcagtggcgtgatctcagctcactgcaacctccgcttcagttcaagtaattctcctgcttcagcctcctgagcagctgggactacaagcgcatgccaccatgcttggctaatttttttatttttagtagacacggggtttcgtcatgttggctaggctgatctcaaactcctggcctcaggtgatctgcttgcctcggcctcccaaagtgctgggattacaggcgtgagccaaccatgcccagcctatttcatgcttttcatatttattcacattataagacccctaatttcttaagaatgtttaaagtaaagaatacaacaatgcatcatggagctaataacacacacaggtgtgatgcatatgaaaaccacaagagtgagcaagggcagacagcaggcccgtgtggctgtgagttccttacgtttcctatcaactaggaccaagttaactagaggaccgcgagacattgggaatgtacactataatccctaaagacaccactaagacatcaggcaaaatggtttacctacaaagcccacagacaaagtaaaatagatttctttaaaaaatcaagtaacccaggccaggcgtggtggctcatgcctgtaatcaagtaactcaaaggaaggtaggaagggaacaaccaaaaaacaaaaatgaagggacaaaaaggtggcaaagtagcagagttacaataagaaatataaatgtgcaaaagcatattccaaaggcgggcagaaaaaaccaagacccaacaatgatgcgaggtctgtaacagactattttcaaagacacagttaagctgaaaggacccccatgaaggcaggactgactacattagtatcagaaaaagcagcggttcccaacaaagagcattatgagtgagaaagaacagttcatcatgagagcagggtcacagggtcaattaatcacaaagagacaacaaatgtaaaggcatctactaaaagagctcaagatatctgaagcacagattgacagaattaacaggaaagttagaaaatccataatcattttaacagccctgcatgagcatttcatagaaagacacagaatatttgaacatgccaaaaatcttgctctaattaacatgtatgtagaaaatcaggccgagatacaacaaaaacacatatcattcccatgtgcacacagcgcggccaccatgacagaccatcagctccattaaaaacaagcctcaaatgtcaaaggactgaaatgataccaagtgtgtctttaagcacaatgacatctaattagaaatcaacaataactaagaaaacttcagatatgtaaaaattatacatctaaataacctataagtcaaataagcactcacaaggatattaaaaatttcacattgaatgataattaaaatacaatataggctgggagtggtggctcaagcctgtaattccagcactttgggaggccgaggcaggcagatcacttgcagtcaggagttcaagaccagcctgaccaacatggcaaaaccccgtctctactaaaaatacaaaaattggccaggcgtggtggtgcacgcctgtaatctactcgggaggctgaggcaggagaatcgcttgaacccagggggttgaggtttcagtgagctgagattgcaccactgtactacagcctgggtgacagagcaggactccatcttaaaaaaaaaaaaaaaagacaatatgaaacaaatgtgtgtgatgtggctaaagccatgcttagagggaaacttaaaactttaagtgattctatttgaaaaggaagcaaaccagtggcctacagatctacttcaggtagctggaaaattaagaaggcaactccaaagtaagcagaaggcagaaaagaacagagaacagaaatcaacaacagcagcagcattatctttcaaaggacaaggttaaacttgtaatctggccaaaattaacttatttaacagactgcttaatgggtgtcaactgtagtactagtgactccatgaactgatttctttggctgcatgtgaagtgggcggagtgttatcaaaaagtactggggcataaaatgtctgagaacaaataatacagccagagaggtaaaatattagaatagtacatcctctttcagcaaatgtatgcctttcatgatgaattagtgtcacaagtaaataaaatcttggtgaaataatagactacctagcacttacggccacagggctctattatgcctcatttgcagagacagggtctcgctttcgcccagcctggagtgcagtggtgcaatcatagctccctgcagcctcaaccacccaggcttgagccatcctcctgaggagctgggaccatagttgtgtgccactgtgcgtggctgtttttcattttttgtagagaaggggtctagctttgttgccccagctggtctcgaacccctggctccaagctatcctcctaccttggcctcccagagtgttgcagttacaggcatgagccaccatgtccagcgcaaatccacaggtttcttactggtaaaggcatatcaggcttgtttttagtttcattttcagaaaacttctggccattactgtgacttttatttgaaccagtctcatttaatgattcataaggccgggcgcagcggctcacgcctataatcccagcactttgggaggctaaggcaggcggatcacaatgtcaggagttcaagaccagcctggccaatacagcaaaaccccgcctctactaaaaatacaaaaattagctgggcgtggtggcggacacctgtggtcccagctacttgggaggctgaggcaggagaatcgcttgaacccaggaatcagaggttgcagtgagccaagaatgcgctgctgcactccagcctgggtgacatagtgagactctgtctttaaaaaaaaaaaaaaaaaaaaagaaaaaaaggctgggtgtggtggctcacacctgtaatcccagcactttgggaggctgaggtgggtggatcacgaggttaggagatcgagaccatcctggctaacacggtgaaaccctgtctctactaaaaatacaaaaaagaaattagctgggcgtggtggtgggcgcctgtagtcccagctactcaggaggctgaggcaggggaatggcgtgaacacccaggaggcggagcgtgcagtgagccgagatcacgccaccgcactccagcctgggtgacagagcgagactccgcctcaaaaaaaataattaattaattaattaaaaaatgattgataaaaagtgagtatccaaagcatataatgtaccccaggtaaacagcttgtgtcacttgaagcttatgaacaaggacaggtacctgtgtgtcctgccagctcacgactcacgcgcacgttcccctcacgagttttcagattgtaaatggagcaaatgttatccaggccaccgcaggccacatagttcccagaaggggcatatgcacaggtcatgacccaggaggagcgcagagggatggcgtggacctaatgacagaaagacagatgatgcaaacaactttatgttcaaaaacaacactgacaccaggattttctcatctccaactttcactgcaaaggaggtaacagaacaaaataagagccaaaattatctagagagcgattcccatatgtggccactcaggtgaagcatacttaatgagaagtccagtgctgcacatgggattcaaattcaatccacacagtccagttttactgaagtcacaacttatgattaggtggagtcttaacagtagtgctgcccactcatcaaaaccacattaggccgggtgcggtcactcacgcctgtaatcccagcactttgggaggctaagtcgggcagatcacctgaggtcaggagttcaagaccagcttagccaacatggtgaaaccccatgtctctactaaatataccaaaattagctgggcgtgatggcgcatgcctgtagtttcagctacttgagtgactggggcaggagaatcacttgaacccgggaggcggaggttgcagtgagctgagatcacgccactgcactccagcctgggcaacagagcgagactccgtctcaaaagaaaacaaacaggccgggtgcggtggctcatgcctgtaatcctagcactttgggaggctaaggcgggtggatcacctgaggtcaggaattcgagaccagcctggcctcaaattggtgaaaccctgtctgtgctaaaatacaaaaattagctgggtgtggtggtgggcgcctgtaatcccagctactcaaggaggctgaagcaggagagtcgcttgaaccaggggggtggaggctgcagtgagcagagatcacgccactgcactccagccagggcggtaagagcaatgctccgtctcaaaaacacaaaaaaacccacacgtattggaaggaaaacactgcattatcctgtcaaatggctatgaactcatctgaaaacaaaaaatttttttttcgagatggagtttcgctcttgttgcccaggtttgagtgcagtggcgtgatctaggctcactgcaacctctgcctcctgggctcaagcaattctcctgcttcagcctcctgagtagctgggattacaggcgcctgccaccactcctggctaattttttgtatttttagtagagacgaggtttcaccatgttggctaggctggtctcaaactcctgacctcaggtgatccacctgcttcagcctcccaaaatgctggaattacaggtgtgagccacggcgcccagccgaaaacaaaagatttttatggaataaccaaaatggacattcctacaatctaccctgccacatctctcccactgttttagatctgctgtaattaatgcaatcatttatacacatttagtattctttagtaaaataaactgaattacatcttttacatacatgtttggaccaatgacaatactttttattcaaaacaatacactttggattaagtcttgaaaataacataaattacactttaaagtatgatgtctttcagatgatctcttctaaaaacttgtaactgaatgaaaagtgatacttctgcactctataaataaaacatgaaacttcccagactctgctaaaactggaattgaggtctcctagaaacacagaaggtccttagctcccaccagcttggtaaggagatgacggacaacagcacaactgtgcctggtccagaggaagagaccgtgacaggtggcacgtgactcagcttctatctcacctgcgcaacttcactactaacaaacagagcttgccgctgctgccttccctatcctgtattacgtgatttaacaaaatgaatccagagcttaaaaccctgtttcctgggttggtttttcaaggaagggaatcctccagtccctaccttgttggtggtgtagctgtcccagatgataagtttaccatcctgcgaggcactgacgagaagcctggagggacagacaaaagcaaacctatcagtaccgcacaacacagaaagtgtacaagagcaacagactaaaacccagactctggtggcttatgtgctcccatgttacatgtgcttcagacaaagccacttatttataagaaaaaaaatctctggtcgggcacagttgctcacgtttgtaatcccagcactttgggaggctgaggtgggcagatcacatgaggtcaggagttcaagaccagcctggccagcatggcgaaaccctgtctctattaaaaatacaaaaattagccgggcatggtagtgcgtctctgtaatcccagctactcgggaggctgaggcagaagaatcgcttgaacctaggaagcggaggttacagtgagccacaatcatgccactggacaccagcctgggcaacagagtgagactctgtttcaagaaagaaagaaagaaaggaaaggaaggctctaaatgtcagaccaacttcaaagcatgaacaaaaacactgtcacagaccacagttgagagtggagatgcctggccccaaccgaatgcaggccacatcacccctggcacccattccctttgtcagctgagacaggctgacatcatttcataagtgtttctgtttggtttcattacaaatcaaattagaggctcatgtctttaatcccaacactttgggaggccaaggtaggtggatcacaggagtttgagaccagcatggcctcatgctagcatggtaaaatcccgtctccactacaaaaacacaaaaaaatagctgggtatggtagtgcatgcctgtaatcctagctactcaggaggctgaggtgggaaaactgcttgaacccaggaggcgggggttgcagtgagccaagattgcgccactgcactctagcctgggcaacagagcgagatcctgactgaaaaaaaaaaaaaaaaaaaaaaaaaaaaaacaaacagaaagaacaaaccacttttagacattccaaattcatgaaacatttctcacccaaaataccccatgaaatttcccagactgagctaaaattggaatcaaggtctcctagaaaccaaaggaggcgttccctcctcacctgcttggtaaacaacagcaccactgcgcatggtccgggagcagagaccagtaactatcacgaattttttctttttttcttttttttttttgagacggagtctcgctccgtggcccaggctgcagtgcagtggcgccatctcggctcactgcaagctccgcctccggggttcatgccattctcctgccccagtctcccgagtagctgggactacaggcgcccaccatcacgcccagctaattctttttgtatttttagcagagacagggtctcaccatgttagccaggatggtctcgatctcctgacctcgtgatctgcccacctcagcctcccaaagtgctgggattacaggcgggagccaccacgcccggcctcttttttttgtttttgagatggagttttgcttttgttgcccaggctggagtgcaatggtgcgtcggctcaccgcaacctccacttcccagatttgagcaattttcctgcctcagcctccaaagtagctgggattacagacacgcgccaccacagccagctaattttgtatttttagtagagacggggtttctccacgttaatcaggctggtctcgaactcccgaccctcaggtgatccgcccacctcggcctcccaacgttttggtattacaagcgttgagccactgcgcccgaccatgaattttttcataactatttccttgctctggcaactgtgctcagttcggaatccacatgttgaaaaggagctccatactacaaaggagaatatgaataaggagcaaaagaatttcaccttagcaggcaagtaaggtgggtgaaaggtaactcctgggaaccacagttgcttatgagaggtcctaaggaaccctgtagcacagaatgctgttttcaaggaagagcaagaaggttccactgtttgatgcagggatatctgtcagtacggtaaatgatagtataaggatttttaattttaaagtttctatcaaacgcaaggttttttgtttgtttgtttttgtttgtttgtttgtttgagacagagtctcgctctgtcacccaggctggagtgcagtggtgtgatctcagctcactgcaacctctatctcctgggttcaagtgattctcatgcctcagcctcccaagtagctgggattacaggtacgtgccaccacacctggctaatttttgtatttttagtagagatggggtttccccatgttacccaggctggtctccaactcctggcctcaagtgatccgcccaccttggcctcccaaagtgttgggattacagacataagccacagcgcctcaaaacacaggttttaactatttcagctgtgaacatatgtggcttcttaaagctgacctaaagctggagtaacgctctctcaagttttgttgataactctgacacttttaatatcaaactagatgttttgatacaggtgtcaatgagtttaagaacaaataaaaaccttttcacctgcactttattacaaaatttatcacagaactaaaaactaagtgcaggctcccatcctattatttttcagatgcaattttttttttttttttttttttgagagagagtctcactctgtcacccaggctggagctcgctgcaacctctgcctcccagatgcaagcaattctcgtgcgtcagccttcccattagctggaattacaggtgtgcaccaccatgcctggctacttttttgtatttttagtagagacagggttttgccatgctggtctcgaactcctgagctcaatctgcctgcctcggctgggattacaggcgtaagccaccgcacccagccttcagttgcaattcttaaagcaaacttctcaatccaggttgtcatcaacatattaaacatttaaaattatttctacgtaatggtatcatgttcccactctagctttatttctgcccagcccttctgagactttctgtcgagtatcagagctgatctaaagcagctcatcctcctagattaggaggatcacctttacagaggtctcccggtcagagagcttaataactgctgacttccagagggattagggacacgtaagctgtccactgatcctccagaaggtgagagaagacatgcctcctagtcccgggtcagggagctgttggaaagctgggttcacgttgcctagtagtgcctttacctactcaaaaatcaattatctgaggtgccactcacctagaacatagaggcaagggccaggaagcaagctaacaggctccaggaccctgaaagtagctgtcaaaaatcaaaacacctaatgcccttcattttactcaaaggagggagggtggtggctcatgcctgtaaccccagcactttgggaggctgagataagaggattggttaagtccaggagtttgaaaccaacatgggcaacaaagggagaccctgtctccacaaaaaaatatatatatatattttttgagatggagtctcgctctgtcacccaggctggaggatctcggctaactgcaagctctgcctcctgggttcatgccattctcctgcctcagcctcccaaatagctgggactacaggcacctgccaccgcgcctggcttattttttgtatttttagttgagacagggtttcattgagttagccaggatggtctcgatctcctgacctcgtgatccgcccacctcagcctcccaaagtgctgggattacaggcctgagccaccgcgcccggcccacaaaaaatattttttaaaaattagctgggcacagtgatgtgcacctgtggtaccagctactcaggaggctgaggcaggaggattgcttgagcacagcagttcaaggcttcagtaagctaggatcgcaccactgcattctagcctggacgacagagtgagacccagtctcaaaaaaaaaaaaaaaaaaaaaaagttgccttttagtacaaatatattgataaacatattacaaatgtacatctgatacattaatacatacatacataacaagtaatcattgtgggccttgcatgtagttttcttttttgtttgtttttttgagacagagtctcactctgtcacccaggttggagtgcagtggtgcaatcttggctcactgcaacctctgcctcctgggttcaagcgattatcctgcctcagcctcctgagtagctgggattacaggcacccaccatgaagcctagttaacttttgtatttttggcagagacagggtttcaccatattgggcaggctggtctcaaactcctgacctcaggtgatccacccgccttagcctcccaaagtgctgggattataggcgtgaaccacggtgcctggcctctcatgtagctttatttgtgttttgttttgttttttgaggcagagtctccatccgtcacccaggcgggagtgcaatgcgcatgtttgtgggtatatatatacatatatatatattttttttttttttctttttttgagatggagtctcactctgttgcccaggctggagtgcagtggtgtgatcttggctcactgcaacctccagctcctgggttcaagcgattctcccacctcagcctcttgagtgcagctgaaactacaggcactcgccaccacacctggctaatttttgtatttttagtagagatggggtttcaccatgtcagccaggctggtctcgaactcctgaagtcaagcgatccacctgacttggcctcccaaagtgctggggttacaggtgtgagccaccgcgtctagcctcatgtagttttgaaagacaaactaggccgggcacagtggctcacccctgtaatcccagcactttgggaggccgaggcgagcggatcacgaggtcatgagatcgagaccaccctggctaacacggtgaaatcccgtctctactaaaaagacaaaaaaaattagccgggcgtggtggcgggtgcctgtagtcccagctactcgggaggctgaggcaggagaatggtgttaacctgggaggcagagcttgcagtgagctaagacagcaccattgcactctagcctgggcgacagtgagactccgtctcaaaaaaacagaaagacaaattagtagtcatttctactgtttccgagtgtccataaatcaaacaaacacagttaaaggaatggtattcataggccagacgcagtggctcacgcctgtaatcccagcactttgggaggccgaggtgggcagatcatgaggtcaggagatcgagaccatcctggctaacatggtgaaaccctgtctctactaaaaatacaaaaaaattagccaggcgtggtggcaggcgcctatagtcccagctactcgggaggctgaggcaggagaatggcgtgaacctgggaggcagagcttgcagtgagccgagatcgcaccactgcagtccaggctgggtgacagagcgagactccgtctcaaaaaaaaaaacccaaaaaaactggtattcataaattatagctttaagtcatgaaaaacaagcaataacatttgtttatgaaggcaggaaatatgaagattaaagaaaatatataccctccccactctgtcatgtggtggggggcaggaggagggacagcattaggagaaatacctatgtaaatgacaagttaacaggtgcagcaaaccaacatggcacatgtattcctatgtaacaaatctgcacattgtgcacatgtaccctagaacttaaagaaaaaaaaaaaagcttgtggaacaaggagatatagatatacatgtatatatatacacacacatacatacacacacacacacacacacaccctccccccaaaaaacctcttttggaccttaaagaggcaaacactggcctatccagaaaaaaacggctatttacaacaagcaatctctagaaggctctgaaaagcagaggttctccataatatcattttggttttctcatgactgtgcaattatacaacaaatgccatgcacctagcaccctgtccaagaacatggaccaatgtggcaccccagcctcccacaggcctcactgaagactgccttgctcacagggtggccatgattctgcacttggtcctgttttgtcagcccttgcttttcttccttctaatcctggggctttcaaggcacaaagtgtgtttgagacagacggaacataaagcctcccatgcaaggatctggcgcccaccccacccaccctgagcccccagccccacctccactgctcagttcacacacccatctcttcggtccctgaacacacctgcctgcaggtcactctcatcccttccagactacccagtccagagcccagctggtgaaggagacatattacttggcagtgcagtgctctgagtacctgaacactgcccagcagcagcactgtctactccactaacctgcctaatctgcacatcagtgttcccacacatggaggaaaggccccagaggtaacatactgttttgttttccatctacttttgacaataaattctaacatagatagactagtaacaacattttttcttttttttttttgagtcagtgtcactctgtcacccagtggtgcaatttcggctcacagtaacctccacgtgcctcagccttccaagtagctgggactacagctaccatgcccagctaatttttaaatttttagcagagatggggtttcgccatgttggccaggaggctggtttcgaactcctgacctcaagtgatccgcccacctcagcctcccaaagtgctgggattacaggtgtgcgccactgcatccagccagaacattttttaaaaaattctttttaattttttaaaggaataactttgaattcacaaagtatattcttacttatttacttatttatttagagacagggtctcactctgccgtgcaggctgaaacacagtggggtgatctggaatcactgcaagctctgcttccctgactcctgggttcaagtgatcctcccacctcggcctcctaagtagctgggactccaggtgcgcaccacaacaaccaacttatttttgtactttttgtagagaaggggtctcgccatgtgacctaggctgatcttgaactcctgggctcaagccattcgcctgccttggcctcccaaagtgctgggatgagaggcatgagccaatgtgcctggttacttatttattttgaatatttaaaagaatttttgacaagtaattatatgtatatttacggagtacaatgtgatattctgatatatatccacattgtgaaataaatcaatcaagctaatcaacatacccatcacttccaatttgctctgtggtgggaacacttaagtctactttactaacaattttgaaacacacgttattatgaactactctccgtgctgtgtggcacatttctaaaatttattcctaactaaaactctgtaccctcagaatatcatctccccacttccccaccctcccccttcccacttttattctttctgactcctgctgtcattggaaccatcatgcgagctctcatttgcatggggaattgtatgggatactatatagaacaaactaaagatagaatcttttgttctctagctgtttgtgctctaaagcggacaatttcacgaacaaagaaaaagcctagcagaaaattccacgctaacaacggaatacaaagaaatactactcaaagaagggcatgttaaaaattgttatgtcaggtgcttcaacgagcatgtcacagttacacaaatcaaacagtactttattaaattatttagatagaacaggcaccaaataagactttgtaatagcctctaaatcagagtgtggggtcacggaagggagatgcctggtggagaagaaaggggtataatttaaagtacaagaaataggctagaagtggtggtggctcacacctataatctcagcactttgggaggctgaggtggaaggatcacttaggggccaggagtttgagaccagtgtcagcaacaaagggagaccctgtctctgtaaaaaaccaaaaaatattagccaggcatggtggcacatgcctgtggcctatgccacttgggaggctgagtaggaagggttactggagcctaggacgtcgaggctgcagtgagatatgatcacaccactgcactccagcatgactgagtgagaccctgtctcaaaaaaaaaaaaaaaaaaaaaaagaaaaaaagaggctgggcgtagtggctcacgcctgtaatcccatcactttgggaggccgaggcgggtggatcgtgaagtcaggagatccagaccatcctggctaacatggtgaaaccccatctctactaaaaatacaaaaaaattagccagtgtggtggcaggcgcctgtagtcccagctactagggagggtgaggcaggagaatggcgtgaacccgggaggcggagcttgcagtgagccgagattgccccaccgcactccaggctgggcaacacagtgagactccgtctttaaaaaaaaaaaaaaaaagagaaaagaaaagaacaaataggagcccatgaagggaattatctcttgggatggtaaaccaaaggaaggcagggcagacaggccagatgagagaatggtgagagcagctcacagcgcattcccgtgtgtctgccgcagcaaagcacacacagcacaatgctgttctaaggctcaatacacttaatccctcaggatcctcggggcaggttctgtgatttcctgagccagggcactgacatcacaagagggcgagggccaaccagccctgagaaacaggcacagagaggtaacttccccaagttcacataagtaggatgcagtagaactgggaagacagaggtctagaaactgaaagagacaggagaagggagaaagaaaaatcagaacttgtattaatgtgattcagacagtgaagaaatggcagtgttctttcagcccaggtaagtggaaaactggacagggaatatgcacctgtgaacgctgcaccttgcgtgcccagagttctgattcaacttcctaatttcttcactgcacagcacagcaaatgggttcaggtacttttcccctaggacaacagagcagcccctgaatgtaacaagcagcatcctgctcatgcccacgcctacctggagtctgtgccccagtgcatggcgtagatcttggccaggtgcccccgcagtgtcctcctcgtgcgcatttggattcttcccactgggtcgatgttgtttgtgatcttgaaaataaaaacatttctgtaaatcaacatctgtgattaaacgattctcctcatcacccatccttgtcaaggctgttggctcgcccactgtgcctacctcttcccagcccttcccacagttctccagtggcttccactgtggcattctgcactgaaccccttccgtacctcttaccaagtctcagtctggctggtcatcaggaacctgtgtgccctgccctccaatgcacgcacacgaacatggccagccttgaagcacttgctgttcccttcctgcttccttcctcctctccctgtccatccaggaccatctcctcctaggtctctgagttctttgagatctcgcaactcttcttatgacaccacacagatgtcccacaccacaatttaatagctggttcctatgtcaggctatgtgtgggcctgcatgacacctgcttctgcacgaccatcacttggagcaccagctgtacacacacctgctgagcccatcctacatatagacactgatgttaatgagtttaggttggcaaacggagtaagtggattacaatagtgggttttaaaaacggacagtccaaagtgcttctcagaattgaaattcaggtaattctatgtagcctaatttttttttctttaacttacaatttaacctcaattaaagcacatcccctaaagcatttagacaatgtaaaaaacttaatcatcttcagtagaagtaggaatatagtttttctttcacatttctgtccaattatttggactttatttttattatcttttttttttttttttttttttaagatggagtctcgctctgtctcccaggctggagtgcagtggtgcgatctctgctcactgcaacctctgcctcccgggtccaagcaattctcctgcctcagccccctgagtagctgggattacaggtgtgtgccaccatgcctggctaatttttgtattttagtagggacagggtttcaccatgttggttaggctggtctcgaactcctgacctcaagtgatccacctgcctcggcctcccaaagtgctgggatggacttcatttttttaataaggtgaagttcacgtaacatccaattaatcactttaaagtctacagttcagtggcatttagtacactcattgttgtaaaaccactgccaccatctagttccaaaccatcttccaaaaggagaccagacattgattcagcagtcactccctgttcacttcctctccctctctcccctaacacccctgctggccactagtccactctgtctcagtgaatgttactattctagatatttcatataaatagaactaaacaatacatagccatttgtttggcttctctcactatcgtaatatttatggggtttatccacgttgcagcctctgactgtactgacgtccatttaatggctgataatactccagggcacagagacaccacaatttgtttctccactcattcatttatgcacattttggttgtttctacattttggctattgtgaatggtgctgctatgtacatgtgtgtgtttgaaaagcagtgttcaatcctgttgggcatatatttaatggcagaactgctgagtcatacaataattctatgtttaactttttgaggtattatcaaattggatattagaaatagaagttctgaggcagattctgttgaggagaggagcttcaaaatatcttaagacaataacaatattttacaactattaccctctgtaacaggtagatgattattcaaggcttgagatatctcatttttatctcaataagcccctctatttcctatgcctaccatcagaatgacttcttaataaaagcagtggcttggcatcctcactgcgcaacagagaatgcaagcagagccctcccgaggctccaggtgtgggtgccgtgctagcctcctcacaggcagatggctctgcgtgactcagtgggctcttacctgagagagagttgcatctgcacatgctttcctggcgtcctgggaagcaaggacagtgagaaattagcaacctttcagatacattcaatctcaggtccacacataccaaagtttcaaagagagctttcctaagctgtcaggagcaaaagcagaatgtgaaagaacggcagagtctccttgcatctcaacaccccatggtctactaccatctgtggactgtccaggccacgctgaacagagaaccagtagtacccaaatctgtctaagacctgcagcacaatattcctggggacccacagctgtggccagcaccgaggagaccacactgcaagctggggcagcacccacacacccgggaccctggtgctgcctgtgccctcactgctgcacaggctggcacacacgacttgctctttttacaaagcccatctagggtcaggaaggctgtggcccaaagaaaaggtctattaaaaaaaaaaaaaaaaaaaaaaaagtctaaaaaggaccagatacccagcccaaaaaaacttttcttcagactgcattaactaagtactttgttttcaagagaaacaatcattaattctaaattctatggagggcgcggtctcacgtctgtaatcctagcactttgggaagctgaggcaggaggatctcttgagcccatgagttcaagaccagcctgggcaacaaagtgagaccttgtctctactaaaaataaaaattaaaaatttaaggaaaataggctgggtgtggtggctgacacctataatcccagcactttgggaggccgaggtgggtggatcacctgaggtcaggagttcaagaccagcctggccaacatggtgaaaccccatctctactaaaaatacaaaaaatagctgggtgtggtggcgcacgcctgtaatcccagctactcaggaggctgaggcaggagaatcacttgaacccgggaggcggaggttgcagggagccgagactgcgccactgcactccagtctgggaaacagagcaagactccatctcaaaaaaaacaaaaataataataaaataaaataaaggaaaacaaagaaaaataaataaattctatggaaaacgagcaagggacctggagccagacaatcagatgtacatgagcctcttggctgttctcgttgctcatctacaaatgacctgcggctgcaggtaggcactgtgaagggatccaccaatgctaactcaagtgtcttcattactaagggatcaaagttactagaaaatagacctggaaatctcaaaagagaacgtacgtttagaaatagaaaggtacgtaacatgaaggaaaataagacaatggctaacaggtttaaagtttgagtgttggtataattttttttttaatcacaactattttttttttttgagacagagtctcgctctgtcttgcccaggcgggagtgctgtgtcgcgatctcagctcaccgcagcctccgcctcccaggttcaagtgattcttcccgtctcagcctcttgagtagctgagaccacaggcgtgtgccaccacaccggctaatttagtatttttagtagagatgaggtttcaccatattggccaggctggtctagaactcctgacctcaggtgatccgctcatctcagcctcccaaagtgctgggattacaggcgtgagccaccccgcctggcctctttttttttttaaactatgtatttatttatttttatgacaggatctggctctgttgcccagcctggagtgcagtgatgtcatcacagctcactgcagcctcgacctcctgggctcaggtgaccctcccacgtcagcctcctgaatagctgggactacaagcatgcattactatgcccggctaattttttttttttttttgtagagatggggatctcgtcatgttgcctgtggctggtcttgaactcctgggctcaaatgatccttcccccttggcctcccaaagtgttgggattataggggagagttaccatgcccagctgacactttctagtaagaaaaatgtgtttatatgctgtcatctgaccatctactttcaaaatggcaaatggcatgtgcagcccttacaggcgtgcgtccaagtgccccacatggggaaggtggaggacgagttcccagcggttcaggcttttggggcaaactgctcactgcaaatgatttctactttaggaagcttgtgggaatattataaactgataatatggaaatatattggtcaggcgcagtggctcatgcctgtaatcccaacacctcaggcggctgaggtgggtggatcacctgaggtcaggagttcaagacaagcctggccaacatggtgaaaccccatccctactaaaaacacaaaaattaaccaggcatggtggccggcacctgtaatcgtaactatttggggaggctgaggcaggagaatcgcttgaacctgggaggcagaggttgcagtgagctgagatcacaccactgcactccagcccgggcaacagagcgagactctgtttaaaaaaaaaaaaaaaaaaaaaaaaggaactatactgagattattataaatataccaaatttatacattccaaattcatctttagttaagctctttattggtcattctgcttataattaagacacacacaaaaaaatcgagtatttctatgcaagcagtaacatttggagtaagggggatgaagaatacttagagcagcagaagtctttttgtcaatgaattttactggcaagtactgagtttaatatttgtttttgaaatactattcttgttgatgttacagcctttgattttaaaacatcataagaaaatttaaaatggagaaaataaaacatgagatttaagcaacttcccccggttagtgtccaatgactaaaatgagtttcttaaggtacagtgtaacagactgtggtgatactactgttaaaccgaaggaaaaactactgtaaaaacaacacacagataacttcaattcaatctttattttagccaataaccagcttatttaactgagtgcagcactttgcagaacagacaccttcaacttttaaaactgtaggaagaagtcttttaatggaaacaagctctataactgcttaacaaagaagaaaaagtcttcaagttctttcagattaatttccagtttaatggactcctgtagatacatattatgatgtccacttaaaccagagatgaacatatccaagccactcatcagttgatttctcattctttttggatttgtcaaatgacacagtaacacacttactttggggtttcatcctaaattaaagcctgggccctgctcagcatggagtcgctggacattttggaccgggcatccattgcagctgcctctcgcacgaatggaccctgctcccttgcactggctggcatgccgctccagaacacatctacgcctgtgcatcctgtggagctttccttactccatcagctactctgtgtattttaaggcacaccatgttttaatcagaatccctctgagagcctgtgtttcctcaataataatcaaaaggagcatgcaaggtcctttaagggtcttttggctgaaaaacaaatctaagaaagaaaacagccccttttagaatcatctacaatttcttgtttgattcactatgctctgcattctttaacaagcacgtattccttgggcaatcaggaaaaaatgttctacattttaaaaataagtcttcctttcccatttggggtaaaaggacttcaacagcttttgctgtccctgtctcgtgcaaaggaactaacacagcgcggttcctggtacttcggagacaaagcagctaggcgcctctcctagtgaacgtcccaccgcgggggccatgacctgcctgtggctgctgcgcacagcaaacggaaccaggagacttgggacaaaaacagtgtcaaatatctcaattaaaatgtattaattacacattgcataataaataatattttagatatactgccttagataaaatttgttgggccaggcatggtggttcacacctgccagcactttgggaggctgaggcgggaagatcccttgagccctaggagttcaagaccagctggggcaacatggtggactctgtctctacaaaattgaaaaaaaccagccaggtgtggcagcatgctcctgtagttccagctactcgggaggctgcagtgagctgtgatcgcaccactgctctccagcttgaatgactgacagagaccctgtctcaaaacacacaaacaaaaaaatgaaaaaaaccttgttagggttaattccacccgtttcttttcattctttttcaaaagacagggcctttctaccttacaaaggctggtctcaagcttttgggctcatgcaatcctcctgccttggtatcccaaagtactgggattaacggcatgagccacggtgcctggccgtctctctttttactttttttttttttttttttgagacggagtctcgctctgtctcccaggctggagtgtgcagtggcgcgctctcgcctcactgcaagctccgcctcccaggttcacgccattccctgcctcagcctcccaagtagttgggactacaggcgcccaccaccaccacacctggctaattttttttgtattttttttcttttagtagagacggggtttcaccgtgttagccaggatggtatcgatctcctgaccttgtgatccacatgcctcagcctcccaaagtgctgggattacaggcgtcagccaccgcgcccgacctctttttacattttttatgtggcaacaagagcatgtggggaatgtcacgtgacatttgtgccagcccaagagggagccccctgtgcaagaaggccctggggaattcacaacgtgacagggtccaaacctcggaaggaggtgcaacagttccttttggccttaattttttaaatttgggtgtctttcacctgtgccatacaagctctttccatctgctatgaatagatccaagtccactatttgtgaacaacttatagctgtcagaaaaacaaaatttcttcaaatatgccaaatcaccctactatttaagacattttcagggtaaactttaaaattctgatttctaggccgggcgtggtggctcatgcctgtaatccccgcactttgggaggccgaggtgggcggatcacgaggtcaggagatcgagaccatcctggctaacacggtgaaaccccatctctactaaaagtacaaaaaattagccgggtgtggtggcgggcgcctatagtcccagctcctcaggaggccgaggcaggagaatggtgtgaacccaggaggaggagcttgcagtgagctgagatcgcgccactgcactccagcctggggaacagggcgagactgtctccagaaaaaaaaaaaaaaaaaaaaaaaaatctgatttctataagatgaaatatagtctcaaaagcaggtggtaaagagctgagagtgttctgaacccccccaaaaacccagttagattattattaaataacaacactttgcttttcttttttacttgccaaaaaccatgctgacttaaaatgaacagcagaagcttaagtattaagtcaggcaaaatttgaataccttttggttttatttaaatagatatttcagagaataattttatatcaaactaaatatttcagaacacatttgattaattttggtggaggggacatgttaaacaagtctgatcagagcaaactattaaaaaaatctaagtcttccctattcacctatgtaagatcttttaaatgttaagatttaaaattcttacagtagaggatactttgttttctctttggctgtaaatctcagagaattccattattttttctcaagttcaggaacaagttgcctaaaattatgttggtgtttctctctccaaatcctggtgggctttctaaacatgtaattggccgtttaaaaggaaatacttgacttcatccttgcactggagtcagaaaaataaactgttgttttttattttattttactgtattttgagaaggtgtcactttgtcacctaggctgcagtgcagtggtgcaatcacagcttactatacagcctcaacctcctgggctcaagtgatcctcctgggtagctcagactacaggcgcgcaccaccatacccagcttataaactgttatttaggtatgtactgaatgtcatcagcttcctgtacagcgacactctgaagaacagctaaagcttgacagagcaaacaagagtaagagaaagctcttacatcaaatggacaaaacctaaaaacatactgaagacgtggtttttcctgagaagtctgcctctttttctcttactcttcacatcagcagtttcagaaaggaaacacatacttgcattaaatgtttctctataaaatatttactagaagtactgcttcacaaaagtaggagcagcagaatgaattccatttagacctactgctcctcccttttcagaaagttatgaggcaagagaattgcttgaaagaggttgcagtgagacgagatcgcgccactgcactccagcctgggcacaacagagtgaaactctctctcaaataaaagtttatgaactctgcaatttaacatcctacatcagtcacagactggaatttaatgttttagaattctgtgaaaggtattctttttacagtgcagtttatttacacacggtaaataaatttatcttcaattttttttttatttttcagggtctcactctgacgcccaggttggagtgcagtggcacaatctcggctcactggatcctctgcctcccgggttcaagggattctctgactttagcctcctgagtagctgggaatacaggcacacaccaccacacccagctaatttttatattttttgtagagatgggggtttcactatgttgccctggctggtctcgaactcccgacctcaggtgatccacccgccttggcctcccaaactgctgggattccaggcatgagccccccacacccggcctctatcttggatttagatatatctgctccatctagcagtctatcagaagctgtagattccaatcatcaccgctagggaagatctttcaaaattaggaaaaaatacatcagatatacctgaaatactttttttattgttgttaatactcttacttttaagcaagttttctgctgtcaatagtcccaatattcaggggagggaggtagatatcacagtctgatcagtggcccagggtatcacaaattttcaaggttatgataaagaatgcaaaagacacttataaattctacggagacatctggtgtatattcaaataacaaattgtatacagaaagcaaaatcccaaaaacaatgtactaggctaagtatctagatctataattagtacatcctgggccaactaagattcaatttcatataaaacatagaacaagtcatcctgtaaaccatttttcctaaaacaagtaacatctaacctgaaactcaaatgattaataaaaccaagcacacacaactacatactcgaatctggttcttaagttgctcggcctcctgccgtaactggtcaagctcactcatcttccgatcttagtgctcttcaatgccaccttcaagaatgtgagatctgaaacagaaagacaagcacaatcaataaacaactgttggataatttaatgaagcaggtgagaaaagtaaattgaaagtttaaggtgggcgtggtggctcaagcctgtaatcccagcactttgggaggccgaggcgggcagatcacgaggtcaggagatcgagaccatcctggctaacacggtcaaaccccttctctactaaaaatacaaaaaaattagccaggcatggtggcaggcgcctgtagtcccagctacttgggaggctgaggcaggagaatggcgtgaacctgggaggcagagcttgcagtgagccgagatggcgccagtgcactccagcccgggcttcacagcaatactccgtctcaaaaaaaaaaaaaaggaaagtctgagaactatggtctcattacaaaccagagaacttttcttcagcattcatcagaacttatacaatggctaagtagggccaggtaaataaaatataattatgattatttattggctttgcataatattacaatgtctaaaatactactcaacatatgctggtgggttataaaaagaaaaatctgttaagcatttttcataaaaaaatctaggtctccctataaatccaagaacataagactgacatttaggccaggtgtggtggctcatgcctgtaatcccaacaatttgggaggccaaggcgggtggatcacttgaggtcaggagttcaagaccagcctggctaacatggtgaaacccgatctctactaaaaatacaaaaattagctgggcatggtggcacacgcctgtaatcccaactacttgggaggctgaggtagaagaatcatttgaacctgggaggcagaggttgcactgagccaaaatcacaccactgcattccggcctgggtgacagagcgagactccatctcaaaataaaaaaaataaaacctgacacttaggatagctatcgcatgaagacctaggggaagttacttcagggaacgggggtgagtggcaacctggcaaccaagaatctcaaagccacctcatctcagtaaccatgaaccgctactggtcaaaagctgtcaggatgctcacacagcaatcctgagcacacagggtgtgtccagcagttttttggctcagggacaacccactctcccacccaagtgagccctgggatcccaggaggctcagaaacaacaccttgatccttataggtgcaggctaaattaggctcagtacaagccgccctgccttctcgccctactcacgttagacaatattcctgaaatcaaagtaaaaactaaatcaccttgttaaacaagagacttattttcccaagagaatgtcataaatggaggctgcatttctgaccaagatcttagctgttaatgtatgactgaagatcttggctgttaagtatgactcaagtataacaaagctgaggacacagttgctaatgtctttaatcccttacaattagctctcacatgcaagtacggcttatgcaagcacttcaatttcctacataaattacacagaggatcaattttaccattataacttttgtgtaagtcaaaaggctaatacaatatacatcaaaatctaactgatagcagttattttcttgagattaaaacccatctgtgggaaactatccgatgacctaagaagctcagccgtcagtttccagtctgaactttcctagtgtgcctaaaggaattcgaataacctacagtatagatacttgatgtctacggtccacagaaccagaaaggcctgcaaggcatgccccgtaacacgagcacgcagaccaggcatcctgctgccactgctctctggggaggcaggctgcacagcaacacggtgtcagaaagatttctgaccaaatagttgtttctaaaggcattatttgaaacggatgttttaatcatgaggaaagcttcactaaggaaaaatacctcaggcctccctgcacacatggagcatcaccggaattaggtatggacaaggtcacacctcaagggcagtttattcttaagggataagactggttaattctttccctggttttcacatataaatcctagcgactgtgatttgtggacgttaatgtgttaagcagtaagagtgccaggacaagatgagcagtgtctcagatggaagctgtctggatgccttgtgctttgcattctttctgcatgccctgacactactcacttgtatttcacacatgatcaaattatattatgcacacaattttgcagagttgggggtagttttatttcaccagcaccccgcacgcataatagagaattgttcttagtctgtaaagctactttaatccttccaaaatcaacatgaagaaaacaagttaatgttatgaagtaccccgaattaaactgttttagttaacacacacagtttctgatcatttaaacactaaaaagtaaagctaatttttatagtacgggactaaaaacaacaaactcctgggatctcgggaaagagaaacgcatgttctgagatgcttcaaaaatgatgttccggctgggggcggtggctgacgcctgtaatcccagcactttgggaggctgcggacaacggatcacctgaggtcaggagtttgagaccagcgtggttaacatggagaaaccccatctctactaaaaatacaaaaattagccaggcgtggtggtgtgtgcctgtaatcccagctactcgggaggctgaggcaggagaatcgcttgaacctgggaggtggaggttgcagtgagccgagatcttgccattgcactccagcctgagcaacaacagcgaaactctgtctcgagaaaaaaagagatgtttcttgtggctggagggtggtgggtgggtgtgtaaaggcccaaattccatcattaggtgggataactcctgaaatcttacatactgcttttaattagatgttcttttcacatattatacaagaacatgtacacaacaatcacccagctgtattgcttgagactagagaaacaaatttaccaaaaatctaagtatctttaaaatgagctcaatataacttagtgacctcacaaaatttcagaagtagtaatgccaaaactcgctaactttcatctttagtcacatgcaaagagaaaaaaaccagacggacttctttttcatagttaatagcagaaattattatagcactctgctgtgccaacatttgagtttcaattcagagactcaaaacctacgtttgtcaattttttttaaaaaggcgtattcctggctgggcatggtgggctataatcccaacactttaggaggtcaagtcgggaggactgcttgaatccagcagtttgcgaccagcctgggcaatatggcaaaacgctgtgtacacacacacatacacacatacacacacacacacacacaatttttgttagcaataaaaataaatttcctggtcaggccctcttcagtccacacatagaagtgataagaaaaatctattgtcaggcatttcaatttttttaaaaaaattacattctctagtctccaggataaagatatattttcttttcttttcttttttgagacggagtttcactcttatcgcccaggctgcagtgcaatgatgcaatctctgctcactgcaacctctgcctcccaggttcaagtgattcttttgcctcagcctcccgagtagctggaattacaggcgtatgctaccacgcttggctagtttttgtatttttagtagagacggggtttcaccacgttggccaggctgtaaggaactcctgacctcaggtgatccgcccgcctcggcctcccaaatgccgggattacaggtatgagccatcatgccccgcctaaaaatgtattttctacaatcaaattgaaaaaaatttttggagataaactcaatgatcagtaccatctttttgttatgtggacatgcaccagacaccctgtacaggagttcaggcacagcagtgaactggctgatgggatgaggcaggagagacgagaaaacgtgaccatcacattccccatgggctgcaagggaaccaggtgccaggaagagcgaacttaagggaagcaaacaaccttctggttcccataaacagccttctcagtggctcttagttcatctttaccgtgaagacagtgaacgaaacaaaaacgaacagtgtacaaagcatgatgcttttgtgtgtacaagaaggacaaacgccaatgccagggcaagccatcttttttcttttttttttgagatggagttttgctcttgttgctgagactagagtgcagtggcacagtgctggctcactgcaacctccgcctcccgatttcaagcgattcttttgcctcagcctcccgagtagctgggactacaggcacatgccaccacaaccggctaattttttgtatttttagtagagacagggtttcatcatgttggccaggctggtcttgaactcctgacctcaggtgatccgcccacctcggcctcccaaagtgctgggattacaggtgtgagccactgcgcccggcccgccatcttttttctacacacaccagatgttatggcgttgtttttggagaaagagaaacaggttagcagcttttattcttctcattattcttcaaatatagtttgcttactaacccccctacacaccaacacacgcatacaaagttaacagaggctaatctggggtcctagaacaaagaaacatttttttctttatacttttcagtttcaataaaataatattacatttttttttttttgagatggagtcttgctccgtcgcccaggctggagtgcagtggcgcgatctcagctcactgcaagctccacctcccgggttcacgccactctcctgcctcagcctctccgagtagctgggactacaggcgcccgccaccacgcccagctaattttttatatttttagtagggacggggtttcaccgtggtctccatctcctgacctcgtgatccgcccgcctcagcctcccgaagtgctgggattacaagagtgagccaccgcgcccagccttaatgttacattttttaaaaaaaatttctgtgagggtctcacactcttgcccagggtggagtgagtggcatgatcatagctcactgcagttcaagccatccttctaccttagcctccagagtagccaggactacaagcagactccacccatcacacccagctatttttgaaatttttggtagagacgaggccttgctatgttgcccgggctggtctcaaactcttggcttcaagtgatcctcctgccaaggcctcccaaagcgctagactctaatctattgcatgagccaccacacccagcctaaagttaactttttaaagttacctgatgcagccaggtgcaatggctcaagcctataatcccagcactttgagaggctgaggcaggtggatcacctgaggttaggagttcgagaccagcctggccaacgtggtgaaactccgtttctactaaaaaatacaaaaattagccaggtgtggtgatgcgtgcctgtaatcccacatactcgggaggcttaggtgggagaacggcttgaacctgggaggcggaggctgcagtgagcagagatcgtgccactgcactccagcctgggtgacagaatgaggctccatctcaaaaaaaaagttacttgatgcaattcgctgggtatcgtggaacgtgcctgtagtcctacctacttgggaggctgaggtgggaggatcgcttgagtccaggagttcaaggctgcagtgagctatgatagcaccactgcactccaatctgggcaacagagcaagatcctgtctctaaatagttactggaataactgtaacatattgctaagaacaataaggaagacagtaataatttgggaaaacgcttactatatactaagtcaaaaataatataaatttgcatatagttattttatttgagactgagtctagctctgaggcccaggctggatggagtgcaatggcgcgatctcggctcactgcaacctccacctcctgagttcaagcgattctccttcctcagcttcccaagtagctgggattacaggcatgcaccaccacacctggctaatttttgtatttttagtagagacagggtttcgccatgttggccaggctggtcttgaactcctgacctcaagtcatctgcctgcctcagcctcccaaagtactgggattacacgcacccggtcacatgtagtaattgtagctgctttattataattaaaataggtctgggcgcggtggctcatgcctgtagtcccagcactttgggaggctgaggctggcagatggcttgagctcaggagttcaagaccaggctgggcaacaacatggcaaaaacctggtctctactaaaaatgcaaaaattagctggcgcagtggcacacgcctgtagtcccagctacttgggaggctgaagtgggagaatccacttgagcctgggaaattgaggctacagtgagccatgactgttccactacactctagcctgagcacatggagtgagaccttgtctcaaaaaaaaaaaaaaaagaaaagaaaaaagaaaaatatactcactttaaagaaagatagaatagcatttttattataactattagtcacgtttttctactaaacgtaatattgatgcagcttcctttgaaaattaaagaataaatgtaaattttaaaagtcttactcacatttaattgctcttgcttttctcttcgcttccctcagtcccccagaccttccagaacacccaccaccaggtttccctggcctgggctcctctcctccggtgccgacgtcacggctaagctctggctgtgctgactccaagagcccgcccgtctaatccactaagacaggctctgctaaggcctcatgtctagtcttcctgatgacccatatctgccattggcttttattcagaatctgagttttggaaatccttttgagagagatttgaataacttaaaagcaagcaggtgaagggatctgcccctactttagaacaacatctttgtgagtcaagtgttagcaagatttttaaagtcagaatatttcatatttgcaatgcaatgtgctccgtgtagtgcctctacccttcatggcaatgcagcagcccaggcctctcatccagacccctgagagtctaggaggggcacctcagcggtgccctcaggaccccatattacacagtcaccaataacaacattcaggctgcaagtttgccaatgacaaaatagggtacagatattgaaaaataatttcaagttctggttctgcaacatacaaagaataatgctttcactaaattgttttttactctaatctgcttaattcaaaatgggaatggtgttatctatatcacagagctaaaatgaaaattaaatcagacaaccaatctgaaagtgctctgtcagtctcacagtgattaaactatgacgtgtacctttgactaacaatctcaaggacaacaggcaccatgctcaccaaagtgcacacatgtggtcccaccaccaagcagcaacagggcagtcctgagtcacctggtcaccagctagccgcacacccctgagcctcctgtgcagcactggatggctgcatctctggatggtttggacaacttccgaagtccaaaccggccccagtgtcttacaccggggcaggaaatttgctaacttgaccaaacacacaaggatcacagctcacctccaagacgaagcagcattttgaaagagaggagtttgcatgaggaatttaaaccaatttcactcacttttccatttttctttcattcccaagtccaggtcaatctccaaaactaagactgtgggaattcaaagggcaacggaaaaagtcctcaggccctgcttcccttacgcaccgctcctaacaatactgtgaggaataaggggagcaggggaccaccgcaactgataaaggacacgaccactaacgcagctgcagagcaacgcatgcgcagaccctccctccaacacaacaggcactgtagagcctcagcatggtgctgagcagcatgaaccaggctggattctagtttgagggagacagaagacaaacaggtaaatcacgtggagttacagaggctgggagcgtacacagtcactgcgaacgggtgaagtgtgccaacgagggcagggaggatgctgctttgcatggctgttagacatgaccttgctaatgggccaacatttgagcagcaggcagatgggcaaaaataacacaactgttcttgtttgaggtgctattttttgcaatggtaacaattttaaaaatcttaccttaggattttgcctgtgcctataaagtaatcttaacgaaaaagtgaatgtgaccaaagctctagaactagaagacagggaaacatgttcaatgaccccacagaggcaacggtactacacaatggcctgggaaacactccaggacagacgaccaggcaggtcggttagtctgtctttaacaaataaacttcaagggaaaaaggagagaaagcaaacaatggagggaggatttctggactaagtgaagagactccccagaatcatctccttcatgtcccagtcacaagtgagctcactcacccattagacgctggcaactgggggaagggcaggaactatggtgtgcggtcacaaagccctcagaaggcaattctccagggaggggtctaacagccaggggtgagccagtgaggcacagctgctaagagcttacctctgacccttggaactctgaaatcccagaagtggctactgactctcccgaagccttattatttctcatgcatcacaaaaaacatctgatctcccattctgctctcccttttctaaccctgttagcctatggcctctttttgcttttagggcggagcacaaaatctagcacatactaggacaattggaaatcattcaatagatacacatcttcaaacatgttgaggccaaattggaagtcccactttgatcatttcaaagccaaactttatatgtaactgatggagtctcatgaaatgaatggcatccatccagaagacgggtctaacagggaaaggtggtgagaaactaacaatcatgcagcgcacacaacagaggaggctaaactccaagcactttttttttttttttttttgagatggagtctcactctgttgcccaggctggagtgcagtggtgcgatctcggctcagtgcaacctccgcctcccgggttcatgccattctcctgcctcagcctcccaagtagccaggactacaggcgcctgccactatgccctgctaattttttaaatttttattagagacggggtttcaccgtgttagccaggatggtcttgatctcctgacttcatgatccgcccacctcagcctcccaaagtgctgggattacaggcgtgagccactgcacccggcctccaagcaccttttataaggggcctggaaatccttaggtttagggaaagactgctgtgtgccatgccatctgcactccagtatataaaaataatctttgtttttacatttactgctgcaaactacaatgaatactatgtgctttcccaacagcaaatgggcggtgggggttagaattctgttcctagaaaaacttccgtgtttttattggcatttgcaggtccagcccacttaagcaggaccaatgatgtctgacagccctggctggaagcagagtgacgcttcatggcaggaaagttggaagccccaggttctaacccagactctatctcttctcaccaggtggcctccagtaggtttcctaacttctctctgcctacatttttttgtctgaaagtggggacagtaatagtccccacagctcatgctatgacaattccattagaatccatgcaagccccttagaaccatgactgacacagtaaatgcttactaaatatgacttgctatgaaagcaggtgtaaaactgttgccctgaaagttttaagtaatgtccagaaaactacctcctgcctcacctgccacactttccatccagtcagtgcagtaggcccttttgcagaaatcaaaaatatatgtagcagtggcaaccagtgtaacagtggagttaatcagatagatgtgatactttgaaatctgtgcatgttgttacatgtacaagtctttatgagaacatctgctttcacttctcttgggcagattcctagcggtggaatggctggatcatactacaggtgtgtgttgaacattccaagaaaatgccaggccaggtgcagtgactcatgactataatctgagcactttccgaggcaaggcaggaggatcacttgagcccaggaattgaagaccagcctgggcaacatactgagaccccgtcttacaagaattaaaaaaagaaaaaaaaaaaaaaaaaaaaagccagacatggtagtgcgtgcctatagtcccaactacttaggaagctgaggccagaggatcacttgagcccaggaggtcatggatgcagtcagctatgatcacaccattgtactccagtctaagagacagagtgagaccctatttcaaaaaaacaaaaaacaaactcaaaaaacaaaaaaaaccaactcttttcaaaatggttatgctgggtcacattcccaacatcctataagcaatgtggagagtcccggctcctcacgcccaacaacgctgggtgggtgtcacagccattctaatgggggcgtgggctgtagtctccatctgcatctcgctgactgctgagcttctgaggcactcaattgctgtctatacagtttctggtaaagtgtctgttcaagtcacttgcctcttttttattgggttacctgttttcttaatattgcttttttttttttttttttttttgacacagggtctcgctctgttgtccaggctggagtacagtggtgtgatcgtgactcactgcagcctcaacatcccgggctcaagtgattctcccacctcagcctcccaagtagctggtactacagacacacaacacgatgcctggctaaattttttttttggagacagtctcgctttatcacccaggctggagtgcagttgcacaacctggactcactgcaacctccacctcccaggttcaagtgattcttgtgtctcagtctcccaaatggccgggattataggcataagccactacacctagctaatttttgtatttttagtagagatggggtttccccatgttggccaggttgttctcgaactcccaacctcaggtgatccgcctgcctgggcctcccaaagtgctgggattacaggtgtgagccaccgtgcccgactgctaacttttttttttttttttttttgaagagacaggggtctcactttattgcccaggatggtatcgaacaactggcttcaagcaatcctcctcccaaagtgctgggattacaggtgttagccatagtacctagccaaaattgagttttgagagttcttacctattctggatacaagtcatctaaaagacatttgctaatattttctgccagactatggtttgtctttcgttctctgttttttctaaggagcagaagttttaaattttgaacaaattcaatttataaatgttttcttttacgcattctatctttgatctcacatctaaaaactgtttgcttaattcaaaatctcattttttctaattttacgttttatatttaggtatatgatccattgagttaatttttttttttttttttgagacggagtctcactctgtcacccaggctggagtgcagtagcgtgatcttggctcactgcaagctccgcctcctgggttcatgccattctcctgccttggcctcctgagtagctgggacttcaggtgcccatcaccacgcctggctaattttttgtattttcagtagagacggggtttcatcgtgttagccaggatggtctcgatctcttgacctcgtgatccaccctccttggcctcccaaagtgctgggattacaggcgtgagccaccatgcctggcctttttgtttttgtttttgtttttttgacacggagtctcactctgtcaccaggctggagcacaacggtgcaatctcagctcactgcaacctctgcctcctgggttcaagcgattcccctgcctcaacctcctgagtagctggactacaggggcgtgccaccacacgtggctaaatcttttcctttgtattttcgtagagacggggtttcaccatgttggccaggatggtctcgatctccagacctgatgatctgcccaccttggcctcccaaaatgctgggattacaggtgagccaccttgcctggcctgagttaatttctgtacatgatgtcaagttctccttttgcgtaagaatatccaattgactaaccaggcgtggtggctcacgcctgtaatcccacagctttgggaggccaaggcgggtggatcacctgaggtcaggagttcgagaccagcctgaccaacatggtgaaaccccgtctctactaaaaatacaaaaattagctgggtgtggtggtgagcgcctgtaatcccagctaattgggaggctgagacaggagaatggcttgaacctgggagggggaggttgcagagagctgagattgcaccactgcacttcggcctgggcaacagagcaagactctgtctcaaaagaaaaaaaagaatatccaattgttccagcccctaattgctattcaatttaattttgctttttaatttaaaattatttcaaacttcaaagagttgcaagaataatacaaagaaaccatgtaccctcctcacccagactcactcactacgaacatggcttcattattcccactttattcaaacaaaaaggtttttgttttgttttgttttcctgaatcatgttcaccttacttttttttcttttctttttttttttttgagacggagtctcgctctgtcccacaggctggagtgcagtggtatgatcttggctcactgcaagctccgcctcctgggttcacatcattctcctgactcagcctccagagtagctgggactacaggcgcccaccaccgcacccggctaattttttgtatttttagtagagacagggtttcaccgtgttagccaggatggtctcgatctcctgacctcgtgatccacccaacctgacctcccaaagtgctgggattacaggcatcagccaccgcacccggccatatattggtatttcaactaagatctgatttgaaaaaagggctctcctgctttctaacgaaaaaaactagcgatgtaccactctgattcagaaggtaaatcctcatcactgggaccctaaaccttcttgctcaacactaaatggaagctttttttgaggatcaaattgttttgaaaaccaactttggcttaaaagagatagaaaaaaactgtaacaaaaaccagggtattgaccaggcatgctggcgtatgtctatagcctcagctactcaggatgctgaggtgagagaaccccttgaccccaggagttagaatccagtctgagcaacatggcaaaacactgtctctttaaaaaaccaacccaccagctatttataaaaacaaactctgaagaaatttatatattgtctttctaaaactgatgaggatcaaatatatcaaaattaccttaattcagaagggcttctggtctggtctccaatacatgtaaatttgtctgaaacaaacagaaaaggctgtatttgtattgcactcaggttgtgaataaaatattctattttgctagtagctatattttatgcaacgacacataaatttgacccttccctattactatttctcccccaaaattgctttatttagcagtactgtcatattttgtttttcagcatgggaacaaaataagaaatcagatctcaacttctttaagaatccttagaaatgccccagggaaaataccttgaattaaactgaaaagtatgggcacagaggttagaatcctatcactagaaaaattacagtaacaatttaaaaactaatgcaggccgggcccagtggctaacccctgcaatcccagcactttgggaagctgaggcaggcaaatcacctgaggtcaggaattggagaccagcatggtcaacatggtgaaaccccatctccactaaaaatacaaaaaaaaaaagttagccaggcatggtgtcacaagcctgtaatcccggttactcaggaggcttagacaggagaatcgcttaaatccgggaggtggaggttgcagtgaaccgagatcattccactgcattccagcctaggtgacagagcaagaatctgtctcaaaacaaaaacacacaacagtctgggcgcggtggctcacatctgtaatcccaacactttgggaggctgaggtgggcgcataacctgaggtcaagagttcgagaccagtctggccaacgtggctaactaaaaattaaatgtttttaattttaatgtgttttaagaacacattatgttcttggcagcgaactaaaaaaaaaaacgtttctactaaaaattaaaaaaattagccaggcgtgatggcaggcacctgtaaccccagctacctgggaggcagaggcaggagaatcacttgaacccagaaggtggaggttgtagtgagtggagatcacgccactacacttcagcctgggtgatagagcaagacaccgtctcgaaaagaaaaaaaaaaaaaagctaggtaccgtggctcctgcctgtaatcccagcactttgggagaccaagttgggcggatcacaaggtaaagagttcgagaccagcctggccaatatggtgaaacctcatctctactaaaaatacaaaaaattcgccgagcgtagtggcaggcacctgtagtcccagctactcaggaagctgaggcaggagaattgcttgaacacaggaggcggagattgcagtgagccgagatcgtgccgctgcactccagcctgggtgacagtgcgagactctgtctcaaaacacacacgcacacacacacacagacacaacactaatacaattcaacaaattctgaagattaatttaatccagactttgcctgtttggcatgacagtggagagcatttcatctgaatctcaaggaagccactaaataactactttgtgagtcctggcaagtctatgttgggacacttccaatccctccctctgtccctctcctgctgacacggtcccatccagtgcctggccctggtgcccaggaaggtggcttgaatggtgacagagatcacaagagaggtttctgactcctcttgacatacttctggtggaatgaaaatatgtccaattctagatttcttctgatttcagaacatttattgtattttttttatttttgagacagcagtctcgctctgtcaccaggctggagtgcagtggtatcatctcagttcactggaacctccgactcactggttcgagtgattctcctgcctcagcctcttgagtagctgcgattataggcacatgccaccactcccagccaatttttatatttttagtagagacgggttttcaccatattggtcagtatggtctcgatctcctgacctcgtgatctgcccacctcggcctcccaaagtgctgggattacaggcgtgagccactgcacatggccacatttattaattttttgagacagattctcactctgtcaccctggctggagtgcagtggcatgatcttggctcactgcaacctctgcatcccaggttccagcgattttcctgcctcagcctcctgagtagctgggattacaggcacacgccatgccttttattatttattagtagagatggggtttcactatgttggccaggctggtctcaaactcctgacctcaggtaatccgcctgtttcagcctccgaaagtgttgggattacaggcctgagccactgagcctggcctgatttcagaacatttaaagatgcttctgtaatcgctccctcaaattaaactatgtgaaaagaccacttgtggaggcttcacaggtcaccacctgcctattaattcagtgtcttgtgagtctgcaaactcacatgcacacatctagtctggagtcagtagatgaatcaacaaactgaaatatctcccagttgaactgtgaattctaattcatttacttaaagtagtttcgttttgcaattatgctgcttatgtacaagcaagcacgtacttttccggcagtaaaaatgagtgtggaaggaaaacagtttggcagttcctcaaaaaattaaacacagaattaccccataacccagcaattctactcctaggtatattcccaaaagaactgaaagcagggattcaatgcatgtacacattatgttcttagcagcagtactcagcagccagaaggtggagacagcccaaatacccactgagcatgaatggatgaataaaatgtggtctatccaaacaattgaatattattcagctataaagataaaggaggccgagcgtggtggctcacgcctgtaatcccagcactttgggaaggtgaggcgggtggatcacctgaggtcaggagttcaagaccaacctggccacctcgtctctattaaaaatacaaaaattgccaggcacggtggctcacgcctgtaatcccagcactctgggaggccaaggcgggcagatcacaaggtcagcagattgagaccatcctggctaacacggtgaaaccccatctctactaaaaatacaaaaaattagccgggcatggtggcgggcgtctgtagtcccagctactctggaggctgaggcaggagaatgccatgaacccaggaggtagggcttgcagtgagccaaggttgcacccctgcactccagcctgggcggggtgacagagtgagactccatctcaaaaaaaaaaaaaaaagaagtcctggtcctgtctctgctagaacacagacaaacctcacaaatatgctaagtgacagatgccatacacaaaaagccacatatatacaaccccatttacatgaaatatccggaacacacaaatccaaagagacagaatgcagtggttgccaggggctgcatgtgtctgcgtgtgcatgcacatgtgtgtgcagtggacaattatttaatgggtacagggtttccttttgaggtgatgaaaatgtcatggaattagctagagacggtggttgcaacacattgtaaatgtactaaacggcaccgaatcattcactttaaaatggtttatgttatgtgaatttcacctcagaaaaaaagttgggtgtgaaaaggcacacaggagtaaacagtgaatgatgcaaactaccccagacttcaggaagcgaagcctcgctccggggcagggtcctatgagcatacccgaaaagtgccaccaaatcaagtttcaaagcatgggtctcaacctcagcacaatgaacattttaggcaggggtgtgtgtgtgtccccaggaggatatctggcagcatgccagtagtgctcctttccccagctgtaacagccacctggcatcccgagaggcaatactgaccccagttgagaactcttcaactgtcacaattatctcaaccactaaatataaatcttttcaagtactttccagatcaagggacaggtaggaagagaaatactactaaaaaaaattatacataatctgctctattttatcattattaattatttttttgagacagggtcaccctctgtcagccagtctggagtacagtggcacaatcatggctcactgcagcttcgacttcctgggctaaggtgatcctcctgcctcagcctcctgagtagctgggaccacaggtgtgtgccaccatgcccagctaattaaaaaatatatatatatttgtagacatggggtcttgccatactgcgcaggctggtctttaactcctgggctcaaacgatccttgcaggtcggccttccacggtgctgggattgcaggcacaaggcaccgcacccagctgctctattttaatgcctagattgccctgtggctcaaatcatgactcaagattggagtaaggatgctaaaagtgctatcaaatcaccttagcctggattcacatggagagttgtctggacccatttctggctaaaaacaagatgacccaaatgtatgctctttttctgactatccagctcatagaaccccacactaaggacaggactaccagtcccacaataatgtaaccctaaaccagtagcactacccttaaagaacatcaggagctgggctcgcacctcccagtgctttgggaggccgaggcgggtggatcacctgaggtcatgagttcgagaccagcctggccaacatggtgaaaccctctccactaaaaatacaaaaattactggccgggtgcggtggctcattcctgtaatccgagcactttgggaggccgaggcgggcggatcacgaggtcaggagatcgagaccatcctggctaactcgatgaaaccccgtctctactaaaaatacaaaaaattagctgggcgtggtggcgggtgcctgtagtcccagctacttgggagggtgaggcaggagaatggcgtgacctcgggaggcagagcttgcagtgagctgagattgcgtcactgcactccagcctgggtgacagagcaagactccatctcaaaaaaaaattaaaataaaataaaaataaatttaaaaaataaaaaaattagccgggcacggtggcatgcacctgtagtcccagctacttgagaggctgaggcaggacaatcaattgatcctgagacagggaggttgcagtgagccaagattgcatcactgcactccagcctcgatggcagagtgagactccgtctccaaaaaaaaaaaaaagaaaaagatgggcactttttcaaggctcttgataaaatcaactgactctatacagctaatttagcaatattaaatattaatatgacttctttgcacatatcctagtacttatacttttatttcagcatttttcaaaatctagaaactgaatccttgagacatacctagagaatttctctacaagctgcattaatatttctaatcaagtacaggtatacttgtgggggatgatttcttctctatcaacataatcctaagatgggaaacacataagtgcaccactggttatctacaattctgagatacccaaaccagaataggacacacggcattaggcagactttctcacattcagggtgagcagtcttatgtttactacaaactttggggtatctgattaaagccttgccgtaagtgtggtgcacatgtaacatactcactgcatctttctcaaccctgaaaaagtctatattccggaaaacatccagccccaagagttttgcctaaaggcctgggggcttgtaagaaacaaagtaaactcccttccaaataattctttaattcaaaaacacactgaacaactagaatgtgaaataatactgaacttaatgacaactctgtatcataatcttcaactatatatgatcatactaataaacaggataaaaacaaactagaaatgccttctttcaaacaaaaattagagttcagtatcaataaaaagataacaatacctgtaaaacacaaccaaccaaccaaaaaaaggtctaaagacatcacgttaatttagaatactctaactgtacaaacgtgggggtacattctaagggcaaatagagttctgaaatttaagcgtcatattggtggcataataatgcttaaagtaggccgggtgcggtggctcacgcctgtaatcccagcactttgggaggccaaggcgggcggatcacgaggtcaggagattgagaccatcctagctaactcagtgaaaccccgtctctactaaaaatacaaaaaattagccaggtgggatggcgggcgcctgtagtcccagctactcaggaggctgaggcaggagaatggcgtgaacccaggaggcggagcttgcagtgagccgagatcgtgccactgcactccagcctgggtgacagtgcgagactccgtctcaaaaaaaataataataaaataaaataaaaataataataataatgcttaaaatattaatatggatatgtatgccagagcgaaataagcgaagatatggttatttggggagcaaggctcacactggagaagggaggcacaacacggactatctgaaagcaaggaatggccccctggggttcaatctgaatttggagacaatggaaattctctatacatttattccgctgtagaatcatttgtgtgtaagtccatacacacacacacacacacacacacacacacacacacacacacacacacgtatatctcctatctcttgtcaactgaaaggtctggaagcaacgacctctccacacacaaagcccaaatcttggttttataaaaacggttccctttaaaaggagcttcagggttcctctgagaaatcactccctcaaggtctggcacaggaaccctcttgctatggcagaaaggaagggctccaaaactaaaaagaacatgtcaaaaacacaccagcttgaaggaagtctgctggccaaatttaggacaatctgagggtcaacatgacgaacaatggtaatggaatataccttactggatctaaaaaaagaacacacaagcacatggtaacatataaattaaaaaaaaaaagaggaaaagcgaagctcttctttacagaggaatgccaatacacatagaaggagtaagatttagccgggtgcagtggctcatgtctgtaatctcagcagtttgggaggccaaggcaggcggatcacctaagctcaggagttcgaaaccagccaggccaacgtggtgaaactccatctctgctaaaaacaaaaaaattagccaggcgtggtggctggcacctgtaatcccagctactcgggaggctgaggcagaaggatcgcttgaacccaggagacggaggttgcagtgagcagagatcatgccactgcactccaggctgtgagacaaagtgagactccatctcaaaatcaatcaatcaatcaatcagagtctcactgtcacccaagtgggtgacagccttgaacagctcactgaaaccttgaactcctaggcacagccatcctcttgcctcagccccctaagtagcaaggattcaggcatgtgccacactgcacgtgactaaattttttgtttctttatggagagagggtctcactatgtggcccaggctggtcttcaactcctggtctcaagcaatcctcctcccttggcctcccaaagtgctcagattataggaatgagccactggttctagctgaaagtgaaggacttaaagctagagaatttaatgccagcaaaagggtggcttgatcagtttagaaagagggttggcttaaaaaatgttaagataacaggagaagcagtttctgccaaccaagaggcaccagggttcccagatgccatgaagaaaatcattgaggaaaagaaaatcttcctgaataggtttttaatgcagacaaaagtgccctattctggaaaaaactgccacaaaggacacttattagtaaggaagaaaagtgagccccagcactgaaggcaggcagggagaggccaactctactgctttgtgcaaatgcagccgggtttatgatcaggactgctcttatctacaaagctgctaacccctgagccttgaaggggaagagataaacaccagttgccagtctcttggttgtggaacaagactgggacaacaaaatccctttttctggactggttccatcgatgttctttgtctgcagtcaggaagtacactttgccagtaagggattgccttttaaagttctttagatattggacaaggcccctggccactcagaaccccatgagttcaatactgacggcaatgaagtggtctacttacccccaaacacagcacctctccttcagcctctagattagggggtcataaggacctttaaggctcataacacacagtactctatggaaagaattgtcaatgctatggaagagaatcccaatagacagaacattgtttaagtctggaaggattatcctgctgaagatgccaaggttgttacagaaaaagctgtgaaggccatgagcctgaaacaatcaactcctgctggagaggacgacgtccagatgctgcgcctgacctcacaggatttacgagagccagacgaggaaatcatgaaaagactgtgcatatgcttttaaaagggtaggggggtgggtaaggacttcaacatgtggatcttagagaaattcaagagctattagacaccacaccagaggaattaacagaacacaccttgacagatgtcagtacttccaacgtggtgccaaacgatgagaaagaagcagtgccaaaaacacgtggacactgggcaatctggcagaaggtccccattccccaagactgcacttgacttctttaggacacagagcttttatggcacaggaactaaaactaaagcatacaacagaaggttgctatcatacagaaacttttttagagaaatgaaaaagcaggccgggtgcggtggctcaggcctgtactcccagcactttgggaggccaaagcgggcagaccacgagatcaggtgttccagaccaccctggccaacacagtgaaactctgtctctactaaaaataaaaaaaattagccgggcatggtggcgggcgcctgtaatcccagctacttgggaggctgaagcaggaaaaccgcttgaacccaggaggcggaggctgcagtgagccaagactgagccattgcactccagcccaggcaaaaaaaaaaaaaaaaagaaaaagaaaaaataaaacgaaaaagaaagaagtcagaaattatgtatttcagtaaagttccaccaagtatgcctgtctctcctacctccccttccaccacctccatccaagacagcaagaccaatcccatctctttctcctcctcagcctcaacctgaaaatgagaaggaagacctttatgagggatccacttccactcattaaatagtaaatacatttttctctcccttatgattttcttaatattttctctagcttgatcacaaaaatatataatatataaaacataaaaactgtcttttgactgctatcggtaaggcttccagtcaatagcaggctattagtagttcatgttttgggagtcaagtgatagaagaattttgactgcacagcaggttagcactcctaatccctgtgttaagggtcacgatattccttccctttcactctttgtaacacaactgtctagcattttacttctacatgttttttgaagactccttctgggtctttgttcccagttcctcagaaggagcttcaaaaactattggatgttccggagtgataggcatgtctttgttattcatgagcctccatgtttttgctgagatgagctgactcaagatagaggctggtcaccagaaagacaaaccatgacattagacggttggggtttgaaaccattctgactggggtgggagaggggctagagattgtgctctatcaattgtgcccaagtaacaaagccccaataaaaactctcaacaccaaggctcaggggagcttcctggttagaagctcattgaccccgatttgtcaggagagactccatggggagagggcttggaggatgtgtgcttgagactctgctaggccttgctgtatatatctcttcatttgcctggtctgatttatattaaactagatatagcaccagaagataactgcagtgtgatgggatacacttctgcctgaagaacttcctccatctcacagggcagatctactggcaacaaaccccacaacttttgtctgaggaagtcttttgtgggactaggtctcattctatcacccaggctacagtgcagtggcacaatcttggctcactgcagcctcaacctcccaggctcaagcgatcctcccacttcagtctcctgagtagctgagaccacaggcaccgccagagcacctggataattttttttttgtagagatgaagtctcgctatgttgcccaggctgctctcaaactcctgggctcaagtgagtctgccactcagtctcccaaagtgctgggattacaggtatgacccaccatgcctggcctgtatgaaatactttttttctggctacattcaaaactttctctttgactttcagcagtttgactataatgtgcctaggtgttgagggttttttgtttatatttatggtgcttggagtcctctgaacttcacagacctctggtttgttgtcttttactaatgaaaaaattctcaaccattagctctttgaatatttcttctgccccgttttcttcctagggctccaattatctgtatatttgacagtttgctatagtctcacaactactcaacactttttttttgtttgagatggagtctcgctctgtacataggctgaagtacaatggcacaatctcagctcactgcaatctccgcctcccaggttcaagtgattgtcctgcctcagcctgagtagctgggattacaggtgcccgccaccacacccagctaattttttttttttttccagatggagtttctctcttgttgcccaggctggagtgcaatggcgggatcttggctcaccacaacctccgcctcccaggttcaagcgattctcctgcctcaacctctcgagtagctgggattccaggcatgtgccatcacaccctgctaattttttttatttttagtagagacggggtttctccatgttggtcaggctggtctcgaactcccgacctcaggtgatctgcccacctcggcctccccaaagtgctgggattacaagggtgagccaccgcgcccagcctaaatgctatttttgttctggtttattttcttctgcttgtttcattttggatttctattgacctatcttcagtttcactgattctttcctatctgctgacaaactcactgagaaaattattcatctataatgtttttaaagaatctctaacatttcaatttaactttttctagagtttctgcctcctgaaattctcgatcttttcacatataatgcatgctgtatacctttctcactcaatcttttaccacatccatcacagtcatttaaagtctctggcagttccaatatctgggtcatctctaagttggcttccatttatttctctcttaacaagaaatcgcttttttgtgtatctcataattttttattgaattatcagatgatattcaataaaaccagaattgggtacacctctttgtctgagccactactgtgtggggatgaggggttaattcaatctagtcttcagttgggtttggattttataatcctcaggggaaggctgccttcaacttcgtggcaccatgtatttttctcaaaaacatactggccggccaggcgcggtggcttacgcctgtaatcccagcactttgggaggccaaggcgggcggatcacaaggtcaggagtttgagaccagcctgaccaagatggtgaaaccccgtctctactaaaaatacaaaaattagcaaggcgccaggcgcggaggctcatgcctgcaattcccagcactttgggaggccgagacgtgtggatcacctgaggtcgggagtttgagaccagcctgaccaacatggagaaaccatatctctactaaaaatacaaaattagccaggcgtggtggtgcatgcctgtaattccagctactcgggaggctgaggcaggagaatcgcttgaacccgggaggcggaggttgcagtgagccgagattgcaccattgcactccagcctgggcaacaagagtaaaactccatctcaaagaaaaaaaaaaaaaaaaattagcagggcatggtggcacacacctgtaatcccagctactcaggaggctgaggcaggagaatcgcttgaacctgggataccactgcactccagcctgggcgacacagcaagactgtgtctcaaaaattaactaattaattaaatttaatttaaaaaaatattggccaaagaggaaacctcactactcacacctagaggaggacagaacaaatgcagaaaagcaagccatacaacttcacatgaagatgcaaacagtcttgcaggctaccatgaggacaagcctttactttattttggcagtagactgaatgtctgttaaacaggcattcggccgggcacagcggctcacgcctataatcccagcactttgggaggctgaggtgggtggatcacttgaggtcaggagtttgagaccagcctgaccaacacggagaaaccccatgtctactaaaaatacgaaatcagccgggcatggtagcgcatgcttgtaatcccagctactcgggaggctgaggcaggagaaatgcttgaacccaggaggcagagattgcggtgagccaagatagcgccattgcactccagcctgggcaacaagagcgaaactccgtctcaaaaaaaataaataaagagacattcactttactggaaaaaaaaaaatcaacatattgtggttgaatatataaaaagagatgccaaacgttaggagccaggcgtggtggctcacgcctgtaataccagggggcgatcacttgaggccaggagtttcagaccagcctaggcaacatagcaagatcctgcctctcaaattttttttgagacggcatcttgctctgtcgcccaggctggaatgcagtggcgccatctcggctcactgcaagctccgcctcccgggttcacaccattctcctgcctcagcctcccaagtagctgggactatagacgcccgccaccacgcctggctaattttttttgtatttttagtagagacggtgtttcacgatgttagccaggatggtctcgatctcctgacctcgcgacccgcccgcctcagtctcccaaagtgctaggattacaggctcgagccacggcgcccggcctcaaaatattttttaaaaaaattggcatggtggtgcatacctgtagtcctagctactccagaggctaagacaggaggactggttgagcccaggagttgaaggcagcagcgagccactgtatgtcagcctgggcaacagtgagactctgtctcttaagaaaaaaaaaaaaaagtgaatgtcttgtgtgccttgctatgcacacaggttctcagcccctgagtggagtgcaacttacgggcctaccctacactcaggagccagcaacagcccctcatcctgctctcaccaacccagctccacatctgccacacccagtcacgcccccttctgaaccctcaactggttcttttgtggttcttctctcaagtcgaggatccactccttattccctttccctgaatgtaccccagttcctagaaagctctacgcactgcagcgctctgagggttcaatcctttcagattccaccagtgtaaagcaagcctcagcacccctttcctttccaaacctgctggcagtccctcccagctctcctgcagcacagactcaagcctcccttccatccctttcccctcctgcccctgtgctccactcccactgcttcagcctcttgatggcttaccatctttgcctggcccgttactaatctgtgtctctatcccacctcttttccacttcaatccatcttaacagcactgcctgatttatctttctgaaggacagctctgacatgcgactcctccgctcagaagtcttcaaatactcctcctacggaaaaaatcaaactttttagcctggcctaatttaaagctcttactgactgtattcccaggtactcctccccagggagtcaagtaagcctagaaagggccaaacacatgggcacgaacaccccagacaactttggtggtctctgccgaactctgaccactagtctcttaaagagaaatcctagaaacatgaacatatttttgcctcaaagaatgagagccaatttttaaaggtaaaatatctccccaccaagcaagaaaaaagacatgcttccaaaacttagcttatttcctgcaaaacccacaaaatatagaaagtaccctgagttggaaatgtttttataacccatattctaaatcatctgtgatttagaaagagaactggaaacaggaataatagaaactatgtcttcaggctatttagaatgacacagtgctctataaacctcagctaatgtctaggtttgttaggcggtcactgtgagaaaagcattttgtgagcctactctggtgccaggcaccagtttaggtcagagtaaagtaagcacaaatatttacttgggagtctgagtacatatatagtcatattatataacaacatgaaaataggatagaagtgtcaattgttgataaaacatttaacaataaagtggcctcaatatctgggttcgtatttgtatggcttcattcactcactcaacaacgacctgcccatctccaatcatgtgccaggcaccacagctcaggggagtccgtaggaaacaagacacagcacttgctgttctagaacttgcttgttggtcgaggaaggcattaagcgaacagtgcaagtctttattttgatacatcaactgctatccattgctaaggaaacataaaactacgtaagaaggggaaacaggtgagatggggaggtctctcttagaaggtggccagagaaggccactctggtgtggagaaatctgagcggggtcccaaggacagggtgaacaggtataaagagtccctgagattctgacttattcctactagtcaagatttcttacctgctgaaacactgacaaagcctgccacttctacctctgaatgtgagagacaaattaactttattgtctccatcctggaatgttcagtccaactgctatccttctcttaaattaaactctgacagtacaaaaaagctcagtcataaaaaaaaggtagaggaaggggaccacaatgaagcagcagatacacagcaagagggactcactacaaaacctgttttaaggaagacagatacatctcctgttagtcccagacattccttcctaagtaagtttttaagctgggcgcattggctcatgcctgtaatcccacctactagcgaggctgaggaaggaggattgcttaagcccaggagttggaggccagactggataatatagtaagacgtcatgtctttaaaaaattaaaaagtgcagtggctcacacccgtaatccccgcactttgggaagccgaggtggatggatcacctgaagccaggagttcaagatcagcctggccaacatggtgaaaccccatctctactaaaaatacatccgggcgtggtggctcacgcctgtaatcccagcactttgggagtccaaggcaggtggatcacgaggtcaggagttcaagaccagcctggccaagatggtgaaaccccgtctctactaaaaatacaaaaattagccaggcgcagtggcagtcacctgtaatcccagctacttgggaggctgaggcaggagaatcgcttgaaccctggaggcaaaggttacagtgggccgagatagctccactgcactccagcctgggcaacagagcaagaccgtatctcaaaaaaaaaaaaaacagctgagtgtggtggtggatacctgtaatcccagttacttgggaggctgaggcaagagaatcacttgaaccggggaggtggaagctgcagtgagctgagatcgcccccactgcactccagcctgggtgacacagcaagacactgtgtcaaaaaaaaaaaaaaagaaaagaaaagaagaaaaaagaacccaaattccatccaagttaaccagcaatgacttaaaaagcaagcaaaacaataactcccggccgggcgcggtggctcacgcctgtaatcccagcactttgggaggccgaggcgggcggatcacaaggtcaggagatcaagaccatcctggctaacacagtgaaaccccatctctactaaaaatacaaaaaattagcagggcgaggtggcaggcgcctgtagtcccagctactcgggaggctgaggcgggagaatggctggcatgaaccccggggggcggagcctgcagtgagccgagatcgcgccactgcactccagcctgggtgacagcgagactccgtctcaaaaaaaaaacaaaaaaaaactcccataaaaggaaaaaacactaagtcactgttttccagtgaggaaagtacatcagagtaacctggggaaagagagacacctggtgtttgcttctttggctatttcaaagaggaggaggcaatagtgtctacagaactagatgctatgaccttcttaacctaagagtgaagttgacagcactgatctggggaaggtgataagcagggagctcagggcagggccctctaccttttcaccactgtgttctcaggactcatggcgtaaagcagcctcccaaatttttttaatcaatggactttcttcttcttctttaagagatggcgatcttgctctgtgacccaggctagagtgcagtggcaccatcatagctcactgcagcctcaaattcctgggctcaagtatcctcccatctcagtctcctgagcagccaggactaaaggcatgtgccatcacacctggctaacttttatattttcagagatgggctggtctcgctacattgcccaggctgttttcaaactctcagcctcaagtgatcctcctgccacaacctcctgaatagggctttctttttttaaattagagatggggtctcgctatgttgcccaggcagatctccaactcctgggctcaagtgatcctcccaccttgatctcctgaagtgctgggataacaggcataagccactgcactggcccggaatttctttctttctttttttgagacagagtctcgctctgtcgccaggctggagtgcagtggcctgatctcagctcactgcaacctccacctcctgggttcaggtgattctcctgcctcagcctcccgagtagctgggactacaggcacgcgctacgacgcccagctaacttttgtattttcagtagagacagggtttcaccatgttggccaggatagtctccatctcttcaccttgtgatccgcccgccttggcctcccaaagtgctgggattacaggcatgagccactgcgcctggcctagaatttcttaatgttcctctctccccctccacaatcccacctaatgtagcaattaacagtttggtgatatgttgggacaaccaagaatgtaatttctgaaaacagttgatatttcatttaaaacaaaaaatattattaattcagaaggcccaagaaaaaggctcttgtactgttcactcttctgagggaagtatcctacaaaacagtaataccgtaaagacattcaggagagcccaggtatatggagagcatactctgattttaatcacttcaggtattttcaccaggtaattaaattcactgtccaatcacctgtctcaaaatcctgctgattaatgagaagccttaatgggaaatttggtattaactacatcttttaggaaatcattaattctagaaatggaaaattaaaactactcctgacttcactttacccccacttcaaaagtctacccagtctagccaaggttctcactgggaagtggggagaggaggaatatgagaggtcccaaggaaactaaactggaaacgagaaagtggaaagaggaaccaagaacccagtctcggatggctcttggggctggctggctcctctctctctccttccagtgtgctttctctgctcctctgtgaatctctctattaaccaatcactgtcatcttgtacagggttcaacgcagcctaggattctaaatcacagcaatcatcaaatgtcagccatgtctctgtctccagagtctcctctgcaccaactcactccctcactgtctgcaggccaggtggctggtacactgtggaactggggaggatacagcaagtcctgtgggcagctgcccttgccaaagggacaatgggtggagtacctgagaagggaacatgggtaggccaagcaatgacgatatctttaacatgggaacaaacttctctacatgtgcacttatagcagtacccccatatctgagaaggacatgctccaagacccccaggggatgccagataaactgtggatagtaccacactttatatagactacattttttcctttatgctgtattttttcctatacaaatgataggaacttaatcctgtaacaaagttttatttataaattaggcacagtaagaaattaacaataataactaataatcaagcagaaccaccataacaacataccgtaataaaagttatgggaatgtggtctctctcgtactgtaccgtgatattttatggtgccatacctcaaaagacaaggccacgggtacaggggctactgcaattcttccctctggcactgcactagctgaggacatgccacaaagcagcacacatggatccataatggagaatccagaacaattacagtccccaaaacacacaaaataaaaacacaactgcacagtcactggtgttttttcttttctttaaaagcattcatgaatatccccactgccttatctgcctactatgtcaaaaacaggagagaaggccatggccagaatcatggaacatccaataaaggcagtcacttgttattctgacaagtcatttgttttcagttcatctgtcgcatctgtcaagaaaaacacagactgtcttctaaaagtccgtttttaactattttattttttttcaatgacaaattccacttgtaccatagaagccatattctgcatgttggagaggcccctttgtggtccctcatccctgggttcttcctgggcatcctatggcctcccctctggtgacaggcagcaccccgaagacttaattttgattcttaaaaagggacagatccctccttccacccttgtccaggtacttccagagggtgggtccccttctcatgggaacatactacccccactcaccagaccacagtgatgagtccagcccagactgtgggccatgaaagcctaagctcccaaaacaaacaagatgccagggacactgcagccatctcagaggacaccgaaagacattttaaagccaagggaagcacagcagaacatcagctgctggacaccaagggagccacagctcgagggggttcgtgctccaacagcagatggagctacacccttcccgatgacgtcacatcctaataaagccctgtttgcagtggctgctgtgataaaaaagcaagctctgcatgaaatcaacatggaacaggaaacaaggggtggggtgggacggagtccaatctgattctgaagtttgagaagctgtacaacccattagtaattgtggctatttaaaaataaaatacagtttccttcaatttatgggtatttattttcttttttttttttttggaggcagagtttcacttgttgcccaggctggaatgcaatagcgcgatctcagctcactgcaacctccacctctcaggttcaatcaattctcctgtctcagcctcccaagtagccaggattagaggcatgcaccacaaagcccggctaatttttatattattagtagagacagggtttcacaatgttggccaggctggtctcgaattcctgacctcaagtgatccacccgcctgagcctccgaaagtgctgggcttacaggcgtgagccaccacgccccgacggggattagttttcaaatggctaccctaacttcctaggacataaatagttaaactgtttagatggaaagattcaacaaagggctgggcgtggtggctcatgtgagcctgtaatcccagcactttgagagcagcctgggcaacagagggagatcctgtctcttcaaacaaacaaaaaaattcaataaagggaatgtgaactatgtatcgtggcctaaaggcatttggagacataaaggtgccatgaatctgccctcagggatgagacgccaacggagactgattggcaggagtgggggaggaaagaaaatgtaaagaaagggggagcagggtaaactaaaggagagaaaaggggagaggaaggagaagtggggtgggggagaggggtgggaaagaagagggaggcaggccgggcgcggtggctcacgcctgtaatcccagcactttgggaggccgagaggcgggcaaatcaggaggtcaggagatcgagatcgaccatccttgccaacacggtaaacccctgttctctactaaaaatacaaaaaaggtgtaaggaagggatccattttcagtttttgttgtggggtggggggagaggggacggaaagcattaggagatatacttaatgtaaatgtaaatgaccagttaataggtacagcacaccaacatggcacatgtatacatatgtaacaaacctgcacgttgtgcacatgtaccctagaacttaaagtataataaaaaaaaagtaaacaaagaagaagtaaaaaatagcaaccataaaaaggaatgaaagcatgtcctttgcagcaacatggatgcagctggaagccattatcctaagtgaattaacacagcaacaaaaaactgaataccacatgttctcatttataagtgggagctaaacatcagggacttgtggacataaagatggcaaaaatagacaatggggactattagacaggggcatgatagagggtggcaagagttggaaaactgactgttgggtactatgcttagtacctgggtgatgggattactcatacccaaacttgagcatcatgcaatataaccaggaaataaacctgcacatgcaaccctgaatctaaaataaaagttgaaaaaattagtcaaaaaataaataaataaaaacaaacaaacaaaaaaaaattagccagtcgtggtggtgggcgcctgtagtcccagctacctgggaggctgaggcaggagaacggtgtcaaccttggaggcggagcttgcagcgagccgagatcacgccactgcactccagcctgggcaacagagcaagactccatctccaacaaaaaaaaaaaaaaagagggaggaagagtccccacaaaccagcctgtgggcaacagagcaagactctgtctcaaaaaaaaagagggaggaagagtccccacaaaccgaccagactgcagctcagctctaaatccaccccaaaagcctcacctactgctctgcccctccactttgcagtaagctgtaacacactacacgctcatcaaaaatgggaactgacactttgggaggccgagccggacagatcgcttgaggtcaggagttcgagacccgcctgaccaacatggctaaactccatgtctactaaaaatacaaaaattagctgggcatggtggcacgagcctgtagtcccagctacttgggaggctgagacaagagaatcccttgaacccgggaggcagaggttgcagtaagccgagatgctgccacttgcactccagcctgggcgacagagcgagactctgtctcacaaaaaaaaaaaaaaaaaagggaactgacttcccaatctttgtgtctcagaacaaaacccagcacagctgcgcacagtggctcatgcccataatcccaatattgtgggaggctaaggcagggagactgttagaagccaggacttggagcccagtctgggcaacataaagagtcctcatctccacacacacaaaaaaattttttaaaaattaactggacatggtggtgcacatctgtagctgaggcaggaggatcactgagcctcagaggtcaaggctacagcaagttatgatcccaccgctgcactccagcctgagtgacagagcaagaccctgtgtactgtctcaaaaataataataataataataataaaaacccagcaggaactcagtaactgcttattgaaaggcatccctcaagggaagcaggattggcaagcagccttgagaacagacacatctcagagattttatatcctcagggggttgggggttggtggtgggggagaagtgatggaggggcaagagaggatgtaaggaagacacaggtcagagctggaagcaaccctgaaggaggcttcaatctgtggctaaaacagagctggtgctgaggctccagttagagctcaaactggacccttcaagcaacacagacagcactggaagcattcaccagagaagccccaggacacatctctggggtattcagctcaaaatgcaaaacctgaatccccccatgaggcagccaccagacccaaagtgagggatgtcctacaggataactggcctgtactctttaaacctcaagggaggccgggcgcagtggctcacgcctgtaatcccagctactcgggaggctgaggcaagagaatcacttgagccccgggggtcggaggttgcagtgagctgagatcgcaccactgcacgccagcctgggcgacagagtgagactccatctcaaaaaaaaagcctggtgtggtggcgcacacctgtaatcccagctacttgggaggctaaggcaggacaatcacttgaaccaaggagatgaaagttgcagtgagccaagattgcgccactgcactccgcctgggtaacagagtaaaaccttgtcaaataaataaataactaagtaaagtgtatatgttagcagagcaacgtggcagtcccatgtaccatgaattggaggatgaagagccactaagtaactcctgggacctcctcttcggaggcttgtcaggtaaattaggagatgattacaacagtctgagtgagaagtccacccattaacttctccccacactgagtgagacaatcagtttcctaagtctattacccggtagtgtaaagtacttcatttttattaatttttttttttttgagacagggtctcgttcagttgcccaggctggagcggcacaattacggctcactgcagacttgacctcctgggctcaagcaatcctcccacctcagcatcccgagtagctgggactacaagccgtgctctgatgcccccgatttttgtaatttttgtagagacagggtttcccccatgttgcctaggctggtctccagctcctgggctcaagcaatcggctgccttgacctcccaaagtgttgggactacaggcacaatccactacacctggccagtactttatttgtacagaagcagaacaaatacacccagcagaaaggtaaggaagctgaggagggctccccggtaaggtattacacgtaggcatcacaccttggagactcttagaaaacaccacggaggaggcaaggtggctgaatttgaactgcagtggtgctgaagtccacacaaataactgccatacacacacaagagggaaaaccaaacctcattcagccccacgccaggccacatccctctacctaagagcacagtgctagacccaggctgaatgtgtctgaccctcagcactgtggacactggggtcatcccgggtggtgcagggtgctgaacagcatcactggcgtctgttcatcagatgaacacaatccttggtcactgcccctcttcagccatcagtctacaaatgggctgtagaggttttccaaccaaacaaatgagtaacagaggctcagatgggcaagttgtgaggtggtgctggctagaaatggaagcagtgagggccacagagaaacaaagaaaagaaagtatgtgacaacacccaatcatgtaagttatgcaatttatagccaacctgagtaatatgtgagataatttgactgattttagagcctcatctcccacagaaacctgaccaattcagaaaagcactgccgtcccttgcccactgtggctgctgccactggaggggtttgggagtggggcaaacacaccccagacattgcaaagcgtcaacaaagccctttactgaaacgtctacttaggagacctaactgcctttctatggctaaacctagtgttcaggctccaccaccttctacatgctgctactctgttaactataaaagaacacaaaaaacaaaaacccacaggactcactcttcatccacaaatagctcattttgagatcttctccttccaaggttcttttagtgagcaaacacccaaatttcagatatcacacacagtaagatttcaaaggagatttaagttggaaaaattcagaaaacctacctatgcttaagcactgaatccccactctcagtgtagtatatggcagcacataattgataacatttttttaaagaataggacagaacaatgtttctgtgggaggtggtgttgcacagtgactgaaaacaagagggtctgggccaggcacactggctcacgcctgtaatcctaaaattttggaaggccaaggcgggtggatccagtttgggcaacatagttggaccctgtctctacaaaacaaaaaaacaaaatttaaaaaatttgccaggagtggtggctcacacctgtaatcccagcactttgggaggctgaggcaggtggatcacgaggtcaggagttcaagatcagcctggccaagatgatgaaaccctgtctctactaaatatacaaaaaaattagccaggcgtggtggcaggcacctgtaatcccagctattcaggaggctgaggcagagagttgcttgggaggcggaggttgcagtgtgccaagatcgtgccactgcactccagcctgggtgacaagagcaagactctctcaaaaaaaaaaaaaaaaaaaaaagaagaaaaccccacgaaaaaactattcttagcttctgggccacagaaagagatggctgtagcgtggcaacttctggctcatagcatagggcctagtacacagtaggtagttaaaacggccgcaatgatactggtttctcccactatcatcacaagttattccctccggccgacccatcctgccgattaccacctggcctgtaggttaacttcatgtagccaattctgtgccatgaggagcatgttccacctaacagaaacctgacattcctgcaccccaggaagtacatttttgggtctttaaatcaaactatataatcttgcctaagaactctgaaaaacccagtatacgaaagactttttccactagtttgtactctgagtaaaattcttcgttctgcaatttataactaagaggttatattttagttgctcatctcccaacaccttttactcactgcatcttagagtgctcacttacagctgctgatgcacatctcctctttcacaaaacgtaaaggtttcatcagctacaattagcttaaccaattacattttacttggcctttggttttgcctgattgccttgtacagagttatgaagagtattgctatctaacatctgttataaaaactaccaggccaggccaggcgtggtggctcatgcctgtaatcccagcactttgggaggctgaggcgggcagatcacaaggtcaggagatcgagaccatcctggctaacatggtgaaacctcatctctactaaaaatacaaaaaattagccaggcgtggtggcgggcacctgaagtcccagcaactcgggaggctgaggcaggagaatggcatgaacccgggaggcagaggtggcagtgagcagagatcacgccacagaactccagcctgggtgacagagtgagactccatctcaaaaaacaaaaaaaaaacaaaaaaaaaccaaaaaaaaaaaacaggcaacacattgtggctcatgcctgtaatcccagcactctgagaggccgaggagggcggatcacaaggtcaggagatcgagaccatcctggctaacacggtgaaaccccatctctactaaaaatacaaaacattggccaggtgtggtggcgggcacctgtagtcccagctactcaggaggctgaggcaggagaatcgcttgaacccgggaagcagaggtcgcagtgagccaagattgtgccaccgcactccaacctgggcaacagagtgagactccatctcaaaaagaactaccggattacagttatgttatgttcacaataccagcatccaaaaatatccagtgacaggatacagcaagaaacatgactacaaggtctatgaaacaggagactacagtacctaaaaaggcagatttaaacaaattcctgtaatgtgctcatttcagtcatgctaacttgagaaagcttttaaaacttttaaatgtaaataatccactttcacatttcttccaaaatgaaaaataactccttttttctgtcactgactttggcgaattttccaaaaaataaagagaaaacagttttgttttttggttgttgttttttgagaccacgcctggccttgaaaacagtatttatttattttttttttttttgagtttcactcttgttgcccaggctggagtacaatggcgcaacgttggctcactgcaacttccgcctccgaggttcaactgattctcctgcctcagcctcccaagtagctgggattacaggcatgcaccaccacggccagctaattttttctatttagtagacagacagggtttcaccatcttggtcaggctggtctcaaactcctgacctcaggtgatccacccgccttggtctctcaaagtgctgagattacaggcgtgcgccactgcgcccagccagaaaacagtatcttaaaacagtatgttcctttcctccattcaccccatgagataccacgtttcacagggatgtcttccagactttgatacatatgtgcataatttttcacaagtcaatcaaatgataccatattccccaaactatacatattcaaaatgcccaaccatttactgtattgtggtcatctcttcatgccaataaaggaaggccaccttaaatctttttaacaactgcacagtatgccattccaagtctgccttaatttaaccaatctattgatggacatttagattcatccaggggtgtccaatcttttggcttccctgggccacattggagaattctgtcttgggccacacataaaatacactaactagtaatagctgatgagcttaaaaaaaaaaaaaatcgctaaaaaaaaatctcaatgtggccgggcgcggtggctcacgcctgtaatcccagcactttgggaggccgaaatgggcagatcacgaggtcaggagatcgagaccatcttggctaacacggtgaaaccccgtttctactaaaaatacaaaaaattagctgggtgtgttggcaggcgcctgtagtcccaggtactcaggaggctgaggcaggagaatggcgtcaacccgggaggcggagcttgcagtgagctgagatcgcgccactgcactccaacctggggcacacagggagactccatctcaaaacaaacaaacaaaaaaacctcaattctaggccgggtgcagtggctcacgcctataatcccagcactttgggaggctgaggtgggcaggtcgcctgaggtcaggagttcgagaccagcctggccaacatggcgaaaccccatctctattaaaaatacaaaaattagccaagcatggtggtaggcgcctataatcccagctactcgggaggctgaggcagaagaattgcttgaacctgggaggcagaggttgcagtgagccgagatcaggccacttcaccccagcctggcaagagcgaaactccaccaaaaaacaacattttaagaaagtttacaaatttgtgttgggctgcaatgcggcccacaggcctcaggttggacaagcatgactaggcattcatacagcaaatatttattgagacctactatgtaccaggcactgtcagaggatataccaggaaataaaacatgaagttctctaccctcatggagcttatattttagtggctactgacaattttttgcttttataccaaaaattctagctaggagtttttgagcattgtctgtcttaaatatttggcttttataactaattttataataagcattctcttatttcttcctttggataaatttctaaaaatagacttgctggaacaattattttagaaatgcttttatactaaaaataataaccctttatcatatatattcctaacatttttctaattttcctgcctttgaactatagttcagaggcccccaaacaggcatcttttgctgtagatatgttccgaatgcttaagcagatatcttttcatagcttatagccttattgtcaaactaagaaactctttacctacagctggattgccagttgatccaataccttttacatgacaaaccatccattcccaactgattgtaaatgctacattaatcataaattcccattaatttatagatcagtatctagactgctttgttccacttacctataatacttataaaaaatctactaggaaacgttcccccttttctttctttagaactcccctcaaatatttacttctccaaatcaagtgacatcttgaaaatattcaagcacatgcatataggaatactgcattcaagttctgtatttatgtctatctattcaagttctctttcacctcttcaataatgcatctaaaggttccttcatatagtgtgtgttttgtttttttgtttttttttgagacggagtttcgctctttttgcccaggctggagtgcaatggtgcgatctcagctcgctgcaacctctgcctcccgggttcgagcaattctcctgcctcagcctcccgcgtagctgggattacaggcatgagccaccacatccaactaatttttgtattttttagtagagatggggttttaccatgttggccaggctggtctcaaactcctggcaattgacctgcctcagcctcccaaagcgctgggattacaagcatgagacaccgtgcctggccatgttttcccgtttttaaaagtgaaaaagttagccgggcacagttgctcacgcctgtaattccagcactttgggaggccgaggcaggtgaatcacgaggtcaggagttcaagaccagcctagccaagatggtgaaaccccgtctctactaaaaatacaaaaaaattagccaggcatggtggcgggcacctgtaatcccagttactcaggaggctgaggcagaattgcttgaacccaggaggcggaggttgcagtgagccgagattgtgcaactgcactccagcctgggtgacagagtgagactccatctcaaaaaagaaaaaaagtgaaaaagttttaggcctaacaatcatgaaacaaatgccattagtgtatttgcctaagaactcaaaaaatcttctgaagttaatttctataaagaataagttatttacagccaggcgtggtgactcatgcctgtaatcccaacactttgggaggctgaggtggacggaccacgaggtcaggagatcaagaccatcttggctaacaaggtgaaaccccgtctctactaaaaaaatacaaaaaaattagccggtgtggtggcgggcacctgtagtcccagctacctgggaggctgaggcaggagaatggcatgaacccaggaggcggagcttgcagtgagctgagatcacaccaccgcactccagcctgggcaacagagcaagacaccttctcaaaaaaaaaaaaaaaaaaaaaaaaaagaataagttacttacaaaaaagaagcaaacttacaaagaccagaggctctagtcagtccactgctcctttatgttgttatctgaccattcattatctcagacacttactactgacttctataagaatccaaaaaacagaatttcactagaaggtgacagtcttgtttcagctaaccattcatgcccaagagcttaattacagggtggacctcagcccccaccttagtgtctctcaggtgggtgggatgaagtcagagaaaaggcagtgcagcaccagcaacacaggtccatcaggaactggagcttttcctactgtccctgcttcctcctcccgtgaatcccaacaatcacagccacagaaatagtaagcaggaaaaaacaaggaggtggcagtagaggagcctatttgtcttatcacagttattcatcacgtagctggttcctcttttctgcctcttcttccagatgacccaactaccctcaaactgccctcccaaccccgaaagaaagtctctgattttgtaataggtcaatatatacaaaaacttcagagctatttatattccatttatcaaggacaacctacgctaacacacttgtacaacacaacttgtaatgctgctttgttatgtcttcagattcaaaaacaatcttttctttttttttcttgagacaacatctcactccatcacccaggctggagtgtagtggtacaatctaggctcactgcaacctccacctcctgggttcaagagattctcctgccttagcctcctgagtagctgggattataggcacccgccaccatgctcagctaatttttgtttttagtagagacggggtttcaccatattggccaggctggtctcgatctcttgacctcaagtgatctgcccgccatggcctcccaaagtgctaggattacaggcgtgagccaccgcaccaggcccaaagacaatcttatgtttttgtttgtggggttttgtttttgcttttttgagacaaggtctcactctggcacccagactggagtacagtggcatatcataactcagtgtaacctcaaactccttctgcctcagccatcccagtagctaggactacaggcaccatgcccagctaattttgttttttaaactttttgtagagacagggtctcactacattgtgcccaggctggtctaaaattcctggcctcaagggatcctcgcaactcagcctccccaaatccagagattacagggattatagttataagccactataatcagcccgtcttgtttaaaaatcaaatccctccctatcaaactcagctttctgaatcgcactttgtcttttccaaaacataatattctgagctcagcagacacttccttatgcgctgttacgcatgttagcgttgctggaattacagtaagaataatcatctgccaagagccagttcaacccatttctgatataaaaagccattttagcactttgggaggcagaggtgagtggattacctgaggtcaggagttcaagaccagcctgaccaacagggtgaaaccccacctctactaaaaatgcaaaataaattagctgggcgtggtggcacacacctgtcatcccagctactcgggaggctgaggcaggagaatcgcttgaacctgggaggtggagtgagccaagatttcaccactgcactccagcctgggcgacagagactccatctcaaaaaaataaacaataaaataaaataaaaacagaactctccactgttgcccacatcaccctccaactactgagctccttctctgagccctctagagcaaccttctttaagtcgtatctacacaggtggtctcctcttccatctcctatgtttcaattgactccaatctggctttcactccctaccgtgaaaccaaaagggctgaccacctagtacctgcagtccttaaatttaaggaacctttggccaggtacagtggctcacacctgtaaccccagcattttggataacattaaggccgaggcaggtggatcacttaaggccaggagttagagaccagcgtgaccaacatggtgaaaccccgtctctattaaaaatacaaaaattagccaggcatggtggcacacatctataatctcagctactcaagaggctgaggcaggagtattgcttgaacgtaggaggcggaggttgcagtgagcccagatcgcgctactgcactccagccacggcaacagagtgagacttaagggaaccctttccccacccccattcacctgactcctcaactgcaccctacactgtcacatcccacctctccgtgtctcctcgatctaacctctaatagctgggcaccccacctctccttttaataacccctccaccgaccatcacaaaaacagaaagaccaagacttccagactggactccaggccaacaggctgttagccggcggttggcacttagttgccctatacccattttgagcttcagatattcaaggcatggctctgcacagccaacagatttgcctcccctcagtgctcaacatcaccaccctctacatgtgcaaagcacacacagaaatcatcctggcctccttcctttccctactcccctacacccggtccatcagcaacctggctgactctaccacccatttcttcccatttccttagtctccatcctcagccaaaccacgccatttctcatcaacagtctccttaaaatgacctctgtctcaatctgtgcccccgacaatccatttttcattcagcaatctgaacaatcttttttctttttttttttttcttaagacagggtctcgctctgttgcccagactcgagtacagttgtgtgatcatagctcactgcaaactccaactcctgggctgaagcgatgctccctcctcagcctccccagtagctggaactacaagtgtatgctacaatgcccagctaattttttcttttaagtagagacagagtcttgaactcctgggctcaagcaatcttcctgtctcaacctcccaaactgttaggactataagcatgaaccactgcacccagcctcaacaatcttttaaaattcaccttttgtcacttgaggcttaaaatttttcaacggcttcccactgcatcaaggaaaacatccaagctctctgccagtttggaaactagagaatgcaccatctgcacgaggaccctcacctggtataaatcaagactgtcctgggcaaactgggcctctggcacctgcctgaggccgtgtggccaaggcctggcttccacccctacctctgccctacagctttgctcctgtgtgctgagcttcacccgctgtcccttccgcaggacctctgctgagcttcgcctgctgtcccttccgcagggcctctgcaatcactgccctctccacctgaagcataggggctccttgcctacctggttccttctcatccttcaggcctttactctaaataccctaaacaataccctaaaccaagtgccctctccacccaacagctcacagcacctaccacaggcccaaacttcgcttcttccagttcgccatctccccacagagaatgaaccaccagttgcaacttctcggtactcaaccatcaccaagcacagtgtcttgctcaaagtaagtacttggtaaatatttgttaaagagttcactccatcccacagataccatattattaactgggcatcctaaagcaggaagttcttgaggtcacacagtataggaaaggctgtgatgaaaaatggccacggtttctgcaagtcccaccattaaggaccagagtctatctcctactctccaagcctgtgctaagccttgtttttttttttttcttcattttcggtagagatgcggtctcactatgttgtccaggctggtttcaaactcctggcctcaagccatcctcccaccttggcctcccaaagggctgggattacaggcatgaggcagcactcctggcctatgctaggcctcataacttgcaataagcaagggaatgcaacagaggtgacactgtgacttctaaacatgtcctcaagtagcctgtcaaactctgctcctgcccttttggaattcagccactatgggaggaagcctgagctagactgttggagaggcaggctgaggagatcagaggcaccctggctgaaagcccatgtgggtgagggcaatgggaagcacaagccagcctacctgccaactgttaattgcccttgctagcgtggccagcacagtgaacagagatgagccctgcccacatccatactcccacatgatgatgaacaaggacttactgttttaagtcgcttcattttggggtagtttgttacccaggagcatataactgatgtaaggccatgacaatatgctcttcttaaacttggcgccgagactggacgcagtggctcacacctgcaatcccagcacttcgggaggccgaggtgggcgggtcacctgtaatcccagctactcaggaggctgaggcagaagaattgcttgaaccccagaggcagaggttacagtgagccaagatggtgccactgcactccagcctgggcgacagagcaagactccatcttaaataaacttggcaccgagactgctggactggacaattctccatggtggagcaggatccctgtggcacaccccagctgtcacaaccaccaatgtatccaggcaggcagcgtggggactaaatacaagagggaacgcatacctgcctctaggggactcagcactttcacaggggaaggaaagattccctgctttggaggcattctttatgtcttctcattgacttctgatctaggttactggtccccaaggacagtcagtggaacaaatgctggcagcagcctcgatccatccctgtggaagctaccgaggacaacactcttcagttcccacaaaagaaagactagcaaagcataaacacaacgcgcctcctggccaggtgcggtggctcacgcctgtaatcccagcactctaggaggccgaggcaggcagatcacgaggccaggaattcaagagcagcctggtcaacatggcaaaaccctgtctctactaaaaatacaaaaattaggccgggcgtggtggctcacgcgtgtctgtaatcctagcactttgggaggctgaggcgggcggactgcctaagctcaggagttggagaccagcctgggcaacacggtgaaaccccgtctctaccaaagtacagagaaagccgggcgtggcggtgtgcacctgtagtcccagctactcgggaggctgaggcaggagaactgcttgaaccttggaggcagaggttgcagtgagacgagactgcaccactgcactccagcctgggaagcagagcaagactccatctaaaaaaaaaaaaaaaaaaaaaaaaaaagtacaaaaattagctgggcatgctggcacacgcctgtagtcccacctacttgggagactgagacaggagaattgcttgagcctgtgaggcggagttgcagtgagctgagatggtgccactgcagtccagcctgggtgacaaagagtgacaccctgtctcaaaaaaaaaagacaaaaaaaaagtgcctcctgagcttcgttctgtgaagcatccagaatccttacagcagcggtcaccaacctttttgatgccagggaccggttttgtgaaggacaatttttccacagacagaggggatggttttgggatgaaactgttccacctcagatcatcaggcattagattctcataaggagtgcacagcctacatccctcgcgtgtgcagttcatgacggggttcacgctcctatgagaatctaacactgccgctgatctgacaggaggtggagctcaggtgggaatgctcgcttgcccacctctcacctgctgtgcagcccggctcctaagagaccacagcccaggagttgggggcccatgcttagaagacattttatctttttctggttttttttttttggagacaaagtcttgctctgcctaccagtctggagtgtagtggtgtgatctcagctcactgcaacctcaacctctccagttcaagtgattctcatgcctcagtctcccaagtagctgggtctacaggtgcacgccaccacaccccactaaacttttgtgtttttagcagagacggggttttcacatgttggtcaggctggtctcaaactcctggcctcaagtgatccacccgctgtggcctcccaaagtgctgggattacaggtgtgagccatcacacctggccaaggacactttaccttttctattttgttttgttttagaggcggggtcttgctctgtcacaggttggagtgcagtggcacaatcatagctcattgcagcctcaaactcctgggctcaagtgatcctctcatcttggcctcccaaagtgctgagcttacaggagtgagccactgcatccggcccctttttctatgtaaattatcttacaagtttcttcaacctccaacagagacttcatttcacaaggctggccacaaggggaatgggaagacatggaaggcaagagagctagaaacacaaggggcgaaggatgaagctctaggaactttagcaggttcaacagtgtccccccccccaaaattcatgtctacctggaacctgggaatgtgaccttatttggagcgtctttccaggtatgattagttaagttaaaacgaggtcatactgaattagggtggccctaatctaataactatgtccttataaggtgagtagagacactgagaaaagcccacgtaaaacagaggtagagagtgactcctctacaagccacactgctggcacccaccagaagccagaaagaagaaaggaagtgtcctcccttggagccttcagaagcactggggccctgccaacaccttgatttcagacttctgtcctccagaactgagggaatcaattcattctgagccatccaacttgtgatgatttgctacagcagccacaggaaactaacattgtgtcatttctgaagacctttactaagccagaaccacaagggtagaaatcaagtgcccagatcagcttggagaaggacttgtttttttttaatagagacagggctggagtgcagtcgtacaatcaggtcactgcagcctcgaactcctgggttcaagcaatcctcccaccttagcctcctggatagctgggactacaggtgtacaccatcaggcccagctaagaaaaagagagagcaagagagaggacatgcatgtgcacacgagagagagagagagagagagagcgagcgtgcatggccacgtgcacgagccagtgagcaagcgcacacacatgcaaaaatggggtctcactatgttgcctaggctggtctcaatcttcccacctcagcctcccaaagtgataagtgtcataggcataagccaccacacccagtcaatggagaagcatttcaggaatgaaggcagagtcaaacaccatcagtagtagcggtactggaagctaacactttgaggtcttgcttggcttgaagctaagaattttatttgtagcatgtcattcagtcctcacaacaatcctggaagacaagaaaactaaggtagagacgttcagtaacttgctccagacctcaaatctgagttggcagaaccaggatgtccagcacgtggattcaggtacaagaaataccactgatatctacataattactactcatgttttccaagatgaatgacatttggaaacaattacaaagtagaaaaatcacaattttaaaaatctatatatacaggccaggcgtggtggctcatgcctgtaatctcagcactttgggaggccaaggtgggcggatcacttgaggtcaggagttcgagaccagcctgaccaacatggtgaaaccccgtctctactaaaaatacaaaattagccaggcatggtggtgtatgcctgtaatcccagctactcaggaggctgaggcaggagaatcgcctgagctggggaggtggaggtttcaatgagccgagatcgcgcctctgcactccagcctgggcaataagtgagactctgtctcaaaaaaaaaaaaaaaaaaatatatatatatatacacacacacacagagtgggacccccaatccgaggaaaaacatctctatacacacatgcatgagagatacaaaacactagaagaaatataataatcttacatggttatttcctgattgagagattatagatttttgctgtatgttcctaatttcccttttttataaaattttatttatttttttaaaaatagagacagggtctagctgtgttgcccaggctggtctcaaactcctggcctcaagtgattctcctgcctcagcctcccaaagtgctaagattacaggcatgagccaccatgccaagcccctaatttactacaatgaacattttagatgtttttattagcaaaatgaagaagctgaaaataaaactgagacaacaggaacaagatctccagagaaaggataggatagatggtggaggcaatggaaacagactgcctgttggggagtttaaagagagaaaaacaagaagagtggctagaatagatagcaagattaactgggtgttgagttacataagatttaggcatgtttgaaggtataatagagtagccactgacaaaactgttggtaactgttttccagtggaaaaatgttccttttactaacataggaagaggcaaatgcagacacagaagtcttctcagatgaatgaggagaaagagctcacaccagcaggtctataatgcataggctccaggagcaatgacccaagaactaagttcactgtcaccacggccaactgtctaatctccctgtagatccagtcatctgtaagatggagctattaacagcacctatcagagctgatgtgaggaccacgcagtaatagcatagttcccagcatggtgcctggtgcaagaaagatacccaacaaatgcgagctaatggcacaggcatcttcaacagggcaaaacgcaagtgcaccaactgccatgggagtgtcaggcagagggactggaaggctaaggttgtagggaatttatttcaacaggaaaaccttcaagtacctctcccaacacactttacataatatgtatgccaagcggggattaaccaattttccaggacttatttcaattccaagtccaagcacagccctgacttggggcttctcctgcctggaaccctcttttcccagatgtctgtctggtttgtcttctcacctcctcctactctctcctcaaatgtttggaccacccttttcaacatggaagcaccagcaatgcctagagccctacagcagactcgtccgccatctttttcagcacacagccttttccactgtcgcataggtaacattcctctcaccaaggcaagttggcatctcttattcactgcccatcacctgcctctccttggcacatctttggccctgaatacgcattttacaaaagatctctcctctcttcccctttatgggcgctgccctctcagtattcccatctaaaatccatgcagacagagcctcccctagccccacacttctctctccgactactttcctacaagactctcctcaccccactggaactcactggccctcagcaatctctaccactgacgaatccatctccaacttcggaccattccctctgctctcagaataccttctgtgggttctgcgacactagtgctgagagtctcccaaagtctggtcactcctttaagtgtttctcttcctctgcacatccctaacacaagggcctcttctcaagctacaccaacgggtcttcacctctgacaaatctctgagttctcctccccaggaaaaggcacaatcctacagtactgcacatgggggcagggacagggtgcctgtctccagctgagaacttctctggtccccacaggtgccctgggcctggcccattctctaaaccagcgctgctcagatatttcggctcagaccccctctacatcctcaactattaaggaccccaggggcttttgtttatgagggtttgatctatcaatatttactgtgctataaattaaaactgaaatgtcctaaaaatgtttatcatttgaaaataagcccactgcatgttaccatacataacatttttataaagaacaactactttctaggccgggcgcagtggctcatgcctgtaatcccagcactttgggaggccgaggcgggcagatcacgagatcaggcgatcgagagcatcctgcctaacacggtgaaaccctgtctctactaaaaatacaaaaattagccaggcgtggtggcaggcacctgtagtcccagctattcgggaggctgaggcaggagaatggcgtgaacccaggaggcggagcttgcagtgagccaagatcgcaccactgcactccagcctgggtgacagagtgagactctgtctcagggaaaaaaaaaaaaaaaagaataactattttctaagaaaaataatctggtgataagccatattttacattttacatttaccttgtctgcctcaatgggagcaatggatcttcacatcgtgtctgctctcagcctgatgcaatacacagttttagctgaagtctaagaggaaaattcagtctcacatagatatgcagctggaaaaagaaaagagctgttttttgttgttgttgttgttttttaagacatagggcctcactctgtcacccaggctggagtgccatggtgcaaccatagctcactgcaatctcaacctgccaggctccatcaatcctcctgcctcagcctccccagtagatgggaccacaggcacgcaccaccatgcctggctaattttcaaatttttttgtagagatggggtctcactatgttgcccaggctggtctcaaaatctcagcctcaagtgatcctcctgcctcaccctcccaaagcactgggattacaggtgtgagctaccatgcccagccaagaacagtatttctatagaatttttattttatttttatatgtcaacacaatgaaaagtcaaataacatcttaatatgattatgaaggccggacacggcggctcacgcttgtaatcccagcgctttgggaggccgaggcaggcggatcacgaggtcaggagatcgagaccacggtgaaaccccgcctctactaaaaatacaaaaaattagccgggcgtggtggggggtgcctgtagtcccagctactcggagaggccgaggcagaattgcgtgaacccgggaggcggagctggcagtgagccgagatcgcgccactgcactccagcctgggcgacagagagagactccatctcaaaaaaaaaatatatatatatatgatgatgaaaacagttctgactaagtgaattcctgaaactgtctcaggagcccccaggggtccacgatcacactttgagaaccactgctctaagtgaccactgctccccaagacttcaatcatcacccaaatgttgctaactcccaaaggcctgcctccatccagacctatcttccagagctccccactcacaggcacaggagtcactacgtcagcatttactgtgtaccgttttaggggctggtctgcagtgaaccagactgcctgtgtccatggagcttagaagaagtgggaagagcattatcaggctacgaagacaagagtggggtaaaacagcagagatcaatgagatcagagcacaccctcggaggaagggatacatgacaaatgcctgaacggagagagggagtgaactgtgcaaacacacagccaggagttttccaaggacagggaggagaaagtataaggcctgccgtaccctcgatgcaaaacatgagaaagcctcagagactcctcaaacccaacacacacaaactaaactcatcatgacccacagccacccagagggcagacggaaacctgtggtcatttacatctttctcgccactctcgccttcccttcggtcaccaggtcttatcaatcgtcaacctggtccagacccctttcctcttctacagcagctttgccaactgactagagtcccctccctcccctgagcactctacgctcaactaccaagtaatgatccccatcagatcaatctccttaaaactctttcagggcttcctggagctctcgaggtaaaagttcatttttttctttttttttgagtctcacactgtcacccaggctagggtgatcttgggtcactgcaacctccgcctcccagattcaagtgatccttgtgcctcagcctaatgagtagctgagaatacaggtgtgcgccaccaagcctaatttttatatgtttagtagagacaaggtttcaccatgttggccaggctggtctcaaactcctgacctcaagtgatccgcccgccctggcctcccaaagtggtgggattacaggcataagccactgtgcccggcctcaaggtaaaagctctttatccagactgtaaaccttttggcttccaggtctaaccactctcctagccctttggaacttccgtccctggatgtgctgtgctcttatgcgcttgataaataattactgagcacctggcacacagtattgtgcggggtgctggagacagtgaaggagaccagttggttgccggatgaaaaacacaccatctcatcagcctaggatacactcctcccctccatccccacctgcctgccagacagactccaattcaggtctcaaagctttttttaatgagaagctgccactgaactctggacagggtggtgtccctgggagccacagccactgccctccgctctgtgcctgcgtgtcaggctccctattagaccatgaattcagcaaggccctggatcacatgcattctactatggctcacagcctcagcacccagtaaggtgctaaattggggccaggcacagtggctcacgcctgtaatcctaacactttgggaggccaaggagttcaagagcggcatgggcaacaaggtgaaacaccatctctactaagatacaaaaaacattagctaggcgtggcggcatgcacctgtaatcccaactatttgggaggctgaggcaggagaagcgcctgaacctgggaggcggaggttgcagtgagccgaaatcgtgccactgcactccagctgggtgacagagcaagactccaactcaaaaaaaaaaaaaaaaaaaaaaaagagagaaggtgctaagtcaacatctgttaaacaaatcaccattacagtttttataaaaacaagtggaaaatatttaattattgtccctatcagcaaatcaagggacgtcaacaaattttggtgaaattaaaaaaaaatctagcttcataaatgggaggaggagaattctctaaaaaaatgaacataaatgggcagggcgtggtggctcacgcctgtaatcccagcactttgggaggccgaggcaggcagatcacgaggtcaggagtttgagaccagactggccaatatggtgaaaccctgtctctactaaaaatacaaaaatcagctgggcatggtggcaggtgcctgtaaccccagctactctggaggctgaggcaggagaattgtttgaacccaggaggtggaggttgcagtgagccgagatcatgtcactgcactccagcctgggtgacagggcaagactccgtctcaaaaaaaaaaaaaggacataaacttaccagttttcaaaatgaggcatagttcaagattattctacaaaggtaaaggaaagcctttaagagcaggttactgtggctcacatctataatcccaacattttgggaggctaaggcaggaggatcacttgaacccaggagttggagaccagcctgtctctacaaacaataaaaaaaattagctgggcacggtggcatgtgcccgtggtcctagctacttgtgagactgagagaagaagatcgtatgagcccaggaggtccaggctgcagtgaaccatgatcataccatcacattccacactccagcctgggtgacacagcaaaaccctgtcccaaaaaaaaaaaaaaaagaaaaagaaaaaaaaacctttcaagaaaagataaggatgtgagagatttagtagaaagtaaggcagtaaataagtgatagggatttgcaaagatagctaatatgcatgttccacaccctgaattaatattcttctggaaccatggagaaaaaaagaaaaatctcagtaaactgtcatcttataacatttgttaaccttgccataaaagaaatttttacaaagcaaggccatcagcaacagaaatagctaatccttgcactgagctctgttatcagtgcccacatcaggactcatttaatcctcacaatgaccccatgaaggaggctctaggagcctgtttcacagataaggacagacacagaagtcctaacactgcaggtggcctaaattaaggcaggctcagggaggacagaaagctcctgtggagtggaagggtagaagttgaactgatcttgattttcagtgcgaataaaagtcctaacactgcaaatcagccagtgaggcaacagagctgagctgggctctaactcagacagtgccaatccttttgaaaactactgaatttctctcactccctagattttaggaattattttaaaattcctatgagaaattttctgaaacctattgtagactcttttgacatgctcatctaattataaagtgtccggactttttttttttttttttgaccgagtttcactcttgttgcccaggctgcagtacaatggcacaatctcggctcaccgcaacctccgcctcccaggttcaagcgattctcttgcctctgcctcccgagtagctgagattacaggcatgtgccaccatgcccgactaattttttttttttttttgagatggagtttccttcttgttgcccaggctggagtgcaatggcacgatctcggctcactgcaacctcagcctcccgagtagctggaattacaggcatgcatcaccatgcctgggtaattttttgtatttttagtagagatggggtttctccatgttggccaggctgatccaccctcctcggcctcccaaagtgctggaattacaggcgtgagccaccgcgtctgggctaattttgtattttcagtagagacagggtttctccatgttggtcaggctggtcttgaactcccaacctcaggtgatccgctcaccttggcctcccaaagtgttgggtttacaggcatgagccaccacacccagcccagaattttttaagctttattaactacaacactcggcagaagttgagtgtctgtaatcaacatagggaatatattttctaagtgctacaggactgcacacagacatgcatggagacatgattacccaccagtaaacaagaatacattccactgatgcccttagtattcccattctttttttttttttgagagacggagtcttgctctgtcgcccaggctggagtgcagtggcgcgatctccactcactgcgaggtctgcctcccgggttcacaccattctcctgcctcagcctcccaagtagctgggactacaggtgcctgccaccacgcccggctaatttttttgtatttttagcagagacagggtttcactgtgttagccaggttggtctcgatctcctgacatcgtgatctgcccgcctgggcctcccaaagtgctgggattacaggcatgagccaccgtgcccggccagtattccaattctaacaggtgaatgaattaatacataaagtcctctcttgatataatgcattagtaagtttggagcaatgaattattaaatcataaaaatattttatctatggcaaaataggttcaacagaataaacttaaaaattaagctgggcacggtggctcacacctgtaatcccagcactttgggaggcggaggcgggcggatcacttgaggtcagcagtttgagaccagcctggccaacatggtgaaaccccatctctactaaaactacaaaaattagccaggcatggtggcgggcacctgtaatctcagctacttgggaggctgaggcaggagaatcacttgaacccgggaggcagaagttgcagtgagccaggacagcgccattgcactccagcctgggcaacaggaaggaaactccatctcaaaaaaaaaagaaagaaaaaaggaattaccttagataatcttaatctggtcttttaaatcagtaagcttttaaaaaatgggtctttctcagaattctaatttaagaagacataaataaggaaatacttccacttaatctttttttttttttttttttttgtgaaacggagtctcgctcagtcacccaggctggagtgcagtagcacgatctcggctcactgcaagctccgcctcccgggttcacgccattctcctgcctcagcctcccaagtagctgggactacaggcgcccgccaccacacccagctaatttttttggtatttttagtagcaatggggtttcaccgtgttagccaggatggtctcaatctcctgacctcgtgatccgcccacgtcggcctcccaaagtgctgggattacaggcgtgagccaccgtgcccggcccacttaatcttaaaaaaaaaaaaaagcaagcaagcaacattgctctataaaacagaaagcttttctaccactgaaagccaggagtaatttccactgattaccatggcacccaatggtaggcactgacacaagaacaagaggctaaaaggtttaaaaaagctttcagcattccggcagggcacggtggctcacgcctgtaatcctagaactttgggaggctcagacaggcagatcaccggaggtcaggagttcaagaccagcctggccaacatggtgaaaccccatctctactaaaataaaattttaaaaaattatccgggcatgacggcgggtgcctgtaatcccagctactcgggaggctgagactggagaatcacttgaacccgtgagatggtggttgcagtgagccgagattgcgccactgcactccagactgggtggctgagtgggactctgtctcacaaaaaaagctttcagcattccactaatccactagcaaactcaaatgtctatagattgtctctatttcttcaatcaaagttctagaacaaaatgcatagctttgaaataggtggtgctctgtccctctcccagagcagctgatgtgatgttgcatttctctctcttcatacacactcactcccatatacgttggccctgctttttctttcagtaatgttgaacactgcagtttcataaatttctgatagtttccattttaaatttattttatctcctcattctgtgttcctaaaccaaacacttaactgaattgcctacttcataatctctccaaccactcttaacaaatgcaaacctgaaatcagaatgtaaaccagtttaaaattttttttatttttattttttgagacggagtctcgctgtgtcgcccaggctggagtgcagtggccgatcttggctcactgcaagctccccctcccgggttcctgccattctcctgcctcagcctcctgagtagctgggattacaggtgcccagcaccacgcccagctaattttttgtagagaagtaattttagtagagaaggggtttcaccgtgttagccagggtggtctcgatctcctgacctcatgatccgcctgactcggcctcccaaagtgctgggattacaggtgtgagccaccacgcccggtcaaaccagtttaaaattttataaaaatttttgttccatgtcttgtgagacttacactaaataggggtttcaaaataacatggcctgccatatggtcaagccagatttaaaaattgagaatatctattaccaatccactaatgctaaagccaaagtcacagacagtaagaatgtaatccaatttagagaccaacatgagccaaatctttcgggcagagaaaaacaacgacaaaactataataaatgccaacactgcacttctaaaataataccaatgttattcattaaagtattagctacaaaaagtcaactgatggtagatgaagtctagagatgccctgaagacctttttcatccttttatcaaagctgtttttagctacaaagctacaacttttccagtggaccaacacacacataaaataaaccaaaagacccagaaatttttagcaaagcaaagggaagagaacaaagctctggtacttttgcaggatagtacaacatctcctttgagaaataaattaacttttcaaattctgtttctcaagtgatcaacataaatctacctagatgatactagctttgaaatcaaagtcattgggcatcaaaaggatttacagaggtttttactcttttgagacacagtctcactctgtcgcccagtggcacaatctcggctcaccgcaacccctgcctcccgggttcaagcgattcccgtgcctaaacctcccgagtagctgggattacaggcgcccaccaccacgccggctaattttaatatttttagtagatacgaggtttcgctatgttggccagactggtctcaaactcccagcctcatgtgatccgcccgcctccacctcccaaagtgctgggattacaggcgtgagccaccacacccagtgggttttactcttaaaaacaaacaataaaaaaaccacacactattctgcagtctcttgaatcttctaagattaaaattaaatctgagaaaatttacttcaactttcccacccaccaaaaaaacagaattaactgaagatatcaaagaaaaaacaatattttaaaggtatcactgaagagcactgtcagtacttgtctgatgagataactatggttctgtcataaattcagattacgcgagagaaatagcttttggccagtggatgtgctcttttgagaaagtcaattctgagctgaaatttcatgttggaacagtttcctctataagactcatcttgaaaggttcccgcagaagataaaatgtcatcctcacactgggcctgggcagtgcgcacttaactgggagggggcacaggcacctcagaacttaactggttttccaaactctcaatctcaaaaaaaaaaaaaaaggcgggcggggggagcactttcagtgttgatgaaaccaaatgctcgtaacctgggaccaccgcccaacacctgcagtccagccttcccccagggttgacagcatcagcctctggaccctgcagttgcagttcatttctgcgcagctctaatcgttagaaagttctgccttaccggctgggcgcggtggctcacgctcgtaatcccagcactttggcagatcaaggcgggtgaatcacctgaggtctggagttggagaccagcttggccaacatggtgaaaccctatctctactaaaaatacaaaaaattagccgggtgtggtggtggtagctgtaatcccagctactcgggaggctgaggcaagagaatcacttgaacccgggggcgcggaggttgcaatgagccgagatcgcgccactgcactccagcctgggcaacaagagcgaaactccatctcaaaaagtaaagaaagttctgccttagcataaaccaagacaaaacccaccattcagtcctaccctggggaggctctcagacctgtctccatgtcagtggcaccacctccatccccagcctcgaacccagcgttagcaaagaaggaaccgcctatccactttcttgatatacataccttcccaaagaatccagaatagactatgcatgtcaatagcatgaaaattaaaaccttactttcaataaagagctcctccctctcccaaaagactatcacttcagattagaaaataacttatgcaaaaaccttatcaataacaatgcttgctccaaagaccttattcagtatgcagttcactgaaactttccacaaaactaatacgtccatttgctaatcatgaaaaataatcttcatattttcttaattaataatctcaccagcaactgcttaatcacctaatactatttgagactaatgttatcagatagatagcaacatgaaaatacaatgaaccaatgctccccaaaagaaaaccataggttaccatttctacactatttacccataagtccagtactgtacaccctaactgtaaatgtacaccaactcccttttcaaaacacaaattttaacatcggcgttttccttcaggagcccatttcacaatcttaagaaaaagcttccatgaagacaggctgggcacggtggctaaggccgctaatcccagcactttgggaggctgaggcgggaggatcgcttgagccccagagttcgagaccagcctggttaacaggatctcttttacaaagagatcccatctcttaaaaaaaaaaaaaaaaaaggcttccatgaagatgaattaagcaaacaaaagctgatactgcttctgcatgctaaccatgtaatttaacggacacaagaaatgttaaaatatcatttgaatcaactatcgattcacaagaaaaaatatagcaggttcttaaaagtcaaaagcctcagccgacagccctgtggaattttcaacagatctccccactccccacccccaccccgcttccagccgaaaagccgatccaggcaagaggaagacacccagcctttgtgctatttcctgtcctctcccccaccttcgggccttcggaatatcgcaaaccgggccccgaaactcggcgcggcggcggccgccccacaaaggcagcggtgggagcgccatcttggcgcggccaccgggcccattcattcgcggggccgggccggggtccgcgcaaccctcgagtcgacacgcgcggggcgccagcgccggacagacccgggcctcggcaggagaagggcgaggccacagcgcgactgcctcagcggctcgacacagcgaaaagggccgaaaccgttattttcccatttcccgacgccgcgcccggcttccgctttaaatccctactccgaccgcggcgcgcggcccggcttccccatttcattgttccccttccccacgctcgcgccccgcggccgcccggccctcaaagtcaccccgataggcggcccgcgcgggggctccggccgccgacaccgccccgcctgcaggcccgcccggcctttgttctcgcgccgcgggcccgagagccacgtccggctccccacgcagggcccggccccgcccgacccgcgcccccggggccccggccgccgccacgggaagcgcccgcggcgcacacaaccccgcaccccggtgccgaaactcggcccccagccttgggcctgggaccccggctcctctccctagaccccgccctcgaccccgaccctgcaccccgaacctcggaccccagcccccggcccccccttcggacgccgcccgccgcacccgggcggggcaggaagacgcggccccgaccggcgggtggggtgggggcggggcgggcgcccccagggcgggcgggtggacgaacaggacccgggtccggggctgggggctgccgcgctcacctcagcgccctcgtcgcggcctgacgcgcccacaccgccgcctcggccgccgctcggcaggtcgtcgcgctcgggccgcgctgcgcgctccgcgggcgctgcgggcaggtgcgcgccggcgaggctcggtccagtcccgccgcggcggctgctccactcccggccccgctccccactcgccgcccgctcccgctcccgccgccgccgccgccgcctccgtccgcccctcagacgcctccagccatcgggatgggcgcggcgggcccctgcccgcagcctcggaaaaccccacgcgctcgcgtcaccacgcacgccgcgcgtcgcgcgcgctcgccaggcccgacgggcacgcgcacgcctgtgcgcgtccaaaccgcatcgggccccgagcgcgtgtccgagcggcttaaaggggccgtgctgctgccttcgggtaccgctgccccgggagacccccggcggcccggccctgcggggaccgggcgggatggggaccggggcagtggaccctcggagttgggatggggcggggggaacgcgggcgtggagccctccggggacagggtaaggttgggtaaccgtgggcgggggctcctccaggggcgggggtggggtaacggcgggcggggggcactcaagcgacagggcaggggcgggaaggccgcgggcgggggcggtccctccggggacggggcgggtgggggcaccgcgggcgagatcgcttcctgcagaggaggcaacaggccccgctagcaggtcagggtcccgggcaggcgcaggtgccccccggcctctcaagcagggactgcggcgagctcagacgcggctgacgggcagagactcgcgcttgggctcagtgcgtgtgaagtgggcctcgggctgcggaggagggcagcaccccgtggctcctcgcgctgctgcgagcagggccgcctggcaggggcgggggccggtgggcgggagtgtcggggtaaggccgcggactcctcccatgccgctgagcagtggacagcggggactggagacctccaggtgaggaaggggaacgaagtcaagaaggccacatgtcctggcttccaggcttggtgtcctcagaagcctccagaacgtccatggaacccgcccctgcgcccaccgcctcctgctgtctttccagctgagttccggctgcccctcaccctcggcttcttcactctgcctctccccagccagcgccctgctccccggtcctcaaccaccaccttccacctgcctgggccttcatcgcctccgagctccccttccacaccaaacctggcgtccgttttcctccaggcctgcaccagcacagctgaaggggagagagacccaacctcatccactgggcctcccctcaaccagggccacaacctcaaggggccatgccacctccaacacctatttcccaccttctactctctccacaccctgggacaccacccgcctctctcagctgacgttttccttcttgttttgtgtgcatggtgcttgtgtgagaaagtggacacacagtaagtgcggcttccagatgcgtccgccacctgccctccgtgccacgcgcttccccctacctaggggagcctccaccagacagggaacccacgccttgccacccttctctctccctcccacttcacctgtccgcatcatttctggagccctttctttctggcacgagatgctccagggccctgttgtattctccctgccccagcctgaacccagctatttctgctgcagcctggttcattgtgggagaatgtcatgcagagcccgggatctggctccggatgtgctcattgctactggggtgtcattgcagctggcggagcaagggaacacatctatgtacatgcccacacgcatatgtatacacacagtttcatgggcgtgtttgtctgtttttcttgggcaccacgtgtttactctgatgccaggccaacactacagggctcaacctgttcggaatgaggggcctcctgctttgggagtgaggaacctggctctgattatctcctgtgtaaccagtctctcatccttgcttccaccccaccatatgctacccgctcctcaccctgcgtggcctctgacctccgctggaccaccgaggccccgcccccacaggggcgcctgcctgcctagcacagttgagcaaggagtgaattcccagtgaaatttttttaatttttattttatttatttattttgggtttttttttctttctttctttctttttgagatgggggtctccctgtgttgcccaggctggtctcaaactcctgggctccagcgatcctcccacctcagcctcccaaagtgctgagatcacaggcaggagccactgcggacacagcctgaattgtcaatcatatcactcctgtgcctgaaaccattgacagttcccatcacccgccctctccccagtgtccaggcccctcctcccctccccactatcaagacactggctcctgatgctccccgacaccaccgaattccatcctccaggctttggcccagtggctccatctgcctgggacggtctccccataacctcgtgtagttcaggcctttgcgggtgtcacgtccatggagatgtctccccagccctaaccatccctcccaggtgcctctctgcctgctccgggccctccccctgttgcagtgtgagcactgtgaagcccactcttaaccgctgctccaccagcccagcgtggcaccaggcacacggggtcatcggagaacagctggtgtggctgataggctctgagttctgagtgaggaagatgcaacccagcacagggaccagtgcccagagcaagggatcaggagggacagaaccatcacctgggccagaacaagggcagggtgcgaggaacctgagtggttggacttcaggagagccgggtttccgcaggaaggcttctctgctcggacactcgaggggcagggtggagcatggggcacatccagggctgagggacgatgcagagtcgggggacagtgttctgcacgttggcaggtgaggggtcagaggtggccctcagaatctggcaggcctaatgccagccttcaatgaccacctgaattaaaagtggaaatgagtagcagggagaggaggctgaggcagcagcagggaagcccaaagtgggcagtggccgtttgtcaccagagaccttccagcagctgtgggatgggagaggccccagaaggtccctgcaagcctggcccagggccatggaggagcctcaagaggagtgggcaccacactgcgggccagactgggcagtggcagggctgtaccccagggctctcttgtcccacaggccaccatcagcctggtcagcccatctcagtacagccagggccatgaaggaaggccacacaggaggaccccaggccagtgcccgccctggccatatccaaggggcagggtgcagccccagcacctccagcttatctgtaggtcctctaggtaaggcagggctgtccctggaacttgccccatggcccaggcagaaatcctatttgatggtttatggagggcaaagttgagaggaaggagggagggaaggagcaggggccccgggtgcttactcccaggtcttcactgcagcctggggctgccctctgaagtacacagtccctgggaggcagagacctctgccctgaggacgatgtgaatccaaaggtgcttctcacctccagccagggcccatccctggagataagagacactcagagcccttggtggcccaggggggtctagagccggcctcagacctgccctccctgccccgcctccattcccttcagcccaggcctcttgtatcttttggccctcacctaccaccccgccctctccctggcagagcaaacgcttcccagtaacactcccttctctgcaaggatctcagagatcagcctgtgtccctgagtccagagccacacccggtcagctctgggtccctgagtccagagccatacccggtcagctgtgcccaaccccgggcaagactgagctgggccctggggtggaggcggctgcaccgatactggctccacaccaggccttctctaaaaccccacgggagcgggagatacaattcagatgccccacccccacctgcttctcagcaggaaatggtctaatgtgaaagtaggtcttttaaatccgaattattcaatctgtgcatgtgacaggacccacagctccatctctgtgcgcgccctgggcgccgcgctccagccaggctttgaagggtctcagagctgcaggggacgtttctagatttccagctctggcaggagaggtccctttgtctttccctgggctctgggctcctgcagggcgtctgtcctcctcctaccagcactgtgaggttctccaccacacggccctctgctgtcgtcttcacttgcagtgagatccaggccccaaaggacagagaataaggagggagggagagaggagagcatcgtgatggtgcccagggggtgcagaatgtaggtgatcaagaagaaagccctaattagctcctgcagctttcaaaggaaggggctggtggaggaatgggaccatggcacctctccaaccctcagcacacacctgctgaggcccactgggtgccagggtgggtttagcaccaggctctggccctgaggccaaagcagggcagctctgctcagggggttgagtaggggcctggttcccagcttcatggggagcggccagtgaggaggtgtcaccgcagcagagccaggcacaaagtgagggcaggctgctgtggctggtgaatgagtggctggcagagctgggagggtcactgccctacaaggtcacagacatcatggcccaggaggctggtgtggcaggcagagcgaatgccgggccttgggggcctctgagaggaggctgactgtggccccctggaccccgtcttgcaggtgcggggagttggcctctgtcccccaccaggactcatcccttgttccgaagctccccaccatgcttctcacccccgaccctcctggccaccaacccgtggtcatgaatcatgaattgcacatccttcttgggcacacccgtgcttgcacacccaagctgggtacacacatgcatgtgcacaaacacacatgagctgggtatgtacacatgtgcacacacagtggggaatcggtgtctgctggggggtggaggaggtgatggtgtaagtgagcagatgcattgtgggggcatgtttcctctccctgctagagttggaccagaatccccagagaaaactcacgtggcctcttgtcactctggtgagcagacccaggtgggctgacactcgcagagggaggtgcgtagcttagaccaccagctccagtaaagacctgacaacacccagcccctgcctcccttgcaggccaatggaagaatccaccttcttccttagagtcctttatcacaggctcatctggcctcactgtagaatcccaaaactgcatgcacagagatagaaatcctgactatgtccagtggccctaagtaccacagatgaacctaaaggaagggcttttttttttttttgagacagagtctcactccgttgcccaggctggagtgcagtggcacgatctcggctcactgcaacctctgcctcccgagttcaagcaattctcctgcctcagcctcctgaggagctgggactacaggggcgcaccaccatgcctggctaatttttgtatttttagtagagacggggtttcaccgtgttggccaggctggtctcaaactcctgacctcatgatctgcacacctcggcctcccagagtgctaggattacaggtgttagccacagcacccagccaacgcggggcttttctttctttctttcttttttttttttttttttgagatggagtctcgctgcgttgcccaggctggaatgcagtggcgcaatctcagctcactgcaacctctgcctcctggttcaaccgattctcctgcctcagcctcctgagtagctggaattacaggcacctgccaccacactcagctaattttcgctttttgttttttgtttttttgagacggagtgttgctgtgtcacccagactggagtgcagtggcgcgatctcagctcactgcaagccccgcctcccgggttcacgctattctcctgcctcagcctcctgagtagctgggactacagtcgcccgccaccatgcccggctaattttttttatttttagtagagacagggtttcaccatgttagccaggatggtctcgatctcctgacctcatgatctgcccacctcagcctcccaaagtgctgggattacaggcatgagccaccatgcccggcttttttttttttttttttagtagagatggagtttcacctgttggtcagactattctcgaactcctgaccttgtgatccaacccccccgccgccaccagcctcccaaagtgccgagattacaggcatgactcaccgtgcctggccaaggagcatttcaatgtcatcccccattcaaggagtgacagacctttggtttaaaatacaaaccttggccaggcgcggtggttcacagctgcagtctcagcactctgggaggccaaggtgggcggatcatctgaggtggagagtttgagaccagcctgattaacatggagaaaccccgtctctactaaaaatacaaaattagctgggcgtggtggtgcatgcctgtaatcccagctactcgagaggctgaggcaggagaatcgcttgaacccgggaggcagaggttgcggtgagctgacattgcgctattgcactccagcctgggcaacaagagtgaaactccgtctcaaaaaaaaaaaacaacaaaaaacacctcttggctgggtgccatggttcacgcctacaattccagctctttaggaggctgaggctggagcattacttcagaccaggagtttgagactaacatagtgagtgagaccccatctctgctaaatataaaaaaattagccaggcatgatgtctcgtgcctcaggtacccgctactcaggaagctgaggtgggaggatcgcttgggcaggggaggttgaggctgcagtgagccatcatcgcgccactgcactcaaacctgggtgacagagtgagaccttctctcaaaaacaaacaaaaaccccacaaacctccctaacagtgaaagatgcaaaaccatgaatggaaagagcatcgtcccctgcctgtagacccagaagccgtgcacagacaggtacgtgtgcatgtgcacatacattcacaatctgagtatatatgcatgtgcgtacatgggagctggtgatatgcacatgtgcatgcacacccaagctgggtatatgtgcatgtgaacaaacacacataagctgtgtatatacacatgtgcacacacaagctggatatacacacatgtatgtacatgagctgggtgtatacacacacccaagctaggtatacatgcatgtggacaaacacgagctggatatacatgcatgtacatgcacacccagcgtgggtatgtacacatgtgcatgcacacatgagctgggtatacatgcatgtacatgctcatcagctggtgtacatgcacgtgtacacacaagggctgggtatacccacatgtacatgcacacatggattgggcatgtgaacacacgcaaactgggtatacatgcatgtatatgcacagcagatggtatgcatgcatgtgtgcaaacacactggagctggtaaatgtgcatgtgcacacacatgagttggatgtgcacacacataagttggatatgcacacacataagttggatatacacacataagttggatatacacacatgtacatgcatacccaaacggtacactcacatgtacatgcacagcagatggtatatatgcatgtgtacagacacattcaagctgggtatacatgcatgtatgcacacacatgagctgggtatgcatgtacacccaaactgggtatacacacgtgcacacactcaaactgggtatatatgcatatgtgcaaacacacaggggctgggtatacacacatttgcatgcacaccagctagtatatgggcatgtgcacacacatgagcttggtatacacacatgtgcacacacatgcaagctgggtcagtcaggagtcactgtagcaagcagtagaagcttaagccagcttgcatgaaaagaggtaactgactggctcagtgaataggagtcatgagcagacagctgagcctcaagcctatctggatccagatgagcccgtcgggctctcccccggcccacccacccatggctctgtgtccccatgtggcgcctcctcctttctctgctgggtagagccccactgccccgtcacccccacctcagcagtcagactgctcagaagacggctatccggatgttgaccccaggaggactctgaaaggcttcactcagattttgtgtggctccaacggtagttagtggctctcaacacaaaggcagggctgtcgccagggggagcagaggctgctgggcatggggaaaatgcataggtgtccccacctacctcgtggctaaaaactagcagctgagcaacagctaggctacttatacccaaagcctctgttggttggtgaggtcaaggacatcggatggttggtttcacccatggtgaggtcaaggacgaaggatggctggctgcccctcgctgaggtcaggctgcctcacccttggcctgacccagcctgaacccggaggctgcggacagagcccacgggggtggagcaggctcaggcctctgctctccccctgcccccatggcgtgctgcagggcatcttctggggtggggtcatcgtgggagccccacgccaccatctgcaagtcctctgcagggacagttggagctcccaaccacccagcccccagccccatttcctgccatggctgggtggccccttggcaggaaggctacagctgttctctggggccccctcggcctcccacaggccaccagcatcctcaggctgagagtgtggctggcacaatgccctgcacacatcctggtgagacgaagggagaagctggcacagtgacccagagagacggacagtcagagcggcccacacccaccccccaacacctccacacagacaagagagcaaggtggcctaggtaggcaccggagacatgagcagaccgaaacggggacgcaagaccctcagtgcccagaaagtgggggtctgagagagggagctcagtgggcagggcctggggggtgagaaggactgtctcggaggcagccaccccagctgggccttggggctctgaaccctcaagatcccttctgggggcgcggtggctcacacctgttatcccagtaccttgggagacagaggcaggcagatcgcttgagcccaggagtttgaaaccggcctgggcaatatagtgaaactccatctctacaaaacatgaaaaaatacatttttttttttgagactgagtttcactcttgttgcccaggctggagtgcagtggcgcgatctcagctcattgcaaccttcacctcccaggttcaagcgattctcctgccgcagcctcctgagtagctggtactacaggcacgcgccactatgcctggctaatttttgtatttttatttttatttatttattttttgagacggagtctcgctctgtcgcccagcctggagtgcagtggcgtgatctcagctcactgcaagctccgcctcccgggttcacgccattctcctgcctcagccttccgagtagctgagattacaggcgcccgccaccaggccggctaattttttgtatttttagtagagacaaggtttcaccatgttagccaggatggtctcgatctcctgacctcgtgatccgcctgcctcggcctcccaaagtcctgggagtacaggcatgagccaccacgcctggccaaatgtttgtatttttagtagagacggggtttcaccacattggccaagctggtctcaaactcctgacctcaagtaatccacccacctcggcctcccaaagtgctgggattataggtgtgagctagcatgccccgcaaaaaaaataaaaattacctgggcatggtggcatgtgcctgtagtcctagctactcaggaggctgaggtgggaggatcgcttgagcctgggaagttgacgaggctgcagtgagctgtggttgagccactgcactccagcctggatgacagagccagatcctgtctcaagaaagaaagaaggaaagaaggaaagaaggaaagaaggaaagaaagaaaggaagaaaggaagaaaggaagaaaggaagaaaggaaagaaaggaaagaaaggaaagaaagaaagaaaagaaagaaagagagaaagaaagaaagaaagactctttctcggtccctcaacatcctcctcccaggcctggccaagcttcctggcctgaggtgtcacccgcctgcctagatgtgcttggggtggggtccctgaggctggagagtggggagacagcacagctgggccacactggccagtgcaggatgacggaggctcccaccccattccagtgcccagagtgagagcagaggtgactgggtgggaacccaggggtccagggaatgcgggggtggctggaccagccctggcctccagctcccttcgcctcccctgccagggccctgcttgaggaagaagctcaggcagctcaggagattcatcttcccaggggcggcaccccggacggggctcctcctacacctgtcggggaaacagttcgcacctgtggcctcagctggtgggtggctggtccagccaccaaggttttcctgactgcgaggcccctagaggtgcccagctaaggggctgcggagggcagagccttcccgagccccctgcccactgccctcttgggccctgccaggtaaggggcagcccagagatggacccagagtccaacctgcctgccctggagctgcccttctgtcccaaagaagcagctggaggtcactgacaggcagatgccagcagggccctttccagcagtgggtggccatgagtagccttccctggaagcaggggacctggtcaaggctctctcaggatagagaggcacctagaggggaagggccaggggtcctcccaggctggagctgcactcccacagtgcagctgctcactgggcggagctcttcgccacgccacaccgggctgcacgggtcacaacagtgcctcggggggccgtcctctccaacagaagaccccaccacactgccccgccctgtgaagaggtcagggactctatctttctctctgggtgccagggtcccacctgctgtccccaccccccacccagctcagggcccagaggtctccacaagggacttcctccacacgccccacgcccttggtgacttgctggctcccctttgttgggttctgcctcatgagctactgtaaaaaaaaaaaaaaagtggtaaagcctgggggcggtggctcacgcctgtaatcccagcactttggaaggccgaggcggccagatcacaaggtcaggagatcgagaccatcctgcctaacacggtgaaaccctgtctctactaaaaatacaaaaaaattagccgggcatggtggcgggcacctgtagtcccagctgcttgggaggctgaggcaggagaatggcgtgaacccgggagacggagcttgcagtgagctgagatcacgccactgcactctagcttgggcgacagagcgagactctgtctcaaaaaaaaaaaaaagtgataaaatacacataaaatttatcattttaactattttttatttttatttatttatttttaaatttttatttttttgagatggcgtcttgctctgtcgcccaggctggagtgcaatggcgtgatctcggctcactgcaacctctgcctcccgggttcaagcgattcttctgcctcagcctcccaagtagctgggactacaggcgcctgccaccatacccagctaatttttatgcttttaatagagatggggtttcaccatgttggccaggatggtctcaatctcttgaccttgtgatccgcccgccttggcctcccaaagtgctgggattacaggcgtgagccaccatgctcggcctattttttttcttttcttggtatgggggatctcactacgttgcccatgctggactcaaactcctgggcctccctagcagctccgactacaggtgcacgccactgcaccgggtgtgctgtaaccattttcgagtgtacaatgtgtggcatttagcacattcccagtgctgcgtagccgtcagcacccctgcatcagaacacttcactgcctccaagaaaaccccatgcccattaaacagccacaccaccctcctccacccccctggtcctggtaacctcggttccaccttcttttgtgaatctggctgtcgtagatgcctcctgccagtggaacacacagcctgtgacccttcatgtctggcttcttccaccaagcataggtctccaggttcatctgcatcacagcatgtctccgtacttccttcctctttacggctgaataatattccactttatggatataccacattttacccatacattcatgaatggatatttgggttgtttccaccttttggctttttttttttttttttttttgagccagagtctcgcgctgtcgcccagcctggagtgcagtggcgcgatcttggttcactgcaagcttcgcctcccgggttcacgccattctcctgcctcagcctcctgagtagctgggactacaggcgcccgccatcatgcctggctaatttttttgtatttcttagtagagacagggtttcaccgtgttagccaggatggtcttgatctcctgaccttgtgatctgcctgcctcagcctcccaaagtgctgggattacaggtgtgagccactgtgcctgaccggcttttttttttttttttcttaaatagagacagaggccaagcacaggggctcaatagttgtaatcccagcactttgggaggccgaggcgggtggatcacctgaggtcaggagtttgagaccagcctggccaacatggcgaaaccctgcctctactaaaaatacaaaaatgggggccaggtgcggtgactcacgcctgtaatcccagcactttgggaggccgaggcggacagatcccctgaagtcaggaattcaagaccagcctggccaacatggcagaaccctgcctctactgaaaatacaaatattagccgggcatggtggcacgcgcctgtaatcccagctactcgggaggctgaggcaggagaatcactcaaacctgggaggcggaggttacagtgagctgagactgcgccactgcactgcagcctgacgacagagctacaaacacaaaaaattagccacgcatggtggcacacacctataatcccagctacttaggaggctgacacaacagaatcacttgaacctaggaggcagaagttgcagtgagctgagaccgcgccattacactccagcctgggcaacaagaatgaaacccggtctcaaaataaataaataaataaataaataatataaaataaataaataattagagacagggtctcgctctgtggtggggttggagtgcagtgatgcaatcatggcttgctgcagcctcaacctccttggctcaagtgatcctcctgccttggcctcccaagtagctgggaatagaggtgcctgccaccatgcctggctaattaaaacaaattttttttgtagagatggggtcccatcctattgcccagggtggtcctttagctattataaacaatgctgttatacacattcctttttttcccaagacagagtctcactccatcgcccaggctggagtgcagtggtgtgatattggctcactgcaacctccgccttccgggttcaagcgattctcctgcctcagcctcctgagtagttgggaatacaggcgtgcccaccatgcctggctaatttttgcacttttagtagagatggggtttcaccatgttggccaggctggtcttgaactcctgacctcaggtgatctgccccccctcagcgtcccaaaatgctgggattgcaggcgtgagccactgtgcttggccacacacattcttttgtttgaacatctgttttaaattctttgggacatatacctaggaccagagttgctgggtaatatggtaactttttttgatttttttgagacagagtcttgctttgttgcccaggttggagtgcagtgacatgatactagctcactgcaacctccgcctcccaggttcaagcaattctcctgtcccagcctcccgaatagttgggattacaggtgtgcaccaccacatgcgcataatttttatttttagtagagatggggtttcgccatgttggccaagctggtctcaaactcctgacctcaggtgatctacccgtctcagcctcccaaagcgctgctattataggcagaagccactgcatccggcctttatttttattttttgagacagggtctcactctgtcactcaggctggggtgcaatggcaccatcacggctcagtgcagcttctacctcccaggcccaagtaaactcccaagtagctgggatcacaggcaggtgccaccatgcccggctaattttttttttttttttgagacagagtctcgctctgtcacccaggctggagtgcagtggcatgatctcagctcactgcatgctccaactcccaggttcacgccatcctcctgcctcagcctccccagtagctgggactacaggcgcccgccaccacgcctggctatttttttttttttttttgagacagagtctcactctgttacccaggctggagtgcaatggcacgatctcggctcactgcaaactccgcctcccaggttcacgctattctcctgcctcagcctcccgagtagctgggactacaggcgtctgccaccatgcctgcctaattttttttgtattttttagtagagacagggtttcacagtgttagccaggatggtctcgatctcctgacgtcgtgatctgcccgcctcggcctcccaaagtgctgggattacaggcatgagccactgcgcccggccatgcccagctaatttttttttaatgttttgtttgtagacagagggtatccctatggtgcccaggctggtctcgaactcctgggctcaagagatcctcccacttcaacctctcactgtggtgggatgacaagagtgatccaccgtgcctggccttgttctttgttttcaagattgttctgattattcagggcccttgcaattccacatgaatttgaggatcagcttttccattcttgccaaaaaggccattagcattcatcacctgttttctgaaaaaagataaattctgagcacaggccacagtgtggtgtcttagtccttccagcctaacacgctgaccagtggggtcagctcaccaagggcaggcgacagcgtgatgggaagcagcggggctctgagcagggacatgaccccctctggcggctgagaggagaacgtcccgtagggccagggtgaccagagaggagtgcagatgggctgtgaaggttgggcagggctgagtattcctgagtgacagatttgctggtggcacagggtcgagggcagtgggggagtcgaggctgacacctgggtgttgtaagcaacggggcagcagagccgttacagcggaggtgggagagcatgggctgctttttggacctttttagcatgagatgcttctaaatgtttgggtggagaagcaggcatggggagggtgtctcaggggcctgcagagccacaggctggcagggcacatggtggggacatgtgtagctgaggactgtcctggagctgccaatatccctgcaggagggactcctgggagtgctggcctgggcgtggggaagatgggcagtgtccacccaggccagcttggccagcccttgggagtggctgaagctctctgggggtaggcgtgagaggcaggcctgcccctctcagactgggtgttgcccccaggcctgggctccactagttcccatcttcaaggcttggagataacaggccttggcctcagggagtccagaatgtacaatgtcagcccagcccatcagggcagtggagtccctgggactcatgactgggacccaagtgcagccccgacatcttctgaagtggaggcaggcaccacagcacatgccctggggcaggagggggcagctgtggcccttcagcagggccatccaggcccagggctccatgcagaacccccagggtctcagccccttgactcctaggcaggactcaccccaaagccacggccttctcctgggactgcccctggggcctgaggctgtttgtctagaatgctgtcctgaggctccagcatgctccagcgtgtgtctcctgggagctgatgcaaggtttgcttggaggaggcaataaggggtggggtacggcatggggaccagtgaggtcctggagggggcacaggccaaggtggtggtctgggaggcctgagggcatgggggctgcccaggggtggaagaggaccccaagcagcagggatttgggtggaaccaggagtcctcaagcaggggtgctgcccctcctggggaggctgggcctgcaggtgctgggtgttttggaaaccagcaggtgtggccaggcacgtggcccctggagcctgtggctgacgcacatctgagactggctgggcgctgctgcacgcctcctggagctctgcccaggcttgccctggggtcccctgggggtaggcccagcctgtccaccagacttttttttgttttttgagacggagtcttgccctgtcgcccaggctggagtgcagtggcgcgatctcggctcactccaagctccgcctcccgggttcacgccattctcccgcctcagcctcccgagtagctgggactgcaggcacccgccactatgcccggctaatttttttgtatttttagtagagacggggtttcaccattcacaggatggtctcgatgtcctgacctcatgatccgcccaccttggcctcccaaagtgctgggattacaggcgtgagccaccgcgcccggccttttttttgagatggtctccctatgttgctcaggctagagtgcagtggcgagcgcgacatgggctcactgcaacctcgcctctcaatcacaagcaattctccttcctcagtttcccaagttactgggattacaggcatgtgccaccacgcccggctaatttttgtatttttttgtagagttgtgggtggggagttcgccatgttggccaggctggtcttaaactcctgacctcaagtgatccgcctgcctctgcctcccaaaatgttgggattacatgtgtgagctacctagggcccggcccccatcatacttctaagggtctgtctctcctgccctgcggcctctccagcagcccctggggaccacggggtcaggccttgattgggcaccgagctgggacctctgggagtgaccatggggaggaagccccccatcactgcagagggtggcaggagtgaggggctgagtcaacctgactcctggggccctgctgaggccagatccatgcccgcccgagcccagggcctgcccgtctcaggctgggtgttgccccaggcccggactccggcagtccccatctgcggtcccttttgggagctggaaggaggcgggacaggacggctgcgggggtgcaggggctcctgggccaccgggcgcgctggggcacgcgctgcagggaggatctggggctcctggtacgtttggacaacatgacccagctgctgtcacattcgaacgaggctgaagaggacgcggacggaggagccccggaacctggctgccactgcgccccgaggtggagcagggagtcgggccgagccctccgcggcgcgggcggctgctggcgaggggcctctcgggagccgcggtcggggcaccctgcggggccgcagccggcgcctccgttcgttcccggcgacggtgggagtccggaagggaaactcacagggccgtgtgtgaccgaggacggagggcggcgcggacggcgccgtgttcgcagtgctcgaaatccccacgaccggcctcggacggcgaccccggccggcccagctcccactccaagcggggtgacgccagacgcccaggccccgggaccgccccgagtccgcgcggcctgcgagcgccgtctggtgggaaagcgcggagcttccgacgcggggcggggcttccaggtggggcggggccgagacagggtggggcgggcgtcaaggcgggccgtggggggggggggggaagtgacggggcgtggccggatgacggggcgtggccgggtgacggggcggggccgggtgatccgggctcccccgcctttccccgccgccgctaggacgcacggcggtggcgagcaccggctcccacaggctgtgccacgtgaacgtcaagcaagaagcgagagacggccgcgcgcggtggctcacgcctgtaatcccagcactttgggaggccgaggcgggcggatcacctgaggtcaggagttggagaccagcctggccaacatggcgaaaccccgtctctaccgaaagtacaaaaattagccgggcgtggtggcgggcgcctgtaatcccagctactcgggaggctgaggcaggagaatcgcttgaactcgggaggcggaggttgccgtgagctgagatcgcgccactgcactccagcctgggcgacagggcaagactctgtctcgaaaaaaaaaaaaaaagggcgagaagcctctagtgcagcgctaggccccacctcagggcgcgctgggcttcgctcctcctcccccacttcgcagagggaagctgaggcacagcccggctttatggaacccagctgaggactgcggatggcgggagaagccctggggccgctctcgctgctggtccggggctgctggcagctctgcgcgctggtcccggaaggctttgttccaagacaagcctgcatttcccaaaataatccatggtttttagggctggtaacctgcagcccctccgccggcctgccctttctcagaaacaaccactttcaactatttgagctctttcctctgttttgtttgtttgtttttgtttgttttattgttgtttgtttttgagacagggtctggctctgtcacccaggtcggagtccagtggcacaatcccagttcactgcagcctcaacctccctggctcaagcgatcctctcacctcaggctcttgagcagctgggaccactgaccactcccggctgatttttttttttgtatttttgtagggacagggtttcactatgttgcccaggctggtctcagactcctggctcaagccatcttcccacgtcagcctcccacagtgctgggattatatgtgagagccaccacgcctggccctgaatgtacttttataatgtgactttctgctttctatttatgcttctttctcccctcctgtgttctgttagatttattacattttcgtcattattttttcctccacaggtgtggaggttatacaagcagtttcagtcattttagtggccaccttagaggtttcacgttgcgttttaggcccagggcattgtctctagctatctcctgtgcggtgctgggagtgcagggccctgtggctcacatcccctcgtccttgtggggtctgcgggtctggagttcgggcttcactttgttttttcacccttgtccaggccgggctcccgtaagcagatactgagacgaggactcaaagggacagtttttttgggggaattccaggaagccaccgtggggcagctggaggtgatgagggtgggaaggggccagcccagggctgagcagatgacactgtgtgcaaggggccatggctccggtgttcaccccatcactgttgcttgccctgggctctgctgaggaggcctcaggcagaagctgcacaaggaagggaacggcaggagaagccgggagccgtgaagtccttttcctactgagcccgtgctccaggcccaagggagccctgtgggtccagaccccgtagatgccgcagcagcaccgggtccactcgaccgcagcgaggttccggctgcagctccaccctcagagccaacctcatgctaccagggcaggtggggctcgggggaaccagtgttgcctctggtttgggtccttccagcattgggggtgggagtgtcagctcttcctatggagtggtgagcaaacctgcagacgcggaagcttcagagctacctggggatcaaactccaggggacacccacctggatgtccccaccagggccctgccggctctgatttaagtcctgggcttggtcctccgaatcgctgccctcccactgcagagtggagagcagagatgctgcctgaaccacagagggcccccgacgctcacacttgggctcacccctggctttcaagtgcccctttctctccttctaccatttgtagcctcgattggtggcagttacctggtccatccctctgcccttccaacacaccaccagtgagtgtaacaggtgactgtgcaggggcttgtgtcttcgtcccgcactggtgcctggttgcagcttggcagcggggggtccaccgccaacatccatcatgtcacagctggggctccccagaagctgaccctgagatggagtttgggataggagctccctgttaggggtcagcccctgtgacaggaagggggaagcagaaccagacagaaggggtcctagaccacctgcagggaccatcagagtcctgcctgtggacacaatgaccaccttgtgtcatgtggctcaggtggggtgggtttgcagctgaggctgctgccctggagtggggcggggtctctcagtgtcttctcactggagaccctcagtggcagtggtgatgtctgcggtgaccctctgtggtagaagcagggggatgtgtatatgtgtgtatgtctgtatatatacgtctgtcatatacacagacgagagagattttgaggaattggcccgtgtgattgcactgtaggcaacctccagggaagagctgatgttgcagccgtctggaggcagaattccttcttccttgggggacctcagtcttttctcttaaggtcctcaactaactggatgcggcccccccctacattatggagggtcatgtgctttacccaaagtctactgatttaaatactttttctttttttttttgaggtggagtctcgctctgtctctcaggctggagtgcagtggcacgatctcggctcactgcaagctctgcctccttggggttcacgccattctcctgcctcagtctcccaagtagctgggactacaggcgcgcaccaccatgcccagctaatttttttatttttatttttagtagagacggcatttcaccatgttagccaggatggtctcgatctcctgaccttgtgatctccctgcctcggtcccccaaagtgctgggattacaggcatgagccaccatgcccggcctactgatttaaatactaatcacatctatgaaacaccttcatgcccgcccatattcattgcagcagcagttccaacagccaagaggtgggagcacctaagtgttcatcagcagatggtggataaaccgagtgtggtccatcccgagaataacattttactcagccttaaaaaagacgcctattccaggccgagtgcggtggctcatgcctgtaatctcagcactttgtgaggcccaggtgggcggatcacaaggtaaggagatcgagacgatcctggctaacacggtgaaaccccgtctctagtaaaagtataaaaaattagccggacttggtggtgggtgcctgtagtcccagctactcgggaggctgaggcaagagaattgcttgacctgggaggcagaggttgcagtgagctgagatcgcgccactgcactccagcctggagatagagcgggactctgcctcaaaaaaaaaaaaaaaaaaaaagtcgaattcttttttttttttttggagatggagtctcactctgtcacccgggctggggtgcagtggcgcaatctcggctcactgcatcctccacctcccaggttcaagcaattctctgcctcagcctcctgagtagctgggattacaggcacctgccaccacgcccggctaatttttttatttttttattttttttagtagaaacagggtgtaaccatcttggccaggctggtcttgaactcctgaccttgtgatccacccacctcggcctcccaaagtgctgggattacaggcgtgagccaccacacccggcccccggagtcgaattcttaaaaacagaaagtagaatagtgattgccataggctggggggcggggggtggtggaagagggcagatgctgtttaatgggggcgggggtccgttttgcaaggtgaaaggttctagagatctgctgcataactgggtacggccatgaacacaactgcacttgcacctgaacgtggctgaggcagcattctaattgttacagggtttttctctttttctgttttcttttcttttcttttttttttttgagatggagtctcgctctgttgcccaggctggagtgcagtggcgcgatctcgcctcactgcaaggtctgcctcctgggttcacgccattctcctgcctcagcctccggagaagctgggactacaggtgtctaccaccacgcctggctaatttttttgtattttttttagtacagtcggggtttcactgtgttagccaggatggtctcgatctcctgacctcgtgatctgcccgcctcagcctcccaaagtgctgggattacaggcgtgagccaccgtgcccagcctctttttctgttttcttatggagaatagcccttcggtgatcagaagagacacaagaaggaaaataaagattggatgagtctcaggtcctagagatacggggtatgtccgaaggccacacagaggctggtcagcatgaggagagagggttagagggcgaggacctgttctgctgcttgtactgggtcttggatatgggtagaagcctagatggagaggagagaggttgatggtggttgtggccatgttgccccttcctacgggcggggcggggggtgtgccctctgctttaagttgggctccaggggtcacagctttgagtttcactcgtaagcccatcaggatgtctggaaccttcagggctgtggcccaggaatgtcagacgctggaagcctgggaacggaggaggcagagcctgctgtccactggctgtgagagttgttggggtggggacttgtccagggccacgaggccagtgcagttctctgtgtctctgtacccagctggcctgtacctggagaccctgagccagaacccaggatgggccctggcctgggtgctgcggctccctccattctatgcccctgggggaaggtgctcagtgcgtgaattgttccctgccccagcccaggggaaagctgaggccagggagcagccaggatgaaggtcagggcctcccttggccccaccagacccagggccgcttccctccagccccggctcccgtttggctggaggtgccctgggccattggcctgccctcgtcagcgtcaatcttgcagtctcagcagctggcctgggtttcagcgggagccatcctgtagctgcaggtttgctggcaggcagagggttgggctggcgggggacactgagtgccccacctgctcagactcttcatgccatcaaggggccagtcggggggcaggtgtgagtgtgaccctgagggccctgacctgccactgcaatcctcacactcttgcctgggtggggcagggaggagctggaccctggctttgggagtctggtgggtaattagacccagacagggagggctcagtgcgggtctgaggagggaacacacgtgtgcaggcgtgtgctccacggtggcatgttgatacggaccagcctgggcaccaggccccctcgggagccagctttgctgttctgagtggaagggagatcaggtttccctgagaaaccccaaaatagcccccaactgtgcctggcttccagcgggcagcccagcccccaggccctgttttgctccctttcccccttcacccccagcccatgtcctgctgtctcctccctgaatggtggaccctcagcccctcctgtacaagatggtcaagcggtgcctcatgcatttgttcattcgacctgtcctgagagtttgtgacatgctggcacggggccaatgttgagtccaccaggatgggagggtggccaggctctgagccactgagcaccagctggccaggatgggtcttcaacaagaaatctcactggtaagtgatgacagcatgggaccagggtcccatgaagacctgctggagggccgcacctctgggaaggtagacttggagcttggtccagtgaagagggaacagcacggggaacagcgtgtgtgagggtcccgccatgtctcagccctttcctggcccccgcacttagccttcggtgcccatcttcagggtcaggggaagcccaggccaaagcgggccgggaaggggccctgtggataaggccgagagcctgtcccaaaatagggccggcaggatttcccacccataaaaggctcttggaatctggaccccggggaccccaggcagccaggcccagctaaaactcagctgccaccactgccccagcactctgcccacagcagccctggtgtcaccaccctgcagaatcctgtcagacaaccaccgacatggtaaggctgctctctgtgcccgatggagtctctggtgggctggctgggtaggttgagctggaacctggaggtgcaatgacctgccacggagcctgggcaggaaggggctgaggtagaagagggggccaagccctgctgccaccaacacagcccttgttccggggccagggtggagcagccctttctgaaagctggctcccagatgggcagcagcagtggtggcaggcaggtgtggcccggtgctggactctccctccggaatgccacacaggctggagcccagggttctgcttcctgggctgtatcccaatcctgggctggaagcctttcccgggccagggctgggctcctccccaccctgctctcggcttccttcacctgcctcacctggtgtccattgccaggctccagggccgctgcctggcccgcctggccctgcagctgctgctgttccctcgcacgctggctcctgcctgtctggcccttgcccctgttagctgcctggcagagccctgctggccctgcaaacccctggcgtgtgaccccttgtcctggaagcctgctctccgctgggggcctcctctcttaccactcaccttgaaaggctgccaatggaggaatgggtgcagggggtacctctgacccttccctggacacaggggcagaaggggctcctggtcaggccggtgcgggtgtcccctgcagacagagcgcctgtcggctgagcagatcaaggagtacaagggagtctttgagatgttcgacgaagagggcaacggggaggtgaagacgggggagctggagtggctcatgagcctgctgggtatcaaccccaccaagagtgagctggcctcaatggccaaggatgtggacagagacagtgagctcatggctggagtggggtgggcagcctcgggggggccctgggtcaggtgtcagtgcctacggggggaagaggcaaagcccatggggagtgctgtgccccatcccttgagccccagctgtgccccttgcagacaaagggttcttcaactgcgatggtttcctggcactaatgggagtttaccatgagaaggcccagaaccaggagagcgagctgagggcggcattccgtgtctttgacaaagagggcaagggctacattgactggaacacactcaagtagggcccgggttgggggcgggtggtgggcgggcacgggcagggccgatggagtggctcagcgccaggccccgtaggtacgtgctaatgaacgcaggggagcccctcaacgaggtggaggcggagcagatgatgaaggaggccgacaaggatggggacaggaccatcgactatgagggtgagtggcctggagccctgggagccgttggctgggccggggcaagctgctgacctgcccctctgttcccagagtttgtggccatgatgacgggggagtccttcaagctgatccagtaggtgcagctgccgcagccgggggaggcctgcccgggaaggctgctgcccctgccccctggcccccactcccccggctccgtgtaaaataaatgttccagcccaacctgtgtgtgcctcactgtcccagcctgggttggggggcaacaggcaaaggcgtggggctggagaaggaaaagagttttcctggcccagtcacagaaacagccccagtcatttctgccacgacacctgacaccacccattgcccagctcagggctaggaatgccagcctgaaacctggactgggtacaggccggggaccacacgctcgcccttcctgcttgcactgggggttggctgcccaagggttcctcccagagccctggagtcccagagtccttcccacataggcagagaccacttaaatacaaactttattctctctccaagaagatgcagacgtcacaggtggccctgagctcccacccgaggcttaggcccaaggggcctcttccaggctgagggcctgctggggctgggccaggggctgaggctgaaagcagcagcctgcctagtgggtgacgccaggggccggtgtaacatggcaccgaggttggggccacagcaatgtgtgggacggtggggtgggctggggcccttggctccaagcattagttctccaagctctggtccgttctcctacctccttcaaggggcaccagggctacaaggtggtagttgagtattggggcccgactcctggggcactggagtggtctctaggcccgaggccccaaggagagggctgggtttctgggagagtgctggtccttcctctctgggcttggccatcttgacagcttcatcgtaggagggtggaggctccggggtgtacaggctgtaggcaggaggagccatggagtccaggtccagctccccaaagggcaggggcaaccgcatgcccagtgggtactgcacggagctgtaggctgcagggaaccagagtgggttcgtggaggcgggcttggcatttacccccgccatctccaccctcaactggcgggcccctaggcactcacaggtcacagtgctgtgtacagggctgtcactgtccatagggatgactgccacgtcgcagggctgccgtgctggtggcagatgtggctgggcctgtgcctgcttccggaggcagcagaaccggacacaaccagctgtgacaccacacagcagaagcaggaggaccgccagcaggatgagcctaggagagcaaggctctaccactggactgaccctcggccaccgggcacctgcaccctggggaatgtcgtggcacaaccaccgaagacaggttaacaggataaaaagcagacaatgtctctccatgtcggagaccgccgtggccagagcctggcctcgggctgctgggcctgccctggctatctctcctgggctggccaggggtggccttgggctcactcccaggactcgctgtcctcagcgagtgccccactgctgagcgggatcgtaggggactcccgcggaggccaggcgggagaggtgggagggaaggtcctgcttgctccaggtcagttcccgccagcggccgggactgggcgacagcggaggcggcctggtgaggtaagggcctggcgggcctggccccggtgacccccgccccagaaccgtcggacgcacggctccgccgcggcctccacttaccccacgtgccacaggctgctccagcgggcctggggcgggcacctgtggggacggcggcacctggagcaggcggggcatgggacggccgacctcgccacccgtgcctccccatagggcggggccaggccccggctccctcccccccgacttactggtccgaggggtcgcagctgccgtccgcgaagcccagcgccacctgtggggacaagggtgagcccgggaggggcgtggtccgagcagggacccgccccgcggtggccgaaccgagagagaacgccgcccgacccacctgcggcagcggcaggagcggcaggagcggcaggagcggcagcagcagccgcagtccgcgggcggccagcggcccccgggccatgctctgaggaggttggagcaaagcccggcggcgcggctttatggggccccgcccaccacaggacacacccaccacatgacacgcccacagaacgcccgctcagagtaaaccccgcccaccgggccccgctggccgcaggccccgcccacaggcgcacacgcctactggacgccccacgcagggtaaaccccgccctccgggcaccgcccagagcaaaccgcgttcgtcgcaggcctcgcccacaggacgcctcacgcagcataaaccccgcccactgggccccgcccagtgcaagccttgttcgccgcaggccccgcccacaggagccctcgcccacgagacgcccccattcgctgggcctccactcaatgcaaaccccgcccactggccccatgcccaacgtaagcctcgcccaccataccccgctcagcgcaatcccctcccactgggccacgcccaacgtgttcagagggcttgtccgccacaagccctaccccgcagctccacctggcccagactcgtgaggcgacggtgggtctcgtcctcagcccgggcacggcgccttaacctcggccgagcgtggcctgctctgctgctggtctgggcgtggcccggggaccctcgggagctggcctggaaagtcgtggctgccttgggtgtggtccctcgggtccagtctcgcaggcgggctccaggtggactgtagggtaacgccaccaagatgctgggcatcccgaacttggtgtttggacacttgattgtggacctgcgctgcaggcgctgtctgggggctggcccagggggctggagcctggccctggctctgggctgttgaggcgctgggtgcagaccactttcccaaagcacttggccttgggggccatgccccacctggggaatgtgacctccattcccgagggccacagggagcccagtgcccttccctcagcctgcaatgtctgctgctccctgtgcaggggcaggcctggggccatttcttccagggggaccccagacccttatccctctgccaccaggccaggggccctgttaggctcttggtgccctctgctccccgtgggaccaacagcacaccgtctctctggtggtcaggctaagggaggtggtcagcacagcaaggggcagggtccatcttactgcaggaggggcatgcaccccttgctcagaactgttccacatgtgggcgctgctcagtgtcccccacccctaccacaagggcagtgaccctggagggcagggcctcctctgcgtggctcttctgcccatacctgccccttcactgcatcactccttccactgttgggctctgcctgaagttgcctttcacctcccaaggcctgtgccacggtcctcaagggcccttcctgcctgcccagctcccccagcccctggcccttcttcctgccacattgactgcactggtcgtggaggcccagcacgggagtgggaatgggagtgcatgtgcacagcacagcctgaggccacagccccgagttccggaaggtgtgggcacggcccccacgcaggagctgggcgggcctcgccactcagtaccagaggcctgccagcaggagagtcgggtcagggtttagaagagaggggcctattcaggaaacattgccatccagtagcacctcctcctgcggccggggcctggcctggacctggcggaacctgccttcccctcccatctggtgtggcgcaagcttgagccatggtgggtcggccgcaggaagggcagcaagggacccattggacagaaatcctgcaaaacgccactgcggggtcaatgtcactggcttgaagtttggggcaatggcaagttcctaggcactgtgggccctggggggctgggggtgagggcaggcagctcaagaccggcgtccctgaggcctgtgcccaggaaagctcccagaagcaccatctgctcccccgacccggccagggaaggctgcgtacagtctgctggtggctgctggttggggtggcacagtgggtgtgctgcactgacaggagggccaggctgggtgggctctgtggggacagcgtccaacaagccagactccagagggcagggttggggtgcaggcaccactctgagcttcaggagcatctcacgggctgcgaggggtcttctctgttgaagggtgggtcagagcccagaaagccgagcccagacttatctcagacaaatagagacttcagtgcaggagctgggcctcacctggcccctgctgggtggaggggagggcatgagtaggctggggggtccccaccgtctgctcacctttgcttggggtcatccggggtcctggaacttgggaaaagtctggaggttcccggggcctgccctgggctttgcagccctgccctccccaccacccaggcccctcggttctgggtcagcctcagctctagctgtaccccggccctctgggctgcctgctgctgctcagggtgccaggcttgggggctctccttgaatttgggtcagggtggcctccccacaggtgtcctgcaggatggccccactctaggaggcccttgccaggcaaagcgggtgtcatggctgtgaggggaggggctgcttccccagggctctgtccccacctcccattctgtgctcaccccagggaataacctgctgtcacccacactgcaggctgcatgtgttggcctacaaaaaatttattgacaggctgtggagggctctcctgggggctgggggctctgagggggtctggctaggatggctgagggctggcctggccttctcgctgcttctgagtctggggtctcaggaggggtgctcttggatgtccctgggcttgcggggtccagggcagcaggaagtggccgtggcgccatgtggagggcggcctattggaatctggcagaggatggccaggtcccaggctctagggtagtatgacctggccctcagcctggggagggctttgagggtggacaggagggcccgagggtgctctgtgcagaggcttaggggccagtcaacacctgggctacaaagatgaccttgtaggtctccttcacatccccccttagctgcagcagggccgacaccatgagtgggtggtctggctggaacaggaggggaggggagaagaggccttcagtcagtgggcacccagaggagatctgctgtcttcccactgccctgcccacctgactcccttgggtcctccacggccacctcctcccctgggactgggcaggggtgtcagcccacccagcctttggcgttcccagggctccctggcctggagcccaaaggcacctacatcaaagtccgcaggtggcacccaggagatgctgatggtcttcgtctggccgcgctccacggagcccctggagggctcaatagagaaacccttgtgctgcagggatgcgacgctgtctatgctgaactcaacggtctgtggggtatggggctcctgtaggctggcgaccaggcaccgctcccagaagcagtgggactaggggtgagggtgcccagctccactcaccctcccagctctgaccaggctgcccaccccacagctgccacaggaagtccgagaaaagcccggctgtcaggacaagcccagtgaggggcaaggccaggagggtcagggctgcccagggcaggggaggccgagggggctgcctggtgtccccaggggcagtgctgtgggcaccttctttggagatggctgggtggtccggatacagcccacctgcagctctcgggtggcaggtggggctggcgtgtctgtgtcaaactggatgtagtccagggtcaccaggatgggcctcagctcctcagcttctggagagagagggcctggccgggagctggctggaggggtgtggccaggggagctgttcagggtcaggctgaggcatggggtgaggctgcagctggactcctgaactctggttagcagtggctgtcctgcttggctctggggtagaaggctgggaatccctgccctgctccgctgggtctcggggcccccatccacgggacaggggcaccgggaggccccgtgtctgttccctccctggggaggggctcaccctctctgtgcctggggtcaaatacagggatcgctgtcagagactccacgggcacgtccagggggtcgccgccctccacgaacatcatgtgctgacaggcggcacccttcagcaggatctggtgggagattttctggggacaagaagtggagtggccttgtccccgaagctcggcggcaggggtcctgctggtgagagctgggctggctcagggaaggaagcagggacggcctgggggccccgtggggccctggactctggtctttccactgacggccctcagtgtggtgctgagtcccccagccatggtaccctcagggcctccaaagtggagcagtgcagccaaaggcaaggccctgcgtggggccagggccgggccgggctgagcttgcagagccagagccgcaccttttcaaagagcaccacctggagcttgtcggagaagtagaggctttcgtggtcggggctgaaggtgacagtgaagtcttgtgtcttcccggggtccatgacgcccttgacgggggccacgctgaacacgctctgaccgttgagattctgcgtccctgcgggtagggtggggtgcagtttggccttctccacctgcaatcactgtctgccctccaagccttgctgcatagagctctacaccctgcccgcccccctgcagagcccctgtcctgcccggtccccccaatggccttgcgccccccactcctcccatggatccaagcgcccaccccccccatctcaccaaccgccccctccagctcactgcccacccccccagctcaccgcccaccccccacctcaccaactgccccccacccagctcaccgcccgtgcccgccagctcaccgaccacccccctccagctcaccacccgcccctgccagttcaccgcccgcagcccatctcattgcccagccccctatctcaccaactgtccccctccaggccactgcctactcccccagctcaccgcccacccccgcagctcaccacccaccccccaccccccgctcaccgaccacctccgtcctctgggagggcgagctgaggaactgcggcagctgctgctggccccggccccgggtgctggagaggctgtccaggtgcatggagaacttgatggggagcagagagttgttctgcagctgcagagagcaggccgcggtcactgcccgccagcccctgcctggctgcccccttcctgtcgtcggtgcccaggacttggctggtgctatgaggccacacccaagtggggacccgggtggcctgatgacgccagcacacgtggcggtttattgagctgtgtgccaacatcccttcttccagcctctcatcagcctttgctaggccggggctcggcttccctgcctagggtgcgtggacagctctggggtgtcacctgtcctccagggcgcctgagtctcgctcaggcccagcttagctgaacccacgtccccacctgtgtcctccctgccctcaccccctctccttagagcaccctttctccatgcaacgcccgtctcgggctctgcctccaggacccgccctgagccaggcggagaagcaggtgtccctcccggacccacactcgtgcgaaggcatgagggcacacgctggtgcgaaggcatgagggcacacgctggtgtgaaggcatgagggcacacactggtccaaaggcatgagggcacacactggtgcggaggcatgagggcacacactggtgcgaaggcatgagggcacacgctggtgcgaaggcatgagggcacgcagggcagggcgaaggcatgagggcacgcagggcagggcgaaggcatgagggcacatggggcagcgtgaaggcatgagggcacacgctggtgtgaaggcatgagggcacacagggcagcgcgaaggcacgagggcacacgctggtgcaaaggcatgagggcacacgctggtgtgaaggcatgagggcacacgctggtgtgaaggcatgagagcacacagggcagtgcgaggcatgagagcacgcagggcagtgcggctcactgcagagggctgcaaacccttgcccccggtggctgagctgagctccaaaggagtgagttcaagcagcagggcagggggtgggtggtgggtgggggagctctgtgcaggggctgaggaggagggacaaagagcgccaaggaggacagggaggtggggaggactaggggacatctgcagcctccccagaaacaggccccgggttccctgcaggagagggcggcagaggcggcagctgtgtagaggaggggtagagggggccacctgtgtccccacgggctctccgacccacgggtcacttttgacagctggcctgagtcctgcctggtggaaacccctcctgggaggctggagccagcaccagggcccacgtgtgcttcaccttgaagcctgaggacacagactctccggcaatcacatagcccatgttgaggacgctgccttcaatggagcacgtgatcatggacgccacgccagtgcccatgagggtgagggtgagcgtgcctctcttggtgatgatgtccagtgtttcttgagcctaaagagaccacatcgctcagccaggaaccgatgtctgctggagccacgaggggagctctgcctcaggggcagtgggttctcaacgctggagttgagacagctctgggggggctctgtcagctccgctcacttggcggctggtgtgagggcctgggggccaggctgctcgcagacccaggcttagtcccaggcctgagcacaggtgatgcccgccccggccagtgcctttgttctgcagtgtggggagccttgggccgcagtgtggccagggtgggcctgggactcaccaggatgctctcgtggggagagaaggaaagcaccaggacctgggtcccacctgcacgcagcaggctggagtggttcagcaggacaaaggggccgttggggttcagcagggagaagtccagctgagggtccacgtcaaggaggggatacaggtgtctgcaggctctaccacgccctccccggtccccgctcccaccccgcaggccgcctgagctgggtggacaaggacacggccagatcctcgggagagacgttctggatggagatcttcttgatactgcggtgccctgaaatggggcagggagcgtcaggccccagccccaggccccagggagcgtctctgccaggggtgggccgtggggctgggggaggcgtgggtgtgcctgggcaccggggtggaggtgtgggcggggcttagcgtctcacccacagcgacgtcgccgaagttaaagatggtcttgcctttatgggacgtcaccacaacagatggtgccaccgtcgggcaccacagctccaggtacagggtgttgtgggggctgggataggaagggcatgctgagggcagggtgggcggccccctgcccgcccaggccccagagttgggcagtagcagagggacagcgcgtttgcggctgaccacaccctgttctggccagagcaccccgcacctgaagctcaggggttctgaccccttcctgtctttgatgtcgccactggcaacaacacagggaactacaaatgtgtcaaacttcgcctggaacgctctgagcagggtggctcgggcggcctggtactcgtcggaactagaaggaagtcagaggcttgcgctcccgccttgcccccacccaccatcggcccaggccggacccctgcggctctgcctcagggtcccagggtcccagggtcccaagctgtggctgtcccagttgtgtctgacaaactggcttttccacccttctctggctcctgtgggggtctcatcactcacttcaggtcctcgtcagctggtggctggaggctaggggttggggcaggtgcctttggcccctggctagagagccatgttccttcccggggccacaggcacccattagagctttcccagggctcattctgcacccggggggctgggtggggggtggtggctttgctccccacccgtggattgaggctgtgtgcaggggtgtcaggcctggggaaatggggtgggtaggtcccaggaaggcagcacctggatccagctgtgtctgaaggcatcagtccttccagccacatgggtcattccgggcaatctgtagggaggggactctacaggggccacagtgggtcccaccagaggggcctggagggaagcaggtggggcagcccctcctggacccacctgggcctcagctcccgcttccgcatctccaggacgtgggggacagagactttgaacagcttgtcgcggttctgtgctcgaagaacggagaatgacagtccatgcaggtccttcctctggggggccatattctttcggaactgtggggggagcgactggctgtggggctgtgcagggccctaaacacagccagctgtgccccgtggctcctctgcggccagtgcgggaaccgcgggagccgcagttgggattgaatgtggggacgcaaaagccgaccggcgcccgaggaagacagtagccagtgcggaggggcacacagacccccacagagctgctcacagactgtggcgtctgcttcaccagaggataaaccgaggcacggagtgaggaggcggccagaaccggggtccccaccctggtgccttcccctatcttcaccgcggaaggccgaaggcaagtgcttcccctcgagtgcacgcccaggaggaacccaggccgggaaaggcaaacccttgggaggaagccaggccgggaagggcaaacccttgggaggaagccaggccgggaagggcaaacccttgggaggaagccaggccgggaagggcaaacccttgggaggaagccaggccgggaagggcaaacccttgggaggaagccaggccgggaagggcaaacccttgggaggaagccaggccgggaagggcaaacccttgggaggaagccaggccgggaagggcaaacccgtgggaggaagccaggctgggaagggtgcatctggagtgtggcaggagcctcgaggccacctccagggccggcacttgtggggcagattctgcaggacactccgtgtttcaggtgcgcctcccggggcctccaggttgttggaggggcccttcattgcatccgctgcacccctgggtcacagcccctactgcccccacctccagagcccacccttccctgctcccgcctggcagtgccttccagagagaagggagggtcttggtgagcaagctttttaacctcagatacagctcgacacgtgcattgcttgggaaaggtctaccctgtgctcccggcacgtggccggagccccccaggactcgaaggcggtggagtttgttcctgcaacaggcccttccccgacctacgcccctccttcccgggccccacgcacagatttggtctccatttctttgttcaggagtgggagggcttcctggcggatcagcttctcgggcagcactggccggaaggccacctggaccaggcacctctgaggagagaccagcgtgggcacaggggttgccacttccctccacctccccggagcccctgcgggcactctaccgtcctctgcccgtggactcccctcaaggtcacctcccccttgagatttcaggctgcgtgccccttcaggaagcccctccctgacctctgtcccccaggaggctgggcgggctgcaggcgggagcaccaaaccctctggccatgcagggggcagtcctgtgattggaggtgctgagaatagagtcctggacaggccgggactgggtcccctgtcctcggggcagcagtgacagctgagcctgcccttgccttgagtttgacgggcgagtcccacaccctaacctggtccctgcacacaccagcctttccaaggagcctccatcttggaaatggcttcccacagaagggtccctccatgacagagcccacaggcagtgtgcagtatggggttgggggtgacatggtgcgggagggggagagggtggggggagggtaggggagggagggagtgagggtagggagggagcgaggggagagggtaggggagggagaggagagctgcatctgcagtaatgtgtgtgggggtgagaaccatcaccgagtggctttcgctaagttgaatgaaatccattttgaatcactgcattcattgaaatcccatgtgagccaactgtcccttacatgcccttcctcacttaggccttcggcagccctcagggtcacccgaaggccctgccaggcccagagctttctgctctgcaggaaaggtagagtgctgggtgggagtggccgacaccttgtcctcccagtcggcctgcgaggtccacaggtgcaagggactacacagccttccccagtctcaacctgggagccctggatgggttccggccaggccagcagcctggggagctcctgcctctcggggtcaggctggaccaagggcactgtgaccccccccgatgggggtggccttgggcccccatgcacattggccatggatccttcctcggccctgctcgggtctgagggtcaggttcactcccgcccctgttctccgggttgaaaccctgtggttaagggtgggcagagccagacaccccaggggtaaatgcaggtggcgtggagctcctgcttcccagcctgcatgtggggcccacacccacctttcctggccacacggtccccactgagggcgagatggtgataggcgagtctgggggcagcaggaactcgaaagacgtgggccccatgggagaggcgtcctctgagccaatgcggggcttggagtgggtcggtgagctcatgctcaggtgagagttgatgacgtacactgtagccacggaggtgtcgtatagggccgtggcggcaaacttgatctggtagtgggacagctccaggggtgggtggacgcctacagcccggcaagacagcttgaagcacctgcaagcagcagcatgggaggccctcagccgtgcagggcgtccgtgtccctctgcggcaggcgcgggggccactgggtggaggacaagccccggggggggctcacagggacatgcacgttcctgctgcccagggggtcactgcgccgctgacaagtttcgaaaatacagcgtatccttgtgcacatttgaggtgggtggctaaaaattttaaaccgtatttattcatttataaatagagatggagtctcgctctgttgccctaggctggagtgcagtggcactacgacagctcactgtagcctcgaactcctggttcaagaggtcctcctgcctcagcctcccgagtagctgggactacagatgagtgccactgtgtcctgggtagctaaaaatttaatcacaagtttagatagttgcaaaggaagttgcaaaggaaatttctagcttattttgttaaatatttattgacgttttaaaaacggatctttttctctaaatggaagcacaggtgtctacgaggcctattatgagcaagttgattcctgccaccatctattaaaaagaggccgggacctggttattttaaccattggaaacttcacatttcatattttcctcaaatgcctatttccactgtattttccccattgatttttgtcctaattgtatatattttatgctgtaaaggacaatactcctatcacatttgtcggtaacagaaagtgttcattcatatgttgtaatattcaaatgcgtatttttatgtcctgtgaccacaggctctaaatgctttaaaaaattctttaaaaaggctggcatggtggctcacacctgtaatcccagcactttgggaggccgaggagggcggatcacgaggtcaggagatcgagaccatcccggctaacacggtgaaaccccgtctctactaaaaatacaaaaaaattagccaggcatggtggtgggcacctgtagtcccagctactttggaggctgaggcaggagaatggcgtgaatcctggagacggagcttgcagtgagctgagatcgcaccactgcactctagcctgggtgacagagcaagaccccatctcaataaaaaaaaaaaaaaaaaaaaaagttcgggcacagtggctcacgcctgtaatcccaacactttaggagtccgaggcgggcggatcacaaggtcaggagatcgagaccatcctggctaacacggcgaaaccccgtcgctactaaaaatacaaaaaaattagctgggtgtgctggcgggcgcctgtagtcccagctatttgggaggctgaggcagaagaatggcgtgaacccaggaggcggagcttgcagcgagccgagattgtgccactgcactccagcctgggtgacagagcaaagactctgtctctgtctcaaaaaaaaaaaaaaaaaaaaaaattcttaaaaaaattggctgggcgcggtgactcacgcctataatcccagcactttgggagaccgaggcgggtggattacctgaggtcaggagttcaagaccagcctggccaacacggtgaaacccaatctctactgaaaaaaatgcaaaagttagctgggcgtggtggccggtgcctgtaatcccagctactcgggaggctgaggcaggagaattgcttgaacctaggaggtagaggttgcggtgagctgagatcgccccactgcactccagtctgggtgacagagtgagactctcgcctcaaaaaaaaaaaaacaaaaaacaaaaaacaaaaaacttagaaaaatgtaggccgggcgcggtggctcacgcctgtaatcccagcactttgggaggctgaggcgggcagatcacgaggtcaggagatcgagaccatcctggctaacatggtgaaaccccgtctctactaaaaatacacaaaaattagccaggcgtggtggtgggcacctgtagtcccagctatttgggaggctgaggcaggagaatggcgtgaacccaggaggcggagcttgcagtgagccgagatcgcgccaccgcactccagcctgggtgatagagcgagactctgtctcaaaaaaaaaaaaaaagaaaagaaaaatgtagtgatggggtgttgcccaggctggtctcaaattcctggactcaagtgatcctcctgtttcagcttcccaaagtgctgggattacagccgtggcgcccagcactcactaaaattatttttgagtggagatattattgattattattagtagtcaatttttttctttctttttttctttttttttttgagacagaatctcgctctgttgcccaggctggagagcagtggcatgatctcggctcactgcaacctccgcctcccgggttcaatgattctcctgcctcagtctcccaagtagctgggactacaggcacccaccaccacacctggctaattttttgtatttttagtagcgatggtgtttcactgtgttagccaggatggtctcgatctcctgacctcgtgatctgcccgcctcggcctcctcaagtgttgggattacaggtgtgagacactgtgcccgaccttttttttttttgagatggggtcttgctctgtcacccaggctggagtgcagtggtgcgatctcggctcactgcaagctccatctccagggttcacgccattctcctgcctcagcctcccgagtagctgggactataggcgcccgccaccatgcccggctaatttttttgtatttttagtagagacggggtttcaacgtgttaggcaggatggtcttgatctcctgacctcgtgatctgcgcacctcggcctcccaaagtgctgggattacatgcgggagccaccgtgcctgacctttttttttttttttttgaaatggagtctcgctctgtcgcccaggcttagtgcagtggtgcaatctcggctcactgcaagctctgcctcctgggttcaagcgactctcctgcttcaggagagtagctgggattacaggtgtgcagcaccttacctggctaatttttgcatttttagtagagacagggtttcaccatgttggccaggctggtctcaaactcctgacctcaggtgatccgcccgcctcggcctcccaaagtgctgggattacaggcgtgagccaccgcacccggcccaactattcaggtatttctatatttttcctgtgtccattgtgtattttgaggaatttgtccatttcctcaaaattgtcaggttccctggtgtaaagatgttcatcatgttctcttcttatcgctttgatatttgttagggtctgtggtgatgttccctttcgctcctgatattgatggtttgtgttttctctttttatcctcattggtcttgctgggggtaatgaattttattaaattgtacaagaaagacttttagtttgttgtttttctctgttgaatattgcatttctatttcgttgacttccacttttaccttttttatgtctttcttctactctctttgggtttaatttactgtgttcttttcctaattcttgaaaaggaagcttagatggttgattttcacaccctcttttctaatatctgcgtttagaactagaagcttcccacgaggtgctgctctgacagcccgcaggcctcaaacctgatgggtccaacatggagcctttggtggtgcccatgaggatcagtcacaaaaatacccaggctgaggggagacaagcaaaatccagaccagcagcaggggtctgaggccaccggcatgaggtcccggtctgcatggggctctccaagtttcagcactcaaagtcctgcggcctgagaagcccctcagtactgggtacagcagcatggtggtcaccctacatctgtgcaagtgtagaagtgtgtgtatgtgtgagtgttagggtataggtacacacgtgtgtacgtgtgttaggctgtaggtacacaggtgtatacgtgggtgttaggttgtaggtacacaggtgtacacgtgggtgttaggttgtaggtacacaggtgtatacgtgggtgttaggttgtaggtacacacatgtgtacgtgtgtgttaggttgtaggtacacacgtgtgtacatgtgtgttgtaggtacacatgtgtgtattaggttgtaggtacacaggtgtgtatgtgtgttaggttgtaggtacacaggtgtatacgtgggtgttaggttgtaggtacacaggtgtatacgtgggtgttaggttgtaggtacacacgtgtgtacgtgggtgttaggttataggtacacgtgtgtatgtgtgtgtgttaggttgtaggtacacacgtgtgtacgtgggtgttaggctgtaggtacacacgtgtgtacgtgggtgttaggctgtaggtacacaggtgtgtacgtgggtgttaggctgtaggtacacacgtgtgtacgtgggtgttaggttgtaggtacacacgtgtgtacgtgggtgttaggttgtaggtacacacgtgtgtatgtgggtgttacgttgtaggtacgtgtgtacgtgggtgttaggttgtaggtacacacgtgtgtgcgtgggtgttaggttgtaggtacacacgtgtgtacgtgggtgttaggttgtaggtacacaggtgtgtacgtgggtgttaggttgtaggtacacgtgtgtacgtgggtgttaggttgtaggtacacacgtgtgtatgtgtgttgctgtgggtacacacgtgtgtacgtgggtgttaggctgtgggtacacacgtgtgtacgtgggtgttaggttgtgggtacacaggtgtgtacgtgggtgttaggttgtaggtacacacgtgtgtacgtgggtgttaggttgtaggtacacacgtgtgtacgtgggtgttaggttgtgggtacacacgtgtacgtgggtgttgtaggtacacacgtgtgtacgtgggtgttaggctgtaagtacacacgtgtgtatgtgggtgttaggttgtaggtacacaggtgtatacgtgggtgttaggttgtaggtacacaggtgtgtacgtgggtgttaggttgtaggtacacacgtgtgtatgtgggtgttaggttataggtacacacgtctgtatgtgtgggtgttaggttgtaggtacacacgtgtgtacgtgggtgttaggttgtaggtacacaggtgtgtgcgcgctaggttgtaggtacacatgtgtgcacgtgggttaggttgtaggtacacacgtgtgtacctgttaggttgtaggtatacacgtgtgtacgtgtgtgtgttaggttataggtacacaggtatgtaatgaaagtgtgacccctggcattcctgacagtgacgggctctggggagggagggagaacaaagccagctccgacttgagggagaatgtttgtttctgtaacaacaaagagaaatcagaggcaagtaggataaaagtctaagatctgtattttgggtggagggtacatgatgttggctgagtttgtgggttatctgaaaatggaagggaagaagagagcagaggacgcagagctaagaaagttgggaccttttttttttcagcactacacacacacacacacacacgaactgcagggggctctggagccatggagttagaaaagctctctgagaggtcaggtgtagtggctcatgcctgtaatcccagcactttgggaggctgaggcgggcagatcacctgaggtcaggagtttgaaaccagcctgaccaacgtggagaaaccctgtcactactaaaaatacaaaattatctgggcgtggtggcgtatgcctgtaatcccagctactcaggaggctgaggcaggagaatcgcttgaacctgggaggcagaggttgtggtgagccgagattgcgccattgcactccagcctgggcaacaagagcgatgctccgtctcaaaaaaaaaaaaaagaaaaaaagaaaagaaaagctctctgatctgcggccgggtgcggtggctcacatctgtaatcccagcactttgggaggctgaggcgggtggaccacaaggtcaagagatcgagaccatcctgtctaacatggtgaaaccctgtctctactaaaaatacaaaaattagctgggcgtggtggtgcacacctatagtcccagctactcgggaggctgaggcaggagaattgcttgaacccgggaagcgaaggttgcagtgagccgagatcatgccactgcactccagcctggcgagagagcgagagtccatctcaagaaaaataacaaaaaaagaaaaaaaagaaaaaagaaaagctctctgaactgggctcccttctgagagtgaggaggagagccgcgcacagtggctcacgcctgtcatcccagcacgttgggaggctgaagcgggaggatcgcttgaggctatgaattcaagaccagcttgggcaacatagtgagaccccatctctacaaaaaatataaaagttagccaggcatggtggcgtgttcctgtagtcctagccacactcaggaggctgaggtgggaggattgcttgaacccgggaggtggaggctgcagtgagccgtgattgcaccccttgcattcaagcctgggtgacagagcaagaccctgtctcaaaaaaaaaaaaaaaattaaaatgtaaaagttcagaaacaaataattgcacttgaaaatgagcagtagaaaatggtcgaatcacaggtgacattgttatgagacgagagagaatgaggagtggaatttgtgtaaacggcgaagcaaactgggaagcgtgttaggaaggaatcaaaggcagcagcctaaggactccacgtgtgcctcagagagttcagaaagtgatacagggttggaaactgcaacatggccgtgattacggatggaacgtgcaaagcactgggcaccaaaggcggctgagggagaggcgacggggcgttagcgccctggggaaggagccagcgtggcttttgaagtggtctggctgtctgactagcccagaggtgctgctgcccatgaacccacaacacagaacagaggaacatgtgaactgacaccacgggacagcatcgcacctgtggcaattccacaggacaaacgcacctggcgtcttcaataaatacatttcaaggaccacagagatggagggaggccccagtggcccaggtcagtaggacccaaatgtgggcgattgtttgatgaaggcacagaggaattcagggcagaatggaatcttctcaacaacgaggctggaataattggaagcctctgcaaaaaaatgaacctcaactcggctcacatcggaaacaaaagcgaccaaaacggaccacagacccggctgtgactgccccccagtgtcttggcctctgccccagaacacatccctggagactgacggtcccagcagcaacaagaacccacgcaggaccaccagccaccgcctggggtccagtttcatctctccctctccaccacttccttatcccgccctcaggctcagggaggtgcagagactggctggtcgcacaagacctcagagcacgcagggatttacaacaccaggtccacctctggacacaggtccacccacctgtgtccagaggggtgccctgcacagcatgcgtgtatacacacatgcacacacacagtctcacataaacgcactcatacacatgtacacacatgcactcacgcatggtcgcacactcaagcactcacacatacaagcactcacattcagtcacatgctcacacatacatgcactcacactcaaccttacacacccaacacacacgcactcacactcaaccttacacacccacatacatgcactcacattcagtcacatgctcacacatacatgcactcacactcaaccttacacacccacatacaagcactcacattcagtcacatgctcacacatacatgcactcacagtcacatgctcacacatacaagcactcacactcaaccttacacacccacatacatgcactcacactcaaccttacacacccacatacatgcactcacacacaaggcactcacacacacacgctcactcacatgcaagctcacacacccacctacgtgtactcacataggcactcacccccatacactcacatacctgcactcacactcctgcaggctcacacacacactcccacaggctcacacacacacaggctcacactgacaaacgcactcacacacccccatatgcactcacacctgctcctacagtgatacgtctgcgcacacacgttcacacacacacacaggcacactcgcctgtcctcacacacatgctcatatacatacacacccacgacacacacaaacacacacgtctgagtgggcccagaactcaaggctgcctgggtcccaggcctctctgcacccaggtttgaggttcctgctggccggcagtgctgcccagcccagccctgtggtcagccaggcagatggggtcaggggcggggatgtggtggagctgggaaggggggcccctcctgagcgggcactccaggccccctgcgtcccctctccctggcaggctcaccggttgatctcagacttgcaggtcagttggaatctgtgttcctcggccttggtgggctggaagatcacacagaactgcagcgtttccaggggcaggatcgtcccaaacccatcgttgggttggacgtccacaaactggaaatagaagagtgctctgagggcatgtcacggggagaccatgtggacacacgtgcggcagggccgtgagtgtgagagtaagagatgagtgtgatcgtgtgtgagcgaatgtgagggtgagagtgtcgctgtcaacgagtgtgtgtcagcaagtgtgtgagtgtgagcacatgtgtatgagtgcatgagcaattgtgagcatgtgcatgtgtgtgcacgcatatgtgtgtgtgtgctggggggagagagagggaggatggcggtgttggcggcggggcagcccagggaaaggtgaggggtgcccaggcttgggcctcgtcccagctaccttgtgtggccccagcaggggaaagtttcagaagaaagagcggggagagggatctggagcgcaggaggtgcacaggaccgaggcagaagttgggctgcacgcccagggctggtgtgcagggtggggaggcccaggtgtggaggggtgcagctgagaggcggaagttgggccacatgcccacgcgtgggggaccctggagcagtggccgctgcatcctgtccccaggacttcccagcctcacccctcttaccccaggcctggctgcaggaggtaccttgggaagcctgacgaacccgaactcctggggcaggagcgagtggttgtggaggctgatttccgtcctgatggcctcatagatggtgcagtagccaaaatccacctccgagggactgagctccaggtccgaggtggtgacaatggcatgcacggtgaatcccactggcttgttctgagacataaagggcacaggcgccctcgcagccactcggagacttaccaagtgctccccaaactctgaggcgcaaccactgctgctgccttgtggccatggcccactgtttccaggacacgacgaggccgtctcttcataaaacccacttccctgtgactgctccctgacatggcgggaggagctgcgggtgggtggcagctgagagcctgctgcaggtggagtggggtgcatgtgtctctgtgtgcggcacacatgggcgcatagacgtgtgcagctgagtgtgtggggcacccctcatgtgtgcacatgcaggtgcaggtgcctgggacacagccctgctggcctggatgggcctcggaggcctctctctggcccatgagcaccctcccagcaggcaagcccctctggccgctagacgcctcctggaaggcaagtgaggatgagcccttttgggggccctcgcccgggtgctgggcctggcctcccaggaaagcccctgctacccaggagcgcccagcatccctgggaagtgccccaacacagacctggtcggcaacccatatggtcatcggggcctccaggactcgggtctccttgtcaaaatacctccctgcgtcctccgggagggagtgtctgaaagaggcagacaaggcgaatgtgctttcctctttccattttgtgaaatgacaataagacccactgtcactggtgcttctacatcccgtgagagctacggcgtctctggaacatcagcgctgggagacgcatcgcgccgccctcctgctctcgcacagaacccacgagcacgtggcccctgtggccccgtgagggctctggcgtgtctaagtagccagtcactcccgggagcaacacaagtgactgtggctcaaaagctgtgtttaaataaacaggaataaattcaatagccatgtttcaaattaatatggagtttgcatcgtaaaggaatcctaaaaagccctttaaaaatgcattttcactttaatcagagcttgatctctgattacataagttaacgttgttaaagaactatcaggaaaagggccgggcacggtggctcacgcctgtaatcccagcactttgggaggctgaggcgcgcggatcacgaggtcaggagatggagaccatcctgcctaacacggtgaaaccccatctctactaaaaaatacaaaaaattagccgggcgtggtggcgggcgcctgtagtcccagctactcgggaggctgaggcaggagaatggcgtgaacccgggaggcagagcttgcagtgagccgagatagtgccactgcactccagcctgggcgacagagcgagactctgtctcaaaaaagaaagaaagaaagaaagaaatatcaggagaagtaaaataagaaagaaaaacatcagcctccctgtgacaggcggccggcgggggcaagtccaggaagcagccgattttaagctcagctccgccctgttcccctcctagtcccaccaggcccgtgcctgctgcgcccacctcccccaccaagctccactgagcatcatttgtctggaccttggtcccggcccggatgctgagggcagctctggggggctgggatcggacacaggacgtccagtctccaaagcacaacaaatgttcaagcgcagaaatcaaagttcacctggcaaaagcagagaccaggggatgcagccagcaggcctgggaagagccttggattagacgagggacagctgggtgacagggacaccctcaagacacaggtaaaggagcaaatgtcaggtgtgcactgagcttgaaacagaaccccagggagttactgggaaagggatgaagacagggaagacagcgggggagtgcacggaccgcagggtacccgtagcaagccagagccttatcctgggccaccttatcccggcaggtagcagaccctcagtggccatgagagccaccggccatgcatgggagacacgcagcctcccagtcttttcaacaacgaggctggaataattggaaacctctgtacaaaaaaatgaacttcaactcggctcacatcttaaacaaaagcaaccaaaacggaccacagacccagctgtgactgccccccagcgtcatggcctctgccccagaacacatccctggaggctgatgatcccggcagcaatgagaacagaggagtggccagtggcgaggagcgcctcggagcccacaacctcccacgtcctcctgtcccggccttggcgtcctggcacctaccgcggcaggaacttgagctgcacggagtaggacgactgtgcctggatatagcctgtcttgggcaggagctccaggtgggccctcagctccttgcacacctcgaacttcaggcgcagggcagctttcgacctgtgggcgtgtcgcagggcactgggtcaggtgccacagtcgtgattctgtgtgcgctcaatgcctggagttattaaaacatttctggcacccaagcccccgagaggtgctcagagcccacccactccaagccatgcacgtgcacctcgacaatcggagtcctcaaagccctgctttgtaagggctgttttttctgaaatgaaatctgatgaagaattcttaaaaataaccacatcgaaacggaagcacggtcctaatgggctctcgggaaccagatgctttccgggaagagcacctgccaggcagcccctgggtgcggggccctggaggggacatgaggggtggaacccctccctccagggctctgcccgcctcctgcccagggcatccccacatcctgcagctcaagcacagggcacgtggggggcctgggacggccacaggcctcggttatgacagcagcctccaacccaagacgagcctgagagagccaaggtacccgccagtcacctgggaggccatgcgtctgtccggtccctacctccggctcccttaagccaacggcctcctcaggaccacctggagcctccctgttcccacagtgaagcctccctcccctcccccgtcttggagcctctgctaaacagtgttgtggccgccccgccacagctgccccgggcaatccacgaggggggacccagagggtgtggcagtgagaaatctcctccctcctgtgcttccatgcgacagtcacccatgctgtggcagcctcatctccgtccatcacagacctgcctctgacctctgaccactacccagaggccacccacagtgcgtctgggcacgccagcctctgcacccctactgctgggccccatgggaggcgggcgcccgggtgctcagagaccgcgccctccccgtcaggcagacgctgctctgccttccggttcccttatggggccagagtctatacaaatgagcacacagctacactgaggtacacacaaccacagccggagaccatccacagagctgggccccactcagccctcaatgcccgacagacacgcctgggccctttctgtcaagtttccaaggccactgagaggctgtagtaggacgatgccggaggcgagcagactccaccgcagacacgccaacacacgcagctggctcccgggtcaccgcaggctgcacattcccggcccatgccgggcccacaggagtccgacagcaggaggacaggcgccgcgggagctgttcctacccaggtcaccggggagaggtggctgtgcctggggccggtgcccggggcctctgtgtccgcacaccctgctccttggtgctggtggcacaggggctccgtcatggaaaccccgcaggcccagcctcgccgtccctctgcgctttcccaccggcgtggctgttcagggcaggctgcttgctctgatgtctggagcccttgccaaaccctgcaagtggaggcttcctcctccaggctcaccctgcctgtgtccacgaggggctgaggactctggccgggcccaggcgggcagtgcgtttcctgtggctgctgaaaggatttgccccaagcttaggggccccacaacacagaggcacattcattctctccacgtcctggaggtcagaagccaagacggagctaaggccaaggtgcgggcagggccgtgcccttgtggctctacgggacaggtttctcctctcctttcacagcctctagaagctgcagtgtccccgggctcggggcccttcctccatcttggaagccgacagtgcagtgtcttcaaatcggcctgactctgaccctcctgcctccctgtgacgcctcccgtgatgacactggcgcctcccagatgatcctggatcaccccccaccaaggtccctctccccaaccatgtctgctaagccccctgcttgccacacaggatgccgttcagggcctggacagcagccgtggcagccccaggtgccatgtccccgctggccactggggggctcaccgcgtgtgcacaggcaggcagcggctcaccccgtgtgcgtgggtcaccccgtgtgcgtggacaggagggggctcaccgcgtgtgcacaggcaggcagcggctcaccccgtgtgcgtgggtcaccccgtgtgcatggacaggagggggctcaccgcgtgtgcacgagcacagagtcctggtagagccggtcatacatgcagatcttcaggtccacgctgggcttcggcacccagaccggcacatcgatggccacgcccacgaccctgaaatgcagctgcatatggacacaggagctcagcaacaggagttccttgggcacagcaggcattgttggtgagcactgacacagctcccaggaggaacgtttcatgggcttgagttttctaactctttgggacggctgtggcacttttcatatcatatcattcaaaatattctttttttttgagacggagtctcgctctgtcgcccaggctggagtgcaatggtgcgatctcggctcactgcaatgtctgcctcccgcgttcaagcaattctcctgccttggcctcccaagtagctgggattacaggcgcccgccaccatgccaggctaatttttgtatttttagtagagatggggttttgccacgttggccaggatggtcttgaactcctgacctcagggatccacccacctcggcctcccaaagtgcagggattacaggcgtgagccactgcgcccggccaaatattctttttattttcgaaatgttcaactactactagaacagaatactggatcaccaagtacctaccagtcagcttcatactcattaacatttaggtgtttaaaaaaacctttctatggccgagcacagtggttcacacttgtaattccagcactttggaggcccaggtgggaggatgcttgagcccaggagtttgagaccagcctgggcagtgtggtgagacccccgtctctacaaaaaatacaaaacttagccaggcatggtggtgtgtgcctgtggtcccagctacgtgggaggctgaggtgggagaatcgcttgaacccgggaggcagaggttgcagtgagccaagacagtgagatctgcttctccccaagcactgactcctggggcctcaggaggttagagagtatgagtgaggttttgggagggccagcaagccccgggctggggaagtgcagcagcccagcacgaagccgcctaggcagtggtactgtcctggtgctgtgaggtgagccgaggactctgaacactgtcgaggatgccaggagcctcaacctgggacaggcaaccgccccagcccatgcgggtgcatagggggtgcagagaaatgtttaaacatagaaagttgtcacttggggctgggcacggtggctcactcctgtaatcccagcactttgggaggccgaggcgggcggatcacttgaggtcaggagttcgagaccagcctggccaacacagtgaaaccccatctctacgaaaaatacaaaagttagccaggtgtggtggcacgcacctgtaatcccagctactcgagaggttgaggcaggaggatcacttgagcccaggggttagaggctgaagtgagctgtggtcctgccactgcattccatcctgggtgacagaacgagaccctaactcaaaaaaaaaaaaaaaaaagaacaaaggctctgcgtgtgtgcacgtgtgtgtgtgggctctgcgtgtgtgcatgtgtgtgcatgtgtgtgaggactctgcatgtgtgcacgtgtgtgtgggggctctgtgtatgtgcgtttgtgcgtgtggggggggctctgcatgtgtgcatgtgtgcgggactgcgtgtgtgcgtgtgtacgtgtgtgtgggctctgcgtgtgtgcatgtgtgcatgtgtatacatgcatgtttttgcatgggcatgcgtgtatgtgctcacagcatgcctgcctgtgtatgccagtgtgcgtgtgtgcacactcgtgtgcgtgcgtgtgttgtaaactgtggtgccaaccatccgtgccaccaactggccatccctgcgtgggcaaatggcgaccttgtggccaagggcagctgccacatgaggctgtggaggcaggggccagggtgtgtgcgtggcgtggcagcaggaatactcaccgtggggcactgggggttcttaaacgtgactttgaacctggcttggacgtcgcctgggacgaccggagtgaagacgatgggcaccttgatggagctgaaggggccaatttccccttctgttacctgcacaggaagagatgccatggggtctgccaggcttcatggcttttaagatcccttcccaaccctcacaatggcatgttgctgcaaggatggaaggtggcaggacccgtgtccctgggtggccacttggccacagatgtcctgggcctggcccagcccttggaggacttactgtcgtgggatcccagccagcggagttggaggcagcctgaactcctccacatcctccccctgctcatgagctcatggccgtgtcccagccagggaggccgcggccagcatccaccccaagtttcacccagtgccccacacccgggaaacaatctgtggcttgcgtcctgcacagccggaggcggtggccccatgccagctgagattacaagaggcctggaggctgcaagtccctggtggacaaagtctggcctgtctctggtcaaacgcaagggccacctagcagtgagggccagtgggttggggtgcagctggggctgggggaaggtgggcggtgtcttggatcgtggcagctattttagggcctgagctggctgacctcccccagcgtgatctccgtctgctcttcgctgggaggtatcactgtggttaatctctctggttctggaagagaagggggatccagaggtgagggttggcagggtggaggcagtgtggcccaggcccccttgggacgtggtcaccacctccaaacccatatcctgggctctgttctttctgaacatagtggagccatccgtgtggccccttggggcacccaggcccagagagggtgcagccagtccccaccgtgcccggagggctttggaagccctttcccaaagacccccattttctcacgacctgttggcccagggcgagggtattagaggctggagtgggaaggacagctaagtccagaaaattctaaaacagtgtcatcttttggggatgtttcttctcttaccatcatatctggtaacctaacttcccatagctgtagcgtactgttccctacgggtacctgctactggcgtgtttgagtcatcacttccctgtggcaggctcctggtttccatctgccactgggttctgggggcaccagccggcagctggtcagcagcaaggccccgggtagcagagctgtttccttgcaagtctgagcaggactttttgttgactttgcacctgaacagaggcaattcgagaggccacgcgcaggttggcattctcctttggcctctgtcgtgctgcccggtcgggtcagagcagctgggccaccagccaggccaggtcactgtggagagcccccacgggcttgccagagcctgccccgggctcagcgtctggacggcagagctcttcaggagccaggtggcgactttgaagcaccatgcacatcatttctggggtctggagttgtaaaggccgcagggacccctgttcttttttttttcttttagacggagtctcggtctgtcatccaggctggagtacaatggtgtgatcttgactcactgcaacttctgcctcccgggttcaagtaattctcctgcctcagccttccgagtagctgggattacacgcacctgccatcatgcctggctaatttttgtatttttagtagagacggggtttcaccatatcggccagactggtctcgaactcctgaccttgtgatctgcccaccttggcctcccaaagtgctgggattacaggcgtgagccactgtgcccggccaagggtccccggttctgaaagtggaaggggtgcggctgcctcaggagtcaccacggcaacaagaacctggacctgagcgcaggtggtcagattctggggccagcagctttttggtttttagagacgaggtctcactctgttgcccaggctggagtgcagtggtgcgatcactgcaccctgcagcctcggcctcctggtttcaagtgaccacagatgcatgcagccatgcttggcatatataaatatatatatatatatttatgtgtatattggtagagacatggtcttgttatattgcccaggctgatcgcaaacatctgcttaagcgatcctcctgcgttggccctctaaagtattgggattataggcatgagctaccatggcctggcctccttattctagtcttttctttcctttcttcttgttttttttttttttggcagggtctcactctgtcacccaggctgcagtgcagtggtgtgatcacagctcactgcagcctcaacttcccaggctcaagcgatcctcccggctcagcatcctgagtagctgggactacagatgcatgtcaccacgcctggctaaattttcttctttgtagatatggggtctcaccatgtagtacttttcaatgtattaagcatccttatttgatatttgatgcctgataatacccatgtctgaaccatgcaagattgctgcaattccttccttccttccctccctccttcccttccttccttccctttccttccttcctctttcctcccttcctttccctcccttactcccttccttcctccttccctccctcctttccttcattcccttccttccccttccccttccttccttctctccctccctccttccttccctcctttccttccttccttcctttcctttccctccttcctccctccctcctttccttccttcctttcctttcttcccttccctccctccctccctcccttccttcccctccctccctcctttccttctttcgacagagtcttgctccttcacccaggctggagtgcaatggcatgatctcggctcaccacaacctctgcctcccgggttcaagtgattcaagtgcctcagcctctcaagtagctgagattacaggtgcgtgccacgatgtctggcaaattttttgtatttttagtagagatggggttttgccatgttgcccaggctggtcttgaactcctgacctcaagtgatccgcttggcctcccaaagtgctgggattacaagtgtaagccactgtgcccggccaaccgcagtactttctgttgtttctgtgtgagtgattttttttttattttttatttttttaaggaataagttgcatatagtaaaatggactcttcttagtggaactttcttaagttttgacagattcatgtggttgtacactcatcacagcaatcaagacactgaatggccccaccgtgcccacgtcgcccatgcccctttctagtcaaccctttcccctgccccagcaaccagtgatctattttgtctctacagttttgcctttttttagccaaaatattctttttctagaatgtcacaaaaatggagtcacagagcttacagtcttttgcgtctgagttctttcccttagcatgatgcatttgagactggtccacggcactgcctctatcaaaggttcatgtctgtttgctgctcggcagtgctgtgtggcagggaccccacggtttctctatccactccccacgcgtgggacattagagttgttggtttttgccaattgcaaataagctctctacaaacattcacatacaggtttttgcgggaatttaagttttcgcttctcttggtggatacctaggagtggccttggtgggtgtctggctttgctgctgagcgtttcgctggtggccatgccattctgcatccccaggggcagcattagaattccagctgctcctcaccggcacttgctattgttaaacttgttgttctttgtttataatttagctgttcttataggtgtgtagtggtgtcccattgtggttttaatttacattttcttcatctcatgtttaatgatgttgagcgtcttttcatgtgcgaatttctcatccacgtacgtatcttctctggtgaagcatctgttcagtcttttgcccattttttttttttttttgagatggagtttcattcactctcattgcccaggctggagtgcaatggtgcagtctcagctcactgcaaactccgcctcccaggttcaagtgattctcctgcctcagcctcccgagtagctgggattacaggtgtctgccgccatgcccagctaagttttgtatttttagtagagacggggttttgccatgttggccaggctggtctcaaactcctgacctcaggtgatctgctcacctcggccgcccaaagtgctgggattacaggtgtgagccaccgcgcctaggcttttgcccattttttgactgggttattttccaattgagatttgaaaattacatattttggacacaaattttttatcggatttgtgatttgctaatgctttccgccagtctgtggcttatctctgcagtctcttaacagcgtctttcaaaaagcagatgttcttggttttggcgaagtccagtttacaatttttaaaccaggggccataatttcaatgttatgtctaagaaaaacctttgcctcacctagggccacacattctctcctgtgtttttttcgggggggaattttatatttttaggcttaacttttaggtacatcatctattttgagtaacttttgtttacagtgtgaggaacgaattaaagttaaactggaggggggtgtattagtctgtttcaccctgctataaagaactgcccgagactgggtaatttataaaggaaagaggtttaattgactcacagttccacctggctgacaaggcctcaggaaacttacagtcatggttggaaggggaagcaggcacgtctcacacagcggcaggagagagagaggtgagagcatgtttataacatcatcagatctcatgagaattcactcactattatgagaacagcatggggaaaacctctcccataattcaatcactttcctctctccacacgtggggattacaatttgagacaaaacctgggtggggacacagagccagactatatcagggggcttatgtttatccaattgttatggcctcacttgttgaaaagactgttctttctccaagcaattacttttgcacctctgttcaaaaccagttgactataattgtgtgtctatttttggattctcttgttccgttgggtctctatctctgttcaccaccacactgtcttgttactgtacttcatagtaatcttgaaatcaggtagtgtaagtccttgaaatttgttttttcaaaattgttttggtcactctaggtcctctggttttccatataaacgttataatcaccttgtcaatttccattaaaaaatcttcctggaattttggttggaattgcattgatccatagttagttctgggatattcacattttagtgaagtgttccaatggttagttcctacagtatagaaaatctgcttgatggccaggtgcagtggctcacgcctgtaatcttagcactttgggaggctgagatgagtggatcacttgaggtcaggagtttgaggccagcctgtgtgatgcaaaccgcctcatgcagactgcagagaataccattcaggctgaaagagcatcggtgagcggccaacgcacaggcagcctccctcagaagagcacagctttggctcagcacgcagggaattccacgagaagcatagctcactgcaacctccacctccccgcttcaagagattctcctgtctcagcctccggagtagctgagactacaggcgcctgccaccattcctggctcattttttgtattttcagtagagatggggtttcaccttgttgccctgggtggtctcaaactcctgacctcaggtgatccacccgcctcggcctcccaaagtgctgggattacaggcgtgagccactgggcccgaccaaggtgtttccagttctgaggccaatttaaaggccaggggtcattgtaatgagtagagaagaaaataaaggaagaggataaaaggctagagtataaaattaaaaaaaaaaaagaaaagaaacaaaaaagcaagaccaatgtaaagcacaaaataagatggtagaaacgaatccaaatatatcaatcatcacaacacatttaaatagattaaatgttctaagaaagtcaaagactgtcagactggataaacagaccaaaactgtataacacattgatgagcaagaaagaaagaaaaaaggaaggaaggaagggagggaaagagagaaagaagcaaagaaaaagaaagaaagaaagaaagaaagacagacctagttaaatgaggagataatggttatgaattacaagactcaattttttttttttaagagacagggtctctgtcgcccaggctgaatgcagtggtgcaatcacagctcactgcagccttgacctcctgggctcaagccatcttcctgcctttgtcccccaagtagctgggactacagaggcacatcaccacacctggctaattaaaaaaaaacttttagtagagatggagtctccctatgtttcccaggctggtctcaaactcctgagctcaagcgatcttcctgccttggcctcccgaagtgctggtattacaggtgtgagctgctgcacccagcctcaatactgttaagatgtcagttctccccaaattgatctatagattcaatgctatgccaatcagattcatgctatgcttttttggtagaaataaaaaagctgattctacagtttatgtggaaatgtaaaggacctaaactatcctgaggccctaatgcaaatattgtggaaaaaaaagaacaaagttgggtgacttacactacctggcttcaaggctttgtctgagtccatgataaccaagacaatggctctggcataagaataattaaatggatcaattaatcagaaaaaagaggcgagaactatataagctcatgcttatatggtcaattgacttgcttttttttttttttttgagacagtattttactcttataggccaggctggagtgcaatggcgcgatctcagctcactgcaacctccgcctcccgggttcaagcaattctcttgcctcagccacccaagtagctgggattacaggcgcccgccaccacgcctggctaattttttgtatttttagtagaaatggggtttcaccatgttggccaggctggtctcaaactcttgacctcaagtgatcctcctgcctcggcctcccaaagttctgggattacaggcatgagccactgtgcctggatggtcaattgatttttgacacggacaacgaatggatcgaatgggatagcagagtccacttgtgccgtggaatacacaaacacgcaccaggggaaatgagcctcagccctgacttccaccacaagcaggagtgaatttgaggtggatcatacacctcaacacaaaagcgatgtcctatgtctttatgaccctggaggagaaaaaaattgcctaaaaatcataaaaaacaaattccaatagaaatgactggtaaatatgcaaagactggactgaagaactttgatttgagaaaagacgtcataaagggagaggaaggcccagccacagactcggaggcagcacctgcaacattcctcagggaggagggctggaatctgggtgcatgaagagctcctatgaatgaatgagaagaagacagacaatcccacagaagaacaagggatagccttaaacagagatgtcacaccaaagaagatacaacttgtaaatgggcccagggaaagacacgcaatctcactggtgatctgggaaaccaaaaagcaacatctcaacagcagaccgtggtgcaggccccccagacaagcagccccgggccgtgtgacctcgtgctcctgcggatgtgaagcaaggccctcaagcccagtgtggccccgtaggaccctctgtgaccaggcagagctgggcttctgggctgtccagtagggcagccgttgcccacaggtcgctatggagcatgtgaaatgtggcccttgtggaggaggacctgaattttcactattatttaatttggatcaatttaagtttaaatagccagatgtggcagtgacagccacgctggacagcacagtcttgtacactgttggtgggagtgtaaacttgcacaaccactttgaaaaagaactcggtgggctaggcgaggtggctcatgcctgtaatccagcaccttgggaggctgaggtgggcagacagcctgagttcaggagttccacaccagcctgggaaacatggcgaaaccctgtgtctacaaaaaaatacaaaaactagccaggtgcggtggtgcgtgcctgtagttccagctactcaggagctgaggcaggaggattgcttgagcccgggaggtcgaggctgcagtgagctgtgactgcaccactgcactccagcctaggcgacagagaccctgtctcaacataaaaagaactcactttggtattagctgatgccagtgaggctggctatgccctgtgatgcaggcatgagccccagccaggtgccctgtgggaactcacacacaggccaaggggcagtgcagaacggccttcgcaacagtgtgtaccacgaacgctcccaagtgtgcactggcagaaggacggatctagaacccgaggctctctcaggaaaggaaacgccacgcagtggtgaggacaggaagtgcggctcacaccggaagtgcggctcacaccggaagtgcggctcacaccggaagtgcggctcacacaggctgtggagaaccggcccagctccgcgctgagctgcagggcgtgcggaacgcgcaccacgcgaagacagacaggaggaggacggaggtttctggatctcgatgcgtatgtgggaaaacgatcaagagaagcaaggaggagacgcaagcgattcccgatggcggcgggctgcagggcaggaggcatggggagggcagggcccgcccgtttctcggcacctctccccgctggtgcgcgtctaacaacagccacagctgcagagctagacagaagccccccgcagcccggcccctccagggggcaccgcagagcctcttccccgccctgtgcggctccgcccgtgctgggcctgctgggccaatgctggaggtgccttcaagtcttcggttagcgtcaacgtgaatgtacattttcgtccactccaaaaacaacacttagtggcacataagaatattttcttgcttaaccgtcacttaacatcgaaggcctaggaaaattctctactttccagccctcccctgggcccctcagccccctggaatgctgccctgaggccctcaccgcccgcccaccctggcttggcctggcagcctggctcacctgcgggctgctcctcctcctgctccttgtccagcttctccagctccttccggctctgcatgtccgcctgggaggactccgtgccctctagctgctgctcagagaagctggtggcggctttgtcatacaagcttttatcttcgtaggtcaggagactgctctagagaggagaatcaacatcctggcttgggaggtttcccacctccttttcccagtcagctgccggaactcccatgaggacaggccgtgttgggggctggaccctggctccagcgtggcccctcagctgcctcctcggctgcctgctctcgtctcacccatcctggttgtgggatcacagcagcagctcacccagagactcagagtcacccctcagcctccctcactccaggccgggtgggcatggctgtgctgccccagcctgggagtgtgagccacatcttcctcttggtccaaccctccttcctccttggctggctagaggctgaggcttctctccacctgagccttgggacacccatacccgtgacaggacaagacgcgctcacacttggaacaggtgcagctgtggccatggagtgcacctgtccagtcctcccacccccacacctggggcttcagagatgcgtcgggggaggctgggtctcctggggccctcgggcctggagctgctggccagcacccctgctgctacgtgcctgagaaagggagtgtcctgctgctgctgcccctgaggccaggtgactgcaggtgtcctacagaagaagctggtctcttctgcttaggctgatttgaggaggcccccacactgccctccttctcccaggcccactgttgataccctcatgttgtcacctctgttcacccacatgggactggatttggggggcaggtccccacactcccccatggctgagtggcacactcactaatttcagggcagactgggagtcgtccatctcacagggctctgaagctggcaggaacttgaaagtcgtgcccaagcccccaacgttggtcagcgtgatggtccgagacgtggtctctcctaccacgtagctgccgaagtcaatgagctccttgtcgagggacagctgccagaggacatggagtgaactcagggccaccgtgccaggcccacagggtgcccagcgtgaggcctgcacgtggctccaggcagggctgccctgagcatttgtgcgcgttgtgcactgcacaagcaggtacacgattcaacccagaaatcaggtgtgtattgctcatgacaaggtgtggcacgcgagtctggttttaagaacatcaaggcaggagccccctcgccacggagtaacaagggttcagtgagaggacgcagggcccggatgcagggcctaaacaaggagcctggacacggggctttggaggtcctgaggatggatggtgtcattcctgggtgaggtcagctggactctggatacagggacccagggagcatccttccagaacgggagcacgccctccatgggggtgcctcaccatgcccgctgtgggccacaggccacagaagctctggtgctggctaaggatgcaggcccgggccatacctcggctctgcccaatggcccctcctcgggaggcttttctgggctctgagtttggaggcccaggggctccccactctgtgctcctgctccaggggcaggaccaggggccaccgacgcaaatggacgtggttcgcagagggcggtcggggtccagccaagggaggccgcctccttcccgcctgcaccgcctgggtcctgttctccccttgttcagatggggttttactgtttttacagtccccagcctggacgctcccctgggagaagcaagcccctgctcaggggagccgagggtctcggtgctcctgtcacagaggagcacttgacactgcaaagaccaaatgcgggagaggccggggcagctctggccaggacacctggggcctcgccgggcacgtgctccatgatgctgatccggagtggagcaggccagtaccagactcctgccgggctcccaggctgagcaggagggagccggagcctggctgtctgcgggggggcgggggacttcctgctgcccctggccctggtgctcggtgtcctgggcctgagtcttggctcaccaagagcccgcacagccgagtgccggcccaaccgtgaccgctctgaggagaaggcggcagccacagggcaaggagctgctcgggtgccctaggacggcagtggtccctgcatgaacccaagcggggccacttgagtgccaagaggaagggagactaaagtgactggaacacaccaaatactcaaacactggtgagcctatgaagaaactgagaggaaaacacttctctctctgccaccatcggtgactctcatcccaacccctctccacggcgacacgcggtgaaggaggaagcacgcgacagagaaagttacacaggtgctcatcaaaggtggcttggggccagcgtggcctggatcacgggtgaccatgagggcgtctgctgatcttcctggggtgggggacatagcgcgcctctgcccttcgcctgccccggcttgttcctcctctagtgtaagaatgggcctcttcctgccccgctgacgcaggctcaggctgtgagacttgccttgacctgagaattcttaggagataatgacgtccccactgtcctctgggagatgctcgtgctgccgtagctgccactctggagtccagcctggacggggctggccgcagagggcttcacactcgcggctgagccaggagccgtttgctgtgtggcaggtgcggtgcgagctgaccaattactcggcgggggccggggggacaatgatgtgtgggttcctggtttactggagatgcatgctgaagtttctgagggtggagtgttgacattttactaatgtactttgaaatggatcagcaacaacagatatagcagttgatggaccaagcaaaggtgtccgaggccgacaatgtggagtctgggaggatgcggggtccgggttgcagcgcgtggagccttgttctgctgttctgttttcctctatgcttgaaatttttcttagttaaaaagaatcaggcgggatccccccaagagctgcagatgaatgttaagttttcctgagccacaggccctgcagtctgggctccacacagagcagggtttgtctcatttttccagcactggtccgagtgccccacgttcgagaccccacctaaggttcggctcaggcccacctgagctgctgttggaagaaggggctcagcccctggtgaagattggagcttccacctggtccccccgccaacctgcaccccctcccaggagatgccgtcccccactggggttcccagccagcatgccccgagaaatgctggctcggacacctttgaactcaccgaacatttctttgttgaacatttcagtggaactgaaaactcgcccgtctgagccaaaaatgagatatttccttctagatccttgtttatctaaaacataaaacaacccccaccacaatacacttctgcaacttttgtgtgttttgttttttttttggacagggtctggctctgttggccaggctggggtgcagtggcacctgctcgattcactgcaacccccctccacccacccccacctggggtccaagcgatcctcccacctcagcctctccactagctgggattacaggcatgcgccaccatatctggctaattgtattttttgtagagacggggtctcgccatgttgcccaggctggtcttgaacttctgggctcaagcgaccctcctgccttggcctcccaaagtgctgggattacaggcataagccaccacacccctccctcctgtaactttagcctgttacatgtgccgtggctacctgggccagggccgcctgccacctgcccagctcgggtgaccccaggggaaagagtcagtagagggcatctcaggagggctggacactagcttcctggaacatcccagccctcccgacttagacccgagagtgcacgccctcggccactaacccagaggagctgcgccgcggttctgcccagcattcaggaatatgttgagtgtatttttggaagtaaaatagcaaaacaggggcctgcgtgatcctcactgagaggccaagtgcatccttcccccatcatgttctgcgccaccatgcccgatcacaggctccacccaccaccacctccccttcgagagagaacgggcccctctgactcaccatcggcttgaaggtgacaagcacttcacaggacattccggctgacagggggccaggggggtcaaagctgcaggacgtgacccatagcacacgggggttagtgctgcggagggcagacgctcgcctcaccacccagagcacagtcaggctgggcctcctggcctcctccccatcccgggcctggccccctgcccagccgccttcaccccggggagtgctggatctgctgcattccctgctgccgccagtacctggcaggcagggggcgctccagtgtgtgcgaacgtttgtggagtgagggagttaatcactgaaggcgtgaggcaagtccccaggccaactgccaggaaatgggaccccatgggtcggagagggccacagttcccctgggcacaggtgccaggcctgggaccggggctctagggctttgataccaatatgggaccagggggctgtgggcaggagccaggaagagagctggaactgggagtcctgagacagctgggaccctcgggaccctctcagcccctttcagggaaagaaccacaaaaatagcccctactgcacaggccacttgagggagctggtctgtcttggcccagatcagggtgagggagcatctccccaaggaattcctgacgccaggctgatttcacaaggttggattttacctaatgtgcttggtttagaaatgcacaagctaaaattttaatgtaaaatgtgtccctggctggcaacattcccacggcaccagcagaagcaaacccaaagctcctccaattgggagggaaatgctttggtgccgactgcacagagcccgggatggagctgccggggagaggagcagaatccgagagggtggacgtgcgtgcctcacataaaccagcagcagagtgcagggccgagctccaaacccttcagatgacagaagcgtggagtggggatgttagaggacgtatagataaaatggttagagacagaaatagagaattccagacgtgagaaaagaacaagacactgtcaagaaatgcagactcatccaaaacagaacttggcatttttagaaatgagagacagggcagctgagtaagaaacttactgagcaatttcaaccgttgattagcagcactaaggggacaagtggtgaaccgagcagcacctagagcaccacccaatgcgaaaaagagacaagaaatttccaacccgacggggaggtttcaaaaggaggagcaggagggcagagccggagaatgaatgggggaggggcgatgcctggggagctggggctgagaagttcccaaaattgttcaaagatctgaatcttcagattcaacagcacagtgaggtctaagaaaaatcagcccacaccagacgcacagcagagctgcgggacattaaggatgagagaatctcagagcaagcaggcggaaagccaggtatcctccaaaaaaaccagcacctggaccgaggccacctcccactccagcaacaagaggcagagggcaggagagtggtggcctcaacctgttgagagaaaataaccgtccatgagaagttctcatcccagcgtggggaggaatgcctcggtggctgagagcacagcgaccacctaaacccacctctgcacgcgccctccagaaaccacatggatcaatgagagaaacaggcgggctgcagaaatcccatgccttcagcatgactagaggacacagaaccctccagacttaaaattaaccataaggtgaaaagtaaacaccaacctccagcatgcattctccatgcccgccttcacagagagctacgaaggtctgaaaaactgcagggaagagaggaaggagacgggaacaaagaccctaagactgacctaaaatcagctccccaaagagaacatcacagcctccacaagaaaataccaagtcccagtgagtcagtgctgatctcagggaggggccatcagagcccacgcgcccctgggggcagcctcaggaagatgcctcgtgggagaagaggaggcccctctggagcctgggcagcaaggggggaatgaggatcctgcccttgctgaccctcttttgagaagctgcacttcacaacgctcgcgggagtggaaactcctgaactgggaatccgaaagccatcctggacctacaaacctgtccacaaagagaaaactggcaggaagcaggaagtagaagagaaagaactttcttaaaaataaagtaagttaggctgggtgctgtggctcacgcctgtaatcctagcattttgggaggccgaggtgggcctcggatcacctgaggtcaggagttcatgaccagcctggccaacatggtgaaaccccgtctctactaaaatacaaaaaattaaccggacgtggtggcaggcgcctgttatccgagctactcaggaggctgaggcagaagaatcgcttgaacccaggaggcagaggttgcagggagccgagattgtgccactatactccagcctgggcaacaagagtgaaactccatctcaaaaaaaaaaaaaaaaaagtaagttactaaggagcagaagaaaagagaaacattgcagaaaacatggaaaaggccgtcagagggaaaaatgaagaaaaataaaataaaagagaaaagaagaaaatgggccaggcacaggggctcacacctgtaatcccagcacttggggaggctgaggcaggtggatcacttgagctcaggagtttgagaccagcctgggaaacacagtgaaaccctgtctctacaaaaaatagaaaaattagccgggcttggtggcacacagctgtggtcccagttactcaggaggctgattgaggcaggaggattgctggagcctgggaaattgaggctgcagtgaactgagatcgtgccactgcactccagtctgggtgacagagcaagaccctgtcaaaaacaaaacaaagaaaaggaaagcagaaagcattaaaggcaaccagaaggaaaacatcagacaccaaagaccagcaaggaggatccaaaacacaggtaagtggagtctgcaaggaagcaaatggaaacattgttacagagtgaaagcacggccttaattcagggaggcagtgctgaaatgaagacagctttcaccttgacactgaaaacactggctaattgccagggaaaacttatcagaatggtcaacatcaaaacataacaatacaaaaggaaactctgacaaggtgtggtggctcatgcctgtaataccagtactttgggaagccaaggcaggtggaccgcctgaggtcaggagttcgagaccagcctgggcaacatggtaaaacccggtctctactaaaaatataaaaattagccaggcgtagtggcaggtgcctgtaatcccagctactggggaggctgaggcaggagaatctcttgaatccaggaggtagaggttgcagtgagctgagaccgcgccatcgcacttgcactccagcctgggcgacagagcaagactccatctcaaaaaaaaaaaaaaaaaaaaaaaaaaaggcagcaaaacaaaacgaagaaaaacaaaaggaaacttgggcagccaggcaaagttccagccattcgtgaagggaaatgggctcggtctcggacgactttgacacaagaagacagaggagccccctctacaaaatcttcgtgaaaatcggacctgagggcttatgcccatatagagcctgttccagccgttctgaacatgaagggacctatgaacctcctgctgtccctgcaccgcgtccctccctgtctgagccgtcctcttactcaacgtggatgaagtcccggaggtgctcctccacgcccaccagcttgcagtagttgatcgtgtaggtggtgtttaccaacgtgatctttttcttgtacactttgccaatatcaaagtcctgggaaaggccgaggtagcagcttcagagcgggtcacagggggctgtgctgtgagcaccgaggcagctttgcctcaaggtaaccgctggtgagcatttgccaactagggagaggttcccagggaacaatttccaaggtttctcccagaatcgagaaggcccctggggtgcatgaaggacaggtctgggggtggaacctgtcacataagagccttcgccacttgaggcaggacagggccttgctggggcccgcaggtgggagtaagagaaaaggctcagacactgtgggttccaaggtgggtccctgactccatggatggacttgagctggggtcaaatacaggagcccacagcctgctctgtcttgcagagtttggcagaggcgtccaggcaccaacctcagcctcacatgttcccaccctgtccctgctacatccctgtcccgaggttcaggggacccccactgccccaagtggcacagggctttcggggccacggcacccccattgctcagactggcgtccagccctccatggggatggggccctctccctccacctcctggaagagaaggtccacacttgggcctgtgcctcctgaggaagcccccgggttttccagcgttaaaaagcgaaaggcaggccaggcgcagtggctcatgcctgcaatcccagcactttgggaggctgaggcgggcagatcgcctgaggtcaggagttcgagaccagcctggcctacatggtgaaaccccgtctctactaaaaatacaaaaattagccaggcgtggtggcaggcgcctgtaatccctgctactcgggaggctgaggcaggagaatcgcttgaacccaggaggcggaggttgcagtgacctgagattatgccgttgcactccagcctgggcgacagagtgagactccatctcaaaaaaaagcaaaaggtgtcaggggttgggctgcggcagggctcccctgctgtcctgtgctgctgcccgtcccgttcctggcccagctgcgggctcacctggaagtggaggagctccggtttgctgttgaaggggcgtccttggaactcacgcccccacaccacctgcttgtggaccaccctgctccgcagccgctccaccgtgcgctccaggatgtccttgtccatctttgtcccgcccacgggctttcggtccacgtcctccttgggcacctgggggtcacagagacagaggctggggctgttagcggctccacctgggcggcgccggtggcagctcggaggcgagggtagcggttagcagagcacggacagcccagccccaccggctgccaccagcgctggagctgggaagagccccatggcccggggagttgctctgagttgctcagaaaggccctggggaccgactgactttctgctccattgacaaggcagggacccctcacttccaaaaaagaggaaaccaggaaacaagagcagacagctccagattcaggtggatttctgggaaatgatgtggagggggaactttccagattgttaaatcaggacaagaggaaggttttgaaaggttctgcaggaagcagttttctcgagcgggcagtgtcagcacacactgggctttctcagatgaaaagccgcttccctggccaacaccagcaaccaggaagatcagaactggagtcctgaactgtcccttcagaagctgcttggactctgcgtgggtcctggctctgggctgtgggctgtccctgctggtgcccatgcccggcagccgggcagcctcctccctggcttcccggggtggggggggcacttggcaccctcctcttgtccagaggcagccttctcccttgggtgtccccagtgggcaggtggtggctctgcctggcctgtcttgttcaccaccctggtcagcccggcatccccagaaccagcagaaccaggtggcttttgccctgacagtagaggtggccaatgcttacagaaaccgggcggcgggcattgccctcccacgtgggacagggccacagcctgagccacactgctgcagagaccgtgtcttgctgtaactgctctttcagaggcagaaggaccccagcgccagatggggcatgtttcttacaaaaggccgtcaaagaaagtttgcacgcttcttctagaaagatgcttctccaatagtacacggagtagctcagagtcattccctcagcctttcagctttggagccccaccgtccctccccgttacaccatggtgaccgagctgtctgtcagggggagcttggggtcgtcgagcacgcgtggtgccctccaggctccgcgaagagggaaaggcatgagtgtggagagggaggcggggggcgtccacacacaggagagggtggcgggagatggcaggcacagccaggagaagcctcagagcagctggtgtggccggggcaggcgtgggaggtggcgagccggcgacagagggccggggtccgtctgcaagcgtctaaaggagcaggagctgatacctggtatggcttgtagtcttcattccaaagcccagagatctcgggctcagctaacgtttcctcctctgagctggccccggggtccccctggataagctcactggaaacgacttccagcaaccgagagggcccggggcctgcagcagcctcgtagtcctgcagtcggggagaggaacatcgcaaagacacgctcatgacagagaacagggaagagaaactcggcccagcccccgccggtatggcccgctgcctgcccccgttcttctgcctcacgtactctgcatggagatagcggtgcacacggttttgtaactttttctacttgaaatataagtattttaatacattattaaatatttttctacaatgctcagaagagtctgcaaaatatttcctttgataggaaaatgttctaattcacggactggcatccttggcgccgatcctcaggcactcatctgttctcatttttttttttttttttgagacgcagtcttgcactgtcacctgggctagagtgtagcagcgcgatctcagctcactgcaacttctatctcccgggttcacatgattctcctgcctcagcctcccgagtagctgggattgcaggcgcccgccaccacacccagctaattttttgtatttttagtagagatggggtttcactatgttggccaggctggtctcgaactcttgatctcatgatccactcaccctagcctcccaaagtactgggattacaggtgtgagccaccgcgcctggcgcagttctcatttctgtggatataagccatgcccgggaaaagccccaggctgaccccaggaggatggctgtggtggtttcctcagaatgagtttggggacggagccttgcctatctgctctggctctgtcccaggcctgctggagaagggggaactgggccgggtagacagggttcttcttcctggggaccgtcctatggagcgacagacaggaagtctggacggggccagcgcattgctgttactgtgacctgtatagtgccacaggtggtgccacagaaaatcgcagggagcagctcacgggtgggggtgggggcaggggaggcttctctggagcaaggaggcgcagcagggtgctcctggcggagggatcggcgggtgcaaaggccccggcgtgagacgggcagtgaggggtggatggggcaaaggctcagcccaggcactgggagcctgggtagcaggaaaggaccttctctggtgccctgaagggcaccgcagagaccctgtggaggccaaagctgaggcagcccaaggctttctctttcccagcagggcatcggttgcagcagtgaccttgaccttcaggttttggggtacacaagggcagagactgcagcactgtgccagactcaggagaggaccatcgtccctaccccacacctttagggaaaggtaaactagaaatacattcccccaactgaagccagttgcctgcagcagcagtggacaccaagcaggccctggatgtgagtgagtgagtgaatgagtaagtgagtgaataagtgaatgtgtgagtgaatgaatgaatgagtgaatcagtgagtgagtgaatgagtgaatgagtaaagaatgaatgagtgaatgagtgagcgaatgagtgaatgaatgagtgaatgagtgaatgaataagtgtatcagtgagtgagtgaatgaatgagtgaatgagtaaagagtgaatgagtgaatgaatgagtgaatgaatgaagaatgagtgagtgaatgaatgaagaaagaatgagtgagtgaacgaataaaggatgagtgagtgaatgaatgagtgataggaaagctgtcctctaggtgctatcaggagtgctttgtagcagggtgatcccaggcatgtggtctgaacggctgtgcacatctccctggcaggcggctgacccagctctacagggccaggcaaggtggtcccagcctggtgggcagcaacactgctgggggtgacgcagggtctggtgggcacaccgagaccaggaggacactggacccttgctggggatgctgcggccatgggcctctctcatgtggtgggtccgtagtgtgtcttgtccccttgtccttgagctgagtggcggccactcagcgggctcagcaaccccctgcaggtggccatggtgctgaggtcctcagaggatgtctcaccacacctgagccctgaggccccacctgccctccacaggtgtgcggcttctgtctacaggaaggcgttttgctcaccagtgtgtacgtgttggttgggactgtggtcttcttgcaaaagtcagaaatgtagttccaggtcttgtccctcagggtcagccggtgcctggcactggtggggggatgctgtttcttcctcttttcctcctcagcctcctctttcagaatccgactgatgatctcctgctttctgagcttctgctcctcctcaaaggccctgcgtggagtcgcttctcagatgagtgcaagaggtcccctgcctccaccttgccccagatgagacagtgcccggcggcccctccctagcgccctcctgggggctccggtcctgcccagcagccccaggtgagacagcgcctggcggcccctccctagctccctcctggggactccatcctacccagcagggctcttggggtgggaacttcctggtcctggagctaaacgcaagctccagtgggaagcagatgggcagaggccaagccagaggttccaggcttaaaccccagccctgccctgcccagtccatccctgccaagcccagtcctgctcagtcctgcccagccctgcccagccctgcccagcccagcctagccctgcccagccctgccctgcccaacccagccctgcccagccctgcccaacccagccctgccctgccctgcccagcccaggccttcccagcccagccctgcactgcccagccctgccttgcccagccctgccctgcccagcccagcccagaccttcccagtccagccctgccaagcccagccttgcccagcttagccctgccctgcccagcccagcccatcccttccaagtccagtcctgcccagccctgcccagcccagccctgcccggcccagccctgcccacttcgcagcccagtcccccagcagccttggctgcccggagggcttcttccaagcccttatttctaggctggcgtggggctgccactgagagtagcaccagggctaaagatgttcatccactcactgcagctgcacttcccgggtgcctcctacatgccaggcctgcgccaggctaagggatgtataggcggtggagctgctgccaggacccccccgcccaggtgggcaggctgatgggtggtggagaactctgatcgtgactcaggggggtggggaggacgcactcagggctctgtggcacccagaggaggatgccttgcccagtgagagggccaggagcccccgcccaggcagatcctaagcagtgattggccagggccgtggacagggagactgggatggggagaaagggccaggctcccgggatgagggcagcttcgggcaaaacccaggacagggtggtttgcgtggaggtcactggggagcgttacgggcagggctgggaaaggcgagactgagcgggagagaggggccttgtaggaacctggccccgaggtctggatctcaggaagcccagtggggcccgtgggtggggggtccgagagggcaacatgggcccccgtttggagaagaacagagagtgaagccagaagcaacgtgttcaccacggacccaagctggcaggaggtggtctgaggggccaggagggccccaaggccgtggcagcaggaagccaggtggacggccctggacagggagtgagcaagggcaggcccagcagcaccaggttccctggaggggcctggtgctccctggagacttctgggtgggccaggaaagagcccgccagtccctccttgtgagaagtcaggacaggagccggaggctctcgacaggggccggggtttcagcgtctgggaggggagaaggggccgagggttgggcgtggactggagtaggggcagggctgggcaggctgagtcaggcccaggcagggcaagggtagcagcctggagcccctgttcccgtgccccacagccgcctgagtgggcgccctgggagagagagcagctttgctcaatgtgaagccgaacccccttggctctccctgcacccactgactgggcgggtgcctcccggtggcacctctgccaccaccctcacctcttctgggcctccagctcctggcgccggcgctggtggacaaggtgcctgaatgcatccctgccctgggccagaatcgccttcttctcagcctggaccctctgctccgccagctctgccttggcacggtcccatgcttggaacttccgcagtgtgtccttggaaacagagagcactgagatgacagcagcagcacccacgggcacatgcacacgctcacacctgcacatgtgcacacacaggttcatacatgcacacgtgcacacacgtgcacacacacatgcacacctgcacatgcacacatcacacatgcacacctgcacacacgtgcacacacacacgcacacctgcacatgcacacatcacacatgcacacctgcacacacgtgcacacacatgctcacacacgcacacctgcacacactcatacatgcacacctgcacacgtgtgcacacacatgctcacacgtgcacacacatgctcgcacatgcacacctggacacacatgcacacctgcacacacgtgcacagacgtgcttacatgcacacctgcacacatacgcgtgcacgcctgcacacacatgcacacactcacgcatgcacacacatgcaaacctgcacacacgtgcacatacacgctcacacatgcacacctgcagacacttgcacacctgcacacacgtgcacacacatgcacacctgcacacacacggtcacacatgcacacacgtgcacacacggtcacacatgcacacatgcacacacacatgcaaacgtgcacacacacatgctcacacactgggccgttgaacagatgtccttaaaccaatgttgacgcctgcagatcctgtgagagaccactggcaaactgtccgcacatcccaagcgtggggctgggtgtccctgcacgtcacctgcccgcctctgctcctcacctctgagcctttgcagatgctgttcccactcttccctccattttcccagcctgaatccccagccttggccccagggcatggcctcgaggcacccaggccctccatgtgtctcatgaggacgccactgcttccccaacaagaccaggccccatgggagcagggctggggtgcctgctcctgcctgactccagtgcctggccctgacccacacggaacccgtgggcaaatctgtggcacaggctcgggaagcctccaggggtcaccaagtgcgcgggtcagccctggacgccagaggacacgggcctggctcccaaggagcaggggcccagggacggaccccggcagggcgccaagggagaggctgggtggggctgcgggggcctacccggttcgcggagatgctgcccttcagcgccaccaccgcatccatgcgtcgcctcatgtactcgtggcactccatctcctccttcttctcttgctctcggattctgaggaaggacatttaaacatttttgaggctctgtcgcccaggctggtgtgcagtggtgcgatcacagctctctgcagcctcgacctcccaggctcaagtgatcctcctgtctcagcctcccaaagcgctgggatcacaggcatgcaccaccacaaacggccacatttttaaccgaggaagtgacacagcgatgccgtgtggggtgttaattacaggagcctcggtgctatcatttccaccaggaatgtgattaatggtgagaacacaagaggtgggatgggcaaaaggtgctggcgcagaggccgggccatgacgacatggtgggaacatgccctggagggccaggccacgaggacatggcgggaacacgcccagcgcatctcaagggcctcttctgaaaagaaacagtacctcagcactaaaaatacacacttattggtttttgatgataaggtggtgattcaataataaaatcaggaggctgggtgcagtggctcacgcctgtaatcccggcactttgggaggctgaggcgggcagatcacctgaggtcaggagttcaagaccagcctggtcaacatggtgaaaccccatctctactaaaaatacaaaaattagccgggcatggtggcgcgtgcctgtaatcccagctactcaggaggctcaggcaggagaatcgcttgaacccgggaggcggagcagtgagccgagatcgcgccacggcaccccagcctgggcgacagagcaaggctccatcttaaataaataaataataaaatcagggcatttcaagacaaaagcaagtgacccgtattcttgggtttctccttaaggacgtcgaagggaggccctaccttcccagggaggccttcaggaaccgcacggcaaccttgtggttcttccgggcgtcctccagcagcttctggtgcctgagcccgagctccttctgggtgttcagggacttcctgtggggatatggggccgtcagagggaaactcggcatcacacgtcccatctgcccccaagccctgcacggctggagctcgtgtcccagagacgccgtgggccctttcgctcagctctgtcccgcacagcctcccttggggaggagcgagggtccctggagagctgatgccgtgggccacacagatgtcaaactctccacgctactggggctccagtgccagggagccaccaaaggcaaggtttgatcccagctgggcaggggtctgggaagaggacggtgcaggcacagcagtgctgtggggagggaggaggcaggggctggggaccttgtgtctgcagccagggcctggattccacaggggtttgtggcctgggcagctgaagggaaggaatgagatgggggaggggatggaggccagaagggggtcccgaggagagaggctcacggcaggttgggacagctggcctgatggcctgtggagcacttggggactggcctagtaggtggccgggccctggctgagcaggagactcatgacagaagacgtgtggggaatgggcctgagtgctccacagccacgcaggtgggggccgtgggaggggtgcaaaggagcagccagaggtggggatggagcccagagaatggcctggctgggaagaggaaggggctgccggagggaaaggggaggggcagtcttgctggagcgtggctttagtagccagctttagcggctgtatggtggctgcggcatcttgggagggctggggctctgggcaggtgcaggggagtgcctgacacttgggaaggactcaagggcccggtggaggagcaagctgggaggaggcagggaggggtggaggtggatctggacagatgtggagggcgaggctgaatctggagacccctgggggagagggcggaggggctggcagaagctgctgggaagggatggaggtgggcctgggtgtcgcctacctgatcctcagcagtcggttccgctccaccttccccagggcctcctgctctctgcagagctgctcggctgcgcgcacctggagccgccgccccgtggcctccacctcctcacggtcagctgtccggaaggcctcgagtcgcccctcctggatctcgatgtgccacatggtgttccttcaaacaagaggcaaagcagctggagacgggccccacagtcatcctggggtgggggtttcggcattgagttctgacaaatcctccaggcagatgttgaacaccccagatgggttagctccctcctctaggggccatctccgctctgagtcacccagacactgaggcccgccctgcctgcctccaacctcaggaaaatcactatgggttcaatccagcccggctagagcctggcctgcactcccgcgtgccacctgccggcctgaggctgtgtccgttggctgcggtgggcctggggcaggccctgcccagcctgaggaaggccttcaggaagggacagccgtgactctttggctgggctggaggatccctggtgcaaattgaccggcacccaagaccacccctcagtcttcaaatgtgcctggggtgggggctatggagcgtggagtcagccagccctgcccggggccacatgtcctggatgacaggggacctgcctgacccctggtcttgggcgaatttgtcctcgactgtgagtgtggcgtctgtggtggccccagatgacacagtgccccttggttcttggcacaactcagggaaatttccggtgaatctttagttggaggagtgcgtgtgctgtggaggctcaggctgggaaagttccttctgaggatgtggacagtgtccttctaacagcggccaggtgagagccgctggagaggcggcctggaaagagacacctggtggagggatgcaaggagccgctcctggagactgcgaacggttccacccagagatgcggctcaggccggggctggccacgcgaggatcagaaccctggacaaggtcagacgcaggcgttgagccggcatcctcactgcattgctgacattccacgtgacgtgtgccacagctctgtcctagacacccgcgatcatgttcatttccacttcgtctttcgttaaaagcttttcctgtggagccgagtccagtctctctccccactgcaacacccggggcaggggtcccaccgccttggccctccgtgaataaagtctgctttacatctttttgaaaaaatcatgaacatatgttgaattgagatactcaatggttttctcttttaacgtgttaatgtcaaggatttctaacgttgagcctttttcggggctcctaggatataaactccaacttggcaagggaggtgtgtctgcgtgtctcacacgtggctggatttcaatgttgaatgtttgatttggggttttctgatttgcctcctgagatcgggttctactttccctctctcgtacgcccacttggttttggcatcgaggttgtgtcactgcattttagaaactgggcataccatgttctttgttggggtaattttaaacagagggctcctttccagggagcatgggtcacttcggatctctggctggtgtcctgtcatgcagcacgttcattgctccccaagtctgggggactccgcggagcttccacgggcgggttatttctattcctccctcgcgtgactcatgaaattctttaatctgaggattcatgctcccatcaattctggaaaacgctcagtcattgttctgctggctgtcacttcccctgcccggtgatcagtgctccagtggccgtgggagctaacagcctgcagggtctcttagtaaagaggcaagacgctgtcccagatgctgtcgtcgcccattcctgctgctgtaggaaaacacccacgaccgggtcttcgcaaacaacagaatttcattcctcagttctggaggccgggaagtccaaggtcaaggtgccagcagcttcgatggcctatgaaagcctgttcctcaaaggcagtgcctgtctgtgtcctcacgtggcagagggacagaaaggctccctcaagcccttttacgaggcactaatcgcccccacgagggcagggcccccatggccgaatctcccagagaccccacctcttcctgccgtcacctccagggcggatttggtttggacgcgtgtcccccgcaggtctcgtgttgaaccggagcccccagtgttggaggtgggcctggtgggaggtgttggggtcgtggggcggctccctcatgaacgggtgggccgtctccttggtgacgagtgagttcacggaagatctggatctttgaaaatgtgtggcacctccaccctcttgcttcccctctcaccatgggagacacggctccttccccttccactgtgattggaggcttccagaggcttcccgaggcgccccgagaagcagatgccatcacgttccctgtacagcctgcagaaccctgaccaatcaaacctcttttcttcttatttttatttcttttaaaatgagtcttgctctctccgccagtctggagtgcagcggcatgatttcagctcactgcaaactccacctcccgggttcaagcaattctcccgcctcagcctcttgaatagctgggattacaggcatgcaccaccacgcccagctagtttttgtatttttagtagagacggggtttcaccatgttggccgggctggtctcaaactcctgacctcaggtgatctgcccaccttggcctcccaaagtgctgggattacaggtgtgagtcactgtgtctggcccaaacctcttttcttttttttttgagacagtctcgctctgttgcccaggctggagtacagtggtgcggtctcagctcactgcaagctccgcctcccgagttcacgccattctcctgcctcagcttcctgagtagctgggactacaggtgcctgccaccatgcccggctaattttttgtattttttttagtagagacggggtttcaccgtgttagccaggatggtctcaatctcctgacctcatgatccacccaccttggcttcccaaggtgctgggattacagatgtgagccacctcgcccagccacctcttttctttatatgacccagtgtcaggcatttctttatagtgacacaaagactgacgaacaatagcgttgagttccagcagaccaatttcaggggcactggccttcagaccacagcagaggctgattgggaaagattgggattttgagaatgggagggaggacatttgagggtatctgcacacatctgagcgagtgccccaaaccgccaagcccctctgcatatccgtccacagggaagcagccttcccctccctcgaaggcaggctctgctgcctgggggccccgtaacacctccctgaggggctgccagagctcctcatgacccccttgccatcctctctggcccagatgctcccaggggcaagaacaaagtctgaactgaactgagaggagaaggatcccagaggagaagaatgtagccaatctacacagcaggacgtgggggaaggtgtgtgggaatgaattccaaccctgccagaccgcagagggaagagcctgtccgaggctggcctgggcatctgatgtggacatgccaccagctcacccacccactgcaggcggctcccatcacaaactcagctgatcgaggaaacctggacccaagagagacctacactgcagaaagctagatgccagaaagtcatgcagaaggaatccaaatgtttggagagacaacccgttggaaagtttgttgttgctgttgttgagatggtgtctcgctctgtggcccaggctggagtgcagtggcgcagtctcagctcactgcatccttgacctcctgggcttgcttaatcaatcctcccacctcagcctgtaatcttgagtagctgggattacaggtgcacgccaccacacccagctaagtttggtattttttgtacagatggggtttcaccatgttcccaggctgatctcaaactccggggctcaagcgatctgcccaccttggcctcccaaagtgttgggattacaggcgtgagccactgcatccagctgttggtgagtgtgacagtgagtgtgaccacatatagaagacatgttcttcattatggctccagtgaggagagtcctgtgccctttgaaagcaccgaggggcactccggactgcgcgggggcctggcagggatgttgcctttgaggggctccctgttgccttggggcgatgctggacctgggaggggtggtggagccctggggtgctgctaggcctgggagggagccgggctggttcctcggtgggcagcagggcagcgtgtctcagcggggatgggtggaaggggtttggggcggtggttaattgattttggggtccctagggctgaagtagatggggaccccactcaagtccagtttatctgaagagccagtgtggtcagtcgcagaggtgatgatgaaggttggaggctggacagatgggacctggctggttttgaagatggaggaggaacgcaggcagctttggagctggaaaaggcgaggacatggattctcctcggaggcttccgtggggaaccagccctgcccacaccttgactttagcccagtgggacccgtgttgggccaatgacctctagaactgcaagctcataaatccgcgtcctgctgagctgttaggtttgtggatttgtcactgcagcgatgggatacgggtgcagtcagggaagcctcagagcaggccgggacacagcaccagcgccctgccgtgggtcccatgtggccaagcggggtgcacacaaagcctcttcttcgtgctgagctgggcgtgggaaggcatcatgtgacgaggctgcacagaacacgtgtgtcgtgctgagctgggcgtgggaaggcgtcacgtgacgaggctgcacagaacacgtgtgtcgtgctgagctgggcgtgggaaggcgtcatgtgacgaggctgcacagaacatgcgtgtggtactgagctgggcgtgggaaggtgtcacgtgacaaggctgcacagaacatgtgtgtggtactgagctgggcgtgggaaggcatcatgtgacaaggctgcacagaacacgtgtgtcgtgctgagctgggcgtgggaaggcgtcatgtgacgaggctgcacagaacacgtgtgtcgtgctgagctgggcgtgggaaggcgtcatgtgacgaggctgcacagaacacgtgtgtcgtgctgagctgggcgtgggaaggcatcatgtgacaaggctgcacagaacatgcgtgtggtactgagctgggcgtgggaaggcgtcacgtgacaaggctgtgcagaacacgcgtgtggtactgagctgggcgtgggaaggcgtcacgtgatgaagctgcacagaacacgcgtgtggtactgagctgggcgtgggaaggcgtcacgtgacgaagctgcgcagaacacgcgtgtggtactgagctgggcgtgggaaggtgtcacgtgacgaggctgcgcagaacatgcgtgtggtactgagctgggtgtgggaaggcatcacgtgacgaggctgcgcagaacacgtgtgtcgtgctgagctgggcgtgggaaggtgtcgcgtgacgaggctgcgcagaacacgcatgtcatgctgagctgggtgtgggaaggcgtcacgtgacgaggctgtgcagaacacgcgtgtggtactgacctgggtgtgggaaggcgtcacatgacgaagctgcgcagaacacgcgtgtggtactgacctgggtgtgggaaggcgtcacatgacgaagctgcgcagaacacacgtgtcgtgctgagctgggcatgggaaggtgtcacgtgacgaggctgcgcagaacacgcgtgtgatcgctcacggcctgcctcccaccaccgaagcagcctccaccaggcagggctctgctgcttcattcatgggagaggcccaaaggcttcggacggcgtctggcacgcagtgggcaccctcttaccgcgtggggaggacgggtgaacgagagtgtatctaagccaccggcacagatcgcagtgggcgccctcttaccgcgtggggaggacgggtgaacgagagactgtatctaagccaccggcacagatcgcagtgggcgccctcttaccgcgtggggaggacgggtgaacgagagactgtatctaagccaccggcacagatcgcagtgggcgccctcttaccgcgtggggaggacgggtgaacgagagactgtatctaagccaccggcacagatcgcagtgggcgccctcttaccgcgtggggaggacgggtgaacgagagactgtatctaagccaccggcacagatcgcagtgggcgccctcttaccgtgtggggaggacgggtgaacgagagactgtatctaagccaccggcacagatcgcagtgggcgcctcacagcagcccccgggcacagggatgggacctgcgcaggcgctgaggaccgggaggtggtgtgagcgggcagggtcgtctctagggccttctttgggggttcctgggacctgctggccaggaaatgcccgtgagtccacagacgcttctgccagcccatggccccttgcgtgcagagatgctggtcctgggagagctgcgggtgagacacatgcagcatcccgtctccaagatgattccaaggaccctcggctgttcatgcctgaagcccctccacggggtctctctcgggctggcctgaacaccccaagcccaaccccctgcccagaccacgaccctcagaaaccgagaccctcagaaaccgagaccatcacgcctgctgccttaggcggctaagggctggggcggcctgttctgtggctgcggatgacgcgcatggtgtggcagcagggacacgtgctggggaaggttcaggtgctgtttccagaacgcggtttgggtcccgaagcagcggccagcctcgtggccgccacctgtcccagagccacaacggaggcctcccgggaccgacgctggaagcggggaccacgctctccaagctgcccctcgcacacacccgtgctatttcgtttctgtgctctctccgttgggctctaccgctggaagcccccgttccagagggaggaggccttgcagagaccctgcaacaatcccactgagtggaagctgaagctgcacccagccgtccagtgcccctgtgcccgcagtgcccagagacgacaaaaggagtcaccacattggccacggagaccttgactgcgagagggagggggcgctgcctccaacgggacccagcgggaaagcgcctggaacccggggaccctcgggggctggcacagccagccgcggacagacacgggggcacgcaggacacccagccgcggacagacacgggggcacgcaggacacccagccgcggtcacacgcgggggcacgcaggacacccaaccacggacagacatgggggcacgcaggacacacagccgcggacagacacggggggcacacaggacacccagccgtggacagacacggggacacgcaggacacacagccgcggacagacacgggggcacgcaggacacacagccgcggacagacacaggggcacgcaggacacccagccgcggacagacacgggggcacgcaggacacccagccgcggacagacacgggggcacgcaggacacccagccgcggtcacacgcgggggcacgcaggacacccagccgcggtcacacgcgggggcacgcaggacacccaaccgcggacagacacgggggcacgcaggacacccagccgcggacagacacgggggcacgcaggacacacagccgcggacagacacgggggcacgcaggacacacagccgcggacagacacgggggcacgcaggacacacagccgcggacagacacggggggcacgcaggacacccagccgtggacagacacggggacacgcaggacacccagccgtggtcacatgcggggacacgcaggacacccagccgtggtcacatgcggggacacgcaggacacccagccacggacagacacggtgacacacaggacacccagccacggacagacacggggacacacaggacacccagccacggacagacacggggacacgcaggacacccagccgtggtcacacgcggggacacgcaggacacccagccgtggtcacacgcggggacacgcaggacacccagccgtggtcacacgcggggacacgcaggacacccagccgtggtcacacgcggggacacgcaggacacccagccgtggtcacacgcggggacatgcaggagtcccagctgtggtcacacgcagggacatgcaggacaccccgccagggacagacacggggacacgcatatgcatgagccccatgcctcaggctgtgcccaggagctccatcggagcaccctgcaaacatctgctggagtgaagtcctagaaaatttaacactgggtggagagcagaccagaggttgcctggtggggtggggctacccactgaagatatgcagggaacgttccagatgctttgtactgcatgcaaattagacccagataaagctgacttaaaggaaagtccacgggcagtccggcagcagccgggcccacaggaggagggcggcaggtgggctccgggcgctcggggccgcctgcgggtagggatggggcaactacctgcccgaaatgagggtggtgggaggcagggttcacaccatcagagaagggggtgaaatagacctgtggctttggttgcaattggaattacagatgtgaacgggtggttttcaatacaggcaggcagagctgcgtgcgtttcccacctctgtctactgacggttaagggtctgggtccaggcaagggcagggaagaagaagggaacctgagcctctcactgtgcccgaaaacgcccacagagcggcagacacgaacgcaggatgcggaaggatgccaccgccaaacgcaaggcggctggagcacccagaccaatcctgatgggccggatcatacccgcagggacacagcacccccagcctacacggagagcgatcacggagggggaacgctcccctaacggtggaaagccaactaataggaagggatggtgcaactggaaactcaccccttagaagccatcacagcaggaatgaattctggcaagaaacacggagggatgccagcgctcgtgtgaaaggggacacggagcgggatttcccagcctcaaagcttctgcccacaagctacgcatcagtttccaagggaacggtgtcgctgcactgaagaagccagcggccccacagtggggctggcagccatcacgtgtcccatgagaggacacccgagggactggtcatcacccccaggggcatcgagcacgggcgctgtgcgggacagcccctggcctgcaatcctcagaaccgcaacgtccgcctgtcacagaagaaccgaggctccttctgactgggggaggcgaggggccaccctcgacacaacgccacatgggcttcaggcacggctctgggatgcggggccgaggggcacagggggtcttgctgccattctgcagctcttctgtaagttcggaattgtttcaaaataaaactttatttatttatttatttttgagacggagtctcgctctgtcgcccaggctggagtgcagtgacgcaatcttggctcactgcaagctccgcctcccgggctcacgccattctcctgcctcagccttccgagtagctgggactacaggcgcctgccagcacgcccggctaattttttgtatttttagtagagatgggggtttcaccgtgttagccaggatggtctcgatctcctgaccttgtgatccacccgcctcggcctcccaaagtgctgggatgacaggcgtgagccaccgcgcccagccattttttttttttttaaaagacagagtcttgctcactctgtcgcccaggctggagtgtggcagtggcgcaatcttggctcactgcaacctctacctctgggctccagcgattctcctgcctcagcctcccgagtagctgggattacaggcatgcaccaccacgcccagttaatttttgtatttttagtagagacagggtttcgctatgttgcctgggctggtcttgaactcctgacctcaggtgatccaccagcctgggcctcccaaagtgttgggattataggcatgagccactgggcccagcccaaaaactttttttttttttttttttaaagaagtggacaatcacatcaacctagtaaagtgaggccttctggggttcattagccctgtgaagcccctcaccctggcgcaggtgctgctgagcagtgagaggggcatgacagagccagttgtcaaaggagtgtcgcaggggacagtgttctccacgctcagccacagctgggttcagcgtcctgtcctcccctgcacccctcccactgcccacacaggtggggccacagtgcagggcactggacaccagcttgggtcgtgactgtatcacagcgagcgtgggtcagagactgggccagaaactacgtcacagcaagtgtgggtcagagactgggtcgtgactacatcacagtgagtgcaggtcagagactgggtcaaagctcagtggtgtcttcagtggagtgaggctgagatgttaggttgcatgagggctggcggcatgggcactcttaggggtggggtggcctgaggcctgcactcagccctctctgtgcctcctgccctgcccaggctggaaagcttaggtcatcccgggcacgtgcagggtcagtgctgtggatgtcatggacctggctgcagctcccggggctgggggctgtgtggttcgggagtcctacttgaggtcagctcagggtcccctcagtcgccctgagaaattcgtgcaccttcccaaaccccttcttgccaaactcgccgaaggcaactcgacgcatccaacccaactccacaggaaagcatttaggacgaggcagctgtctctctcctgggctttgaaaacccagctcgctgttctgtggaagcacaaagcatgagaaacgaggaaagaggaaaaagaacctgattttggagttcctaggaacataaacaaacccagagaaactgaaaaaggcaacgtgaagactaacccttccaaccactgcattcaccgagtcccctttccacttccccgcagtttgccggtcaggtgcaaaaccccccagatcttgctctctgcccccagatgggaaggactcgcaccgttctggggcctgcctgctgccagtcccggctgcacaccgactcactcgctctccttcagcacggcctcagtcctcgactgcaggtctctctcgttctccagctctgcaaacaggcgtctggacacggcctggaggcggcccacagcggccctgcagtggtgaacggacaggccgggcgtgtgtcaggcctcagtcatccaggggccatccaggttcacctggcactccctggcctcctctcgctcaggagggaaatctcggcactgggccacctagccaatggagcgtggggctggcgggaggctctccacatgcccctttccgctgggcaggcagtgcccacatggcacagccccagggggagtgagggcttggggagcctgccctggaccctcagtggcccctgcatgaagcccctgggggcagcagccatccaggcctgtgacccgggaaggacccagcacgtgcgacaagccccaagccctcgcgtcagggcgccctgggtcccctccctccctcctgttcccctcctgggcatcatccaccccagcacacatccagtgccagcccagccacgttcctagagaccacttcccgggcggtgggcggttgcccacgagagcggcacagtgtgatgctggccagaggtcccggccatgtggacacgggtggtgggctttgagcagctggccgggtatggcagtcacccctagatcctgggtgccacagtccaggaatgaggcaggtcaaaaccctgcagagggctgggtgcggtggctcacgcctgtaattccagcaatttgggaggccgaggcgggtggatcacaaggtcaggagttcaagaccagcctggccaagatggtgaaaccctgtctctactaaaaatacaaaaaaaaattagccaggtgtggtggcacatgcctgtaatcccagctactccggaggctgcagcagagaattgcttaaacctggaggggcagaggttgcagtggcccgaagcccctcaccccccagggccgggaggacctgctggttcccttgcccctggctgctggccctctgctccccatggctgcactagcccctccaggtcgggcaccctgctggggccttccagggctgggctgaactcggcaggccctgcaggcacctggtgcccccagagggtgaggcgaggccagagctgcagccgtggagccatccaggctcccggagcaatgcctgttggtgagtgttggcgtttccagcgtcccccaggcccctcccacctgggagtgtgggacgcatgcaggcctctcacctctcacctcgccctcagctgcctcaccctgctgctccaggcaagagtggcccaagaggccttcccctgactgctgacccactcggccttgcctcccagagatccagccccagtgccctccaggccccagcagtgccgacctcacatgcttctgcatgttcgtgttgtggcctcacactggggctcctcattggcctgaacacagcaggtgcttcacgcctcactttgggtgaaccagtgaacctccggccctgacctcatgcccggttccctgccccctggcgagggccacctacatgttgcccgcctcttcctctgtggcgatctcggctgccacagcctcctgctgcttgtcgatcaggtcccgcctctgccgacaggcgcgcagctcccctctggaacagggaaacaaaggtcagatgatggttccctgaaactccagcctccaaagtgacagtgggcgtggcaatggggccaggtgaggcagagccagacccccagagcccccctcacccgggccaggggtctctctaacaccttcaagccacacaagcagggtcttgtcgtccatttttggaaaactgcccaggggcagctgtgtggcccccacccgaaggtgacatgctccccagggccgaggacggtgcaggagcgggagggaacctgggtctgcataaacaagcgcactcctgcgtgtgaagggcacgtggtgggaggtctggggcccacgggaggggaggagctggagctcctccaccatcttccagagagcgggccaggcaggcccaggtcaccagtggggcatgggccgggacagaatccagttcacatggtagctcctgggggcgactcaggcctcaggtacaaacaacggagcaaagcccagagcatgaactctggaggtcgcttttttttttcccgagacagagcctcgcttgtcacccaggctggagtgcagtggcgcgatctcggctcactgcaacctccgccccccaggttcaagcgattctgctgtctcagcctcccaagtggctgggactacaggcgcccaccaccacgcacagctaatttttgtatttttagtagagacggggtttcaccatattggccaggctggtctcaaactcctgacctcgtgatccacccaccttggcctcccaaagtgctgggattacaggtgtgagccaccgcgcccggccatgacggtcacttggaaaacacacgggcgctgccggagccgaggagggaaatcgtagtttccccgggtgaagtacccaagttaggtgcccgagttatgggcaagaagttatgcagaagaacatttgtctttcagttttttatttttagagacagggtcttgctctgtcacccaggcttgctgcagccttgacctcctgggctcaagccatcctctggcctcagcctcccaagtcactgggaccacaggcgtgcgccaccactctccgctgaatgtttttagtttttaggagacgctgaaatatttaggagtgacgtatcatgtctgtgatttgctttaacataatttagcacaaaatcccatagatataaaatacaaacacacacaaacacagaaagaagctacaacgaaagcttgacaggtggcaactctgggtggcgctgggggcagcggggccacttgtttccgccttttctgtgggaagggggctgggagcgctgggcactagctcccgggtggggcttgcagaactgctcctccatggagaccctgtgcgaccctcccttgcaggccctcagggtgacgacaggtacaggaccacccctgctgcacccatgtcacggcctggggggcatcaagaggtgcaggtgcagcggcctcagccccagctcacctcatcttctcagtgaaaagctcttgctcctcatgcatcttatccagggcgctcaggttctgccgcaggtgaaatgcctgcgttctgtcctcagctgttttcttcttcaatttatcagcatcagtatctagttctttcactgagcttaggatgaaaaggacgtcagctgccaccaccccagctgcaggctcagaactcattcctcggtgtggctgccggggtaggtgcctgacagttctgcttcagggcgggagctgcgggagctacagcctgtgggagggaggaagcagccgccccgctcccttcacccacccccccacccccacccccacccccacccccccacacccacctccacccccgatcctccgagttacctgctgtgtcccgggtccacgtcatcctcagcttcctgtagaagacatttgatgtcaaactccggatcctctaattcatctctttctagaaatcaaggcaagagtttaaaaaaaaaaaaaagcagatcaaacatttgcatctgaagttttaggataaatctttttctttttttgggacagggtgtaaggaacctgctgcactgcagccacacaagcacaggcagaggtaaacagcctgggtgactcagtgggactggggcgctggcgccttgagagagagagagagagtcagggacatccgtctttgcagacggacagcggggagcaagggcacagcaccgcttggctggtgtccagagaaagagttaagctgctgaccctgaagtcaagggagagccggccacgcagctgtgtgtgtgggagccgccggactaaccagccaggacagggcggacggtgtgagacaaagccgttggggagagctgctgctgaataaaatcctttttcacctgcctacggcccccgagcgttccttctgctcatccacccactccctttggacctcaacatgacgttcggcgtagtcatgaacctgacgtggagtctctgttgcccaggctggagtgcggtggcgtgatcttggctctctgccaccttcgcctcccaggttcaagggatcctcccacctcagcctcccgagtagctgaggctacagatgtgtcctaccatgcccagctaatttttatatttttagtagagagagggtttccctatgatgaccaggctggtcttggactcctgacctcaagtgagccacccgtctcggcctccccaagtgctgggatgacaggcgtgggccaccacacccggcccgtgttaggataaatcttgacacgcactaacttggtggtaccacacccggccagtgttaggataaatcttgacaagtctaacttgatggttctcaaagcaaaatccgaggaaccctgagggtcccttagtgtccttcagggcctgtgaggtgaaaactgtcttcatgatcacactcgcacgccatttgtctcctcactctcttcccatgagaggacagtggcgttttccagaggctgcatgacaggtgacgtcacaacagacagctctaagactccagctgtcttccattaaacccaactcttaacgttactgccaataggttcgttattgctattttaagtggctacgtattaaaatgtttccagctttaatttttgatacagtaagtatggaaagatacaggcaacataaacaaatgttctctgtgtcttcaataatttttaagaatgtaaaggggttctcagacaaaagaggctgaaggtcactatctcagaagattacagcggacttccggcaaaacacggcaaagggaacacagtttttcttcccttcattaaatctcagtaaaaatgatggaaaaggcagaaagccacagtcacaaggggggcgggagagggagacagtggcggggggcaggggggagaaggccacacagcgccaggagctgactcagcacacaacagaacccaaaacggggtggggagtggggtgggggtgggaaggaaatgcgttcccagattgcgatggcctgcctgtgcccagaactagaaccaaatcaaggcacgtctcagtaacatttcagatcatcagagattttttaaaaacagcttccaggaaaagaaaacaaaaataggtcacattcaaaggattgggataaaaatggcatcagatttctcaatactgatgttggaaactagaaaactatggtctgccgccttcaacatctcagccacaatttatctttctttcaaataaagacaataatataagctccctctttgagagaaaaatatgagtgtaaaagataccctctcccagaaataaagggaattaaagggctactatgaagcatgtcatttgtttgtctttttgctgaaacttccgttactgtgaaagaagctttattaccatcttccaaaagaagggcatcggccaaaagctcgtcctcagggagcaggctgccgtcatcctccatgctgggagatagaaattagctgcaaaagatgatcgcaaaatatagatcaataaaatcatagatttaaaagacggtgaattaaccatttctcttaaagaaggcattaagaaaacaaacgacagattaggaaaaaatatttgcagcacacacatatctgacacaagtcttacatctggaacacatgaagagctcctatcaaccacatgaagtccaaactccagtttaaaaggtcaaagaggccgggcgcggtggctcatgcctgtaatcccagcactttgggaggccgaggcaggtggatcacctgaggtcaggagttccagaccagcctggccaacgtggtgaggctacagtgagctgtgatggcaccactgcactccagcctgggcaacagagtgagaccctgtcacaaaagaaaaaagaaactgcccaacagtatcctcgagtatcactttacactcccaccagcaaataccaaattaaaataatgaaatacaacattagctgggtgtggtggcgcatgcctataatcccagctactcaggaggctgaggcaggagaattgcttgaacccgggaggcagaggttgcagtgagccgagatagtgccactgcactccagcctggggacaagagcgagactccatctcaagaaaaaaatgtcaaaagatttggaattccataagaaaagagatatacaaatggccaatatgcatgtgaaactgtgtaacatcagtatctttaaggaaatatgaatcaagccataatgagatactattatatactgagtagaatgcctgagattggctgggcgtggtggctcacacctgtaatcccagcactttgggaggccaaggtgggcggatcacgaggtcaggagatcgagactatcctggctagcacagtgaaaccccatctctactaaaaaacagaaaaaattagccgggcatggtggcaggcgcctgcggtcccagctactcgggaggctgaggcaggagaatggtgtgaacccaggaggcggagcttgcagtgagccgagatcgcgccactgcactccagcctgggtgacagagcgagactccgtctcaaaaaaaaaaaaatgcctgagatcaaaacgctgccaacagtgagcactggcaaggctatggaagggctggcatcgtcacgcgttgctggtgggagtgtaaagggatactctggaacactgttgggcaatttctgttttcttttgtgacagggtctcactctgttgcccaggctggagtgcagtgacacaatcacagtttactacagcctcaaacttctgggctcaagcaatcttcccgcctcagcttcacaagtgctaagactacacgcacatgccgccatgcccaggtaattttcaaattattggttgagatggtgggtctctctttgttgcccaggctagtcttgaactcctggtctcagccaggattcacccacctcaacctcccaaagtgctgggattacaagcttgagccactacatctggcaccaaaaacaatttttttttttttggagatgaagtctcgctcagtctcccaggctggagtgcagtggcgggatcttggctcactgcaagctctgcctcctgggttcacgcccctctcctgtctcagcctcccgagtagctgggactacaggcgcccaccactacgcccagctaatttttttgtatttttattagagatggggtttcactgtgttagccaggatggtctcgatctcctgacctcgtgacccacctgtctcggcctcccaaagtgctgggattacaggcgtgagccaccacgcctggcccaaaaacaattcttaaataatttcaaaattatcattacactttgcttatcattttgggaatgttaggagcttgctcgtgtggaactcttggtaccgaatcttctgtgtccagatgttggaactaaataatttcacttaagaaacaggccgggcacagtggctcgcgcttataatcccagcactttgggaggccaaggtgggcagatcacttgaggtcaggaatttgagaccagcctggccagcatggtgaaaccccatctctactaaaaatacaaaaactagccaggtatggtggcaggcacctgtagtcccagctacttgggaggctgaggcccgagaattgcttgagcccaggaggcggaggttgcagtgagccgagatcacgccactgcattctagcctgggcgacaggggaagactgtctcaaaaaaaaaaaaaaaaaaaagaaacaat

SEQ ID NO: 1818 - DNA, 74302 bp, Homo sapiens
gtttggtctaaatataatatacaattaaaccagtaatgattacaaaatccaaaattaattgttcattgtcatgatggttatgggtttcactctaaattacatggattggcaaacctattattatgtatgcatctacttgagtgattctccagcggcaatgatgtgaatactctaagaaatccttaaacatagtttatattttggctcgtttttcaccttgaattattcacgtgaataaagttctaccttgattttcgtctatatcaactttacctcaggtgcatcacagccagtacttacaatcttctactaaatgagatgagctagtagagaaacagggagaggagcaacacttacctactgtcatcagaaagccacacgcccttcagtggagaggtcaggttacctctgaaagacacaaacgttatctgtgatcttcacagactgccctttgaagggtcagagtgaggcaagagtggaaaaagtagattcctcaccaatgtgtcactgcagatttgaacaggaaattctcaccctagggctattttgaatcagtttgtctcatcacacactttagaatataggagactttgggtggctagtgtgtcatttagtttgtccattttaaagtgcctcttagaaattatttttatggtcaacaagatgaggggagagcagagatttgatccatgctggtgattgtttccatctcagtcacaaacaccaaagttttgtaacttttcaaaaggatcttaggtggttgctttctacatttagacaaggtggctgaaacttgacattatatacttttttatcatatacccctataatatcactgctatcataataacaaaatttaaataatgattttatcaataggaatttaatgtacttgtcactattttgagaaaatgctgcattttcaacttaattgtaactgacatgcattctcaaacttatcttcttgctttctttgccttagttcttaaaattccctcattcaatttttcttctttatataagttaaccagattcctgattaaaataaatgtctcttgaaagaataaaatattaaacaatactgagctatatctctatgccagagactgaaataataaaaaaactacctactatattgttcaccggttccttctctaatcatgacttactgtctgcattttaatagaaatatttgttgtaaatgactaaagcctaagttaaactatgaagggaggttaaagcaatttttaaaacatcacctacttaaaaatggggaggccagaaaatggagattttttaaaacacaagtaaaatgatacatgaatgtccgggcatggtagctcatgtcagtaatcccagcactccaggatcacttgagctcaggagtttgaggttagcatgatacacaggatgaaaccccatctcttaaaaaaaaaaaaaaaaaaaaaaaaaatatatatatatatatatatatatatgaattagccgaggatgctggtgtttgcttgtagtcccatctgctctggaggctgaggtgagaggatcgcttgagccctgggggtcaaggctgcagtgaactgttagtgtcactgcactgtagcctgggcaacagagccagaccttgtctcaaaaacaaataaacaaaaacttttaaaaaataaatggtatacgaacatcagggaaaaaactataaattatctagttgtattaaataaaaatcttttcatcatttattttctatcaagaaaagggggaatgtttatgcataattctattgcccaggctggagtgcagtggtgccatctcggctcactgcaacctctgcctcctgggctcaagcgattctcctgcctcagcctcctgagtagctgggattacaggcgtgtgccaccaggcccagctaattttttttgtatttttagtagagacgaggtttcaccgtgttagccaggatggtcttgatctcctgacctcgttatccgtctgcctcggccttccaatgtgctgggattacaggcgtgagccactgtgcccggctattctctaaaatctaaaaagttggaatttaaacccatatttatttctttgcaatgagaattattatttgcccttccatcagaatggctaatggtggctaggtatatatgtttttctgtaaaatatattgtaatatattttcacaaaattaattaataatgtcatatgcatatatgcttgtgttcatattgtatctttttctattacaagtatatttatatttacattttattacattttcataaactaggttactttttctattagtcacgttatggaactaaaacaataaaatcattcactaaagatgccacataatgtatcattcactgatgttttctatttaagtctgaagtgctgatgtctactattgctacaaacatccacttggtgttttccattagtgttataccattattgtttgcataatgacagggatacctctgaggaatatgtctttaggcaatttcatccctgtgtcaacatcaaagagtttatttacacaaacctagatggtacagctactacactcctgtgttatatgggataggctattgctccaaggatacaaacctgtacaatatgttactgttgtgaataatgcaagcagtgaccagaatggtaatttttgtttatctaattatatataaaccaaaaaaacagtaaaatatggtttaaaaaaaggttaaaatggcatccttttatagggcacttactacgaatgaagactgcagaaatggaattttccctgggtgagtcagtgagtaagtagcaagtgaaagtcaaggcctaggatattacagcacactactgtaggatttatacactgtacactagggtacactatatttatgcagcactttttttcttgagctaataataaattaactttactgcacctttgttggtttctaaatttttcatattttaaaaatcttctgcctctttttaaatacactttatttaaaaacacaaattgcacagtcttaacaactatattctttttatgagcttttttctatatttcattttaatttttttctttttaaactttttttaaaaacgaagacacgaaaacatacattagcctaagcctacgcagtgtcagcaagatcaatctcactgtcatcccctccacatcttgtcccactggaaggttcaggcaataacacacgtgcagctgtcctctcctatggtaacagtgccttcttctggaattcctcctgagggacctgcccaaggttgtttttcaggtaactgtttttatagaagtagaaggagtacactctaaaataataattaaaagtatactacagtaaatacataaaccaataacattgtcatttattatcattatcaaatattatgtagtgtatgtaattgtttgtgctatacttttattccactggcagcaaggtaatttacaccagcatcaccacagacatgtgaataatacactgtactgaaactattgctatgacgtcactaagtcataggaaatttccagctccgttataatctagtgggaccactatctatgtgcagtcagtcattgaccaaaacatcattttgtggcacgtgactgtatatcatgtcctttgttaatcgaaacaatacagatttctactgtttgggcatttactgtgaatgaagtttatgcttatacaaaggcacaataaatatataaaaacaaaacaaaaattacacaagataactggagtacttagaatttatatgatgtgtgtgtgtgtgtatatatgtttatgtgacgtaaatacacacacacacacacacagaacttacgatgattaatattaggtgtcagccggattggattgaaggatgcctagatagctggtaaagtgttgtttctggctgtgtctgtgacggtgttgccagaggagattgacatttgactcagtggactgggcgaagaacacccatcctctgtgtgggtgggcaccatccaatggctgccagagcgagtagaacaaagcagctagaagaaggtggggtaagctggcttgctgtgttcggctttcatttttctcccgtgctggatgcttccttcgttcctcctgcccttggacatcagactccaggttcttcagcctttggactcttgtacttacaccagtggttttacaggggctcctgggccttcggccacagactgaaggctgcacttttggcttctctgcttctgaggcttttgactcggactgagccactaccggcttctttcttcccccagcttgcagatggcctattgtgggactttgccttgtgattgtgtgagccaattctccctaataaactctctttcatatatacatgcatcctattagttctgtccctctagagaaccctaacaccgaacctacatatgaattactgtgactattgcaaataatggcaatatctggtttcctatgggttatggctaagttggaagtcaataagaagtgaaaatatacttttaatgtaacatgaaacaaaataattttcaaggaatttaaaaaattggagtgaattagttattacaaactctaaagaaaataaaatttaaatttcttcaatagattaagcacaccttcccaatgaaaacttggatattcaaaaagaagacgtaaaggaattatgtggatatacctaattggatattgaatagatagtgtattaatgacaaagtttccaacattgaaataaatatttgtattagaatttggggagcagatacaggctaactggtaaataaaatagagagtaatcttactttgtttgtactgctataataaaatatcacaaactaagcaatctattaaccatacagatatattactcacagttcagacagcagggaggtccaagatcaaagtgccagcaggtgtgttgtaaattgtattaaattaacaagtttctatgtggaaagtaaacaatgaaaatatttattatgaaaacataagggaacaacagagtttaaacacttggtaatgttcaatcagaatgtaataaaaatgaagttataattaatacctgtgcttacatatttccatataaataaaatacataagaattatattttagatattgataattatattaagtatagagtaatttgaatttaaaagcaaagaatgtatatattcagtaataactgtttgttgtctttattagacatgcctttcatgtaagcataaagaaaaatgaatataaaagtggagccaccatatgatccagcaatcccactcccaggtatatacccaaaagcaagaaaatcagtttatctaagggatagctgtactcccatgtttgttgcagcactgttcacaatagctaagatctggaagctacctaagtgtccatcaacagatgaatggacaaagaaaatgtggtatatataaacaatggagcaatattcagccataaaaaaggaatgagaccctgtcatttgctataacatgaatggaaccaggggtcattatgttaaataaaataagccagtcgcaggaagacaatcatcacatgctctcacttacctgtgggatttaaaaatcacaacaattgaactcatggagagagacagtagaaggatggttaccagagattgagaaggatagtggaagggtagtagtagggaggtgaaaatggttaattaatgggtacgaaaaaaagatagaaaggatgagtaagacctagtgtttgatagcacaacagggtcactacagtcaataataatttaattgtatattttaaaataactaaagagtataattggattgtttgtaacacaaaggataaatccttagggagatggatgcatcatttttacatgatgtcattattatgcactgcatgtctccctcaaaacagctcacggaccccataaacatataccctactatgtacgcactgaaattaaaattaaaatatttaaacaaggaaagatgaagataaaatatttaacaacatataccatgcctcacaaactggtagaacactattacagttgtaatagtgccgtcttaatataaggcaagccctttactggaattgaggaagcatgcttcacaatgtaagattaattttccaaaccactagtaatatacatttttatcattgcatgtacctaatgctacaagttcaacatacaattgaataaagtgaataagtaacaatcataaatggaattttaaacacttttctctcagtgcttaacacacaaacaggccagagagccgatagaaagatttgaactagacaagtagttatcactcatatgcacacactcacacacatgtagaatactcacatatttaatttcacatatttttcccagatacactgtaatctcataattctaagcatattagtaaaaaatataggactatgatttcaatgtagtaccactagccaagcttggccagtggatagttaaaaaatagctattctaattcaacattaattaataccaaataaataacatgtaaaaccagtttctcagcacactagccacatctttgcatacaaagatgaagaatatttccagcttcatagaaaatgttctaactacagtttacctacaatagaagtcaataaaaaaatctgacaacctcaatggttttaaattcagtaatacatatctaaataacatatgggtgaaataaattatcaaaacgaatggtcacaatttttatatgaattataaggaaaatagaatgaaaatctctcttgtaaaaaccgattgccctcaatgtacatatattacaaaagatgacctaaaaattaaattaccattgaatgcactaaaataaattaaaaatagaaaagctaaaattaaatacaagtgatgtataagaaaaagatgaataaacagtaaaaaatcacgataaagaataatgttacaatagagagaacagcaaggccaaaggtattttcattgaaaatgcttttaaaacttgatgaacgactactaaaaatatacacctactaacgtatccacaaaaataataaatttaacattttaaaaaattgataagggccaggcacagtgatgcctcccaaagtgctgggattataggcttgagccaccagaactggcctatttctagattaaacatggcaataccattatggtctttacagttatttagaggcaataaaactatttttcattacattttaatgtctatatgaaatagaaaattcatacatactcattaccaaatgcagtacctcaaatagaaatctgagtatatcccaccatgtattaaagaaattcagtttagacataaactttcctagaaaaatagtctacaaactcagatggcattactagtgaattataacatttaaaaataaagcagtactctcaacaaatgcttctaggttatagaaaaagagaaattcttcccaagatagccttgatatcaaaacctttcaagtatatagctatgaataaaaacatggtcaaatatccttgtgaacatggatgaagaaacaaatcttaccctacataaaatatatatgcgctaatttttttttattcatcttttttgagacagagtctccctctgtcgccaggttggagtacagtggtgccctctcggctcactgcaacctccgacccctggtttaaagtgattctcctgcctcagcctctcgagtagctgggactataggtgcgcaccaccacgcccagctaatttttgtatttttagcacagatagggtttcagcacgttggccaggatggtctcgatctcttgacttcatgatccacctgcctcagcctcccaaagtgctgggattacagacgtgggccaccacacccggccagcactgatattttatgagggaaatatacaatgatcatcatggatctatttcagaaacaaaggctggtttaacatttgaaaaaataaaagtttataaaatgttatataaacaaaacatatatcattccaacggatacaaattaataaaaatgttacaattgataaaatctattagaaaatagtattataaaactgcttcgatatgagaaagataggatgcaaaaaacaccaagctttttaaatatgtataacatgttgaagtattttttgccaaaaccagaaaatgatgcatatgatccacaaagaactttgattgtgccttctattcaactatgggtataaaaccctagccagtgaaaataaatgaaaataaaactaagttatagcacatggattaaaaaaaataaaagtgtgatcatttgcagataaaattgctcgttatatagaacacccagaaataaatcaatagttgacataatagatttaaatatataaaatcagtggaataagtagatataaaatcaaaatgcagacatcagttgtatttctatttataacaacaaaaattactaaagggaattttagaatcaggatgccatttacaaaagcataaatgtaaaatacctacatttctgtatgacttcaatcccccaaaatacaaaatacaagagagagaaattaaagataacacagtacattgaaggaaacactttatactgattagaaaagtcaatattataaagaagctaatctttaaaaattactttagagaataaatgcagtcataaacaatcccatcagaggcttttttttttctggatagctttattgaagtgtcatgtacaaagcatacatttcatgcacttaaaatgattaaaaatcaatgatgtttagtatattcgcagagttacaaccatcaccactactgaaatttagaaagttttcatcacgacacaaagaaacgttctatcaattagtggtcatctcctatttcaacctccctgagacattggcaaccactattctactttctgtctccatgggtttgactgttcttggtacttcctataagctgactcacataacatgcaacttttagaaaggctgaaaaccacaaataccatgttgagcaaaatgagcccgacacaaatgctaggatgtctgtactttagtaattgtgtgcatcctatttcaataattgatttagaatttttgtatcagagcaaataacataattcattttcagatttatgcaatcataatatttctattttaagaaatataaaatgtatctgatgcactgcaaacgcaaatgctttacttctaaagcttatgcttacaatgatatatcattgaagatccacactgggctgatttaagtcgatttacttgtagcactgcacagttaagttcagcattatctgagtcttttatcctgtaatggagaaaaatccattttctgttacattttaagcaaatgattcatgagacgaaagcattttccatgtactgtaagaaaagaatttcatggaaaagggtaattaaatttttcataatattagtaagagtcattattctgaacactcaacagagtagtccctcttcatccacgagggatatgtttcaagaccccagtggatgcctgaaatggcagatagtgcagaacctatagagagattatgttttctctacacattcataactgtgataaagtttaatttataaattaggcacaataagagattgacaacaataactaataataaaaaaattatagcaatatgccaacagcactattattgtgctttgaggatattcttaagtaaaaaagtaagcgtggctttttaataaaaacaagcactgcagttccctgatagtccagctcgaggttgtccaactcgctgcccatgggccgcacgtgacccaggacagctttgaatgcggcccaacacaaatacgtaaactttcttaaaacattctgtgattttttttttttttttagctcgtcagctatcgttagtgttagtgtattctatgtgtggcccaagactattcgtcttctaacgtggcccacagaagccaaagatgggacacccctggtccatctgataaccaagaaggttactagcagaccaatgagcggttgaaatatatggactactatggtctattgtaaaatatttatatcaacatttcactaactttccacatctttcttcatgtcaatgattccacataaatttattcatattattcttctgaatttatcctttatatatattttttatatagcgccatacaaaagaacttacttatgtttgaaagccaaaccatttattgtcacccatggatgatgactgctgttacgaaacacaccaatccatgaggaaggtaaaatgctggccagaaatttctaaaagaaaagaaataattttcacttaaataataattatgaaaacattacaaaaacaatatattaaagttgaaaaccactatttgcagtgccaaaaactttcataaatgtttgaattttttatttaaatgaactcttcaacgtttatacttagtactttcattcttattctcatgttaataaagacattttaattcttgcaatgtaatagttactccaattaacagaataaacgcaggaagggttttaataagtttcctgatactgtgcattcattcctccagatactgtgactaaatcaatctatttttgtgctatatttctcagagttggagatttagaagggaattgaggggttgtcattcagaaatagatgacatggaagctacagattgggttttctgggtaccacaccattctttaactagataagccctcaatttttatccgattcggtttttgcggaataacaggggtcctggccaggtggtgtagactcgtctctctctgctactcccgactaaaaacaactataaactctgggattaatgaaagacaaaagcaatggagaactctgaaaggtggaaagagaaagatgaaattgtctgggaccctagcatcagggatcaaccaagtgtccgagtgagcatgttaagtcctccacacgacagaagaaggtgacctaggcctgctgtttccctacacccaacctggcaataggaggagggtatcgaaggagagtcccctccacaataccaggcaaggctggtgccactggcaaggatgatctaccaggagacctgctaccaatatggagctagagaaagtgcttccttctcataccaagagacaccaggatggctgtggatgaggaggatcagcaaagggaccccatgactaacagtgcaccgtaaaccacctagggtcctctttgtccctgagggcatgagacccacttccccatccagagacaaggactcaatggattcttactgttctttgtacatagtacagcagtgaacagtaacatactactgataactgcaataatatggaggaattgcacaaatatcagataggattgaaaaagacatgaaattcacactgcttgattccctttatataaataaattcaagaacaggcaatcattatttataatattaaaagtcaagactgcgttttggagaggagtcaggataagtgatgagggcatacacaggggtggaactgctagagctggaaacttttatttcatgatctgacttgtatcacatgcattcattcactttgtgatcaatctgcatgaccagatgatatcatgcccgataaaattagatagcaaaatttattgtggattcaaagcacttatagaagcatggttttccttgaaaaacaaaaactgaaaataaatgtacattagcagtatataactttaaaaacattattaagtcaatcaattgaatattacatacacttgaaaatatatgagataaatatatgtacacacatatggatgttttctacaaatgtattattcactgaaggaagcttttcataaaatgtttgaaacatttacatcttaccatttcttcttcattatctatagaaagcagactggagttcttcgaagtacaggccagcaaactctcttcccaagttcttctttccttaccaatgtaataacaactgttggaatatgtaatccactcctcaggacaatggccacaatgacgtgctaataaagatatgaattactatctagaccaatatgaatttttaaaaatgaaaattagttcacatatttcaacagtataaacatatatgtgcttaacatatttacgcatccttacaggcttataaatgtatatttttaataactgagtcagtcatacacacatgcacagacaagggttagcctctcctccctaattgtgttcccatataaagcaaatgaacaaacaaaaatacactctacacatgtgttgaacatcgctgatacacaactgcttttttagaatagtaaaattatttatttggtatcatctcacagcagtaggaaacctctgttaattgggagaaagagggtagaatgattttaagtgagtatttctactcactggagaaaaggaaatgctgcctcataatctttctttataaatatttatggctgaatttatggcttattttctgcaaaaatgccactattcttttacatgccttaaaacagacacaaaatataaattgtactaatatcagaacattgaaaataaaaatgtacctttctgcgttcttgtattcggggaaaaattgttctgctccaggactgtaatagaaaaattaaaatgatttttataaaaactgatatctagataaaccataacgagtttagtttcttactttgaaactttgtgtgttatttaaaatggggagaatctttaataaaattaactttttctataaaaatatataaagtaatagacctttgaaataaacatttttaaagactttagcacaaacttcaccatctcttgtagtatttgatgtaaccactttcaaaaattaatttgtttttctaaatacttttcttctatagcatgcctttgaattatgaaatcagaaaatatctttgtgtgtgtatgtatatacatatatatagattacacacaaaaaataaacacatgttctctacaatgattttgttatttatgttgtgaaaaattcagaataaccatattacttttggttccaaattgtactaatatcagaactttgaaaataaaaatgtacttttctgggttcttgtatttggggaagaattgttctgctccaggactgtaacagaaaaattaaaatgatttttataaaaagtaatatttagataaaccataatgagtttagtttcttactttgaaactttgtgtgttatttaaaatggggacaatctttaataaaattaactttttctataaaaataaatgaagtaatagatctttgaaagaaacagtaaaataagagttctattcttcaacagtatgaaatattttgaggcacttccaagcattaaagtaaaacgttcccttctaatctttcaagaatatgcttacaaggaataagaactattgtttttaacacagtggccatcaggacaatgcaaatgattcctaggacctcggcagtgagcttctctggaggtggcagtaaacctgcagggagagaaatagaggcactgagagaggggagatagagagttgattaggattacatactagagaattacatactagagaacccacatgcacagggaaacataatgataaactctggcctctaaatctacatctactctagtaatctttctctcagaatataccatttcattttcagtaaatataatgttccatgagtggaccgcagattacagttgaacaatgcccgaataaaattagtcttctgatttcatattagaattttagatcccaattatgaactccgattctcacaagtgcaaaatattccctaatctttcctcacccttctgcattcaactgcacatcctagaacaataatattgaagatatatttaatgttttaccttggcagtcatatattttatcaatcccttgatgattcagggaaggattttgaagatttaattctacttggaatatttcctgttcggttcctgaaatggagcttttattgcctttaggtttcctttgctgccgctttgggtcctgggccagactcacttctgagaaggttcctctttgtttattcatctctgcagctgtgtgatgtgagggactgtgctctatgataactgcacttaagaagctataaatggtgtatattttgacaggatccctggtataggcaatgtgcatgtgttggggctgagtaataatgtttactttgctgttaaccaatgtaaaattctgctactaatttcctaaagctttaaacaaaaatcacacgatataattggcaattttttagatgtattctgtatttgacataatattactagtgggaacaataaaaacattaaacttatgagaactaggaagttcatgaaaaattggtattaaattaaggttagattcttcaaaaatgtttaacaccaatagactgcatatgtcaacaatcaaaatactgtatttagaaatacacaaattttatcatagttttaagagtcattgatggttaaggattgtgtgccataagataaaatagttctgtcagcatatagagtatcttcttatactaaaatacattgttagtgacttacattcatttattaaaaggacctgaggtattgtcaaatgattttttttctaaattaggaaatcagaaaaatcattaaaattttaaaaatatatcttgtaaaacattacattactgtatgcataaatattattgaaaacgtatttttaaattgctgcttttacacaagaaattggtaattgatttaatgactaaaataggaaaacttaaaatgataaataaacgtgtgggccgtctatggaagaatagtgtccaatcaaactttcagaaagctcctatgattgtataagtcagtgagggttgctttggttgtataagtaattgtaatagttcagataatgtaatttaataatctagtcaatgagctctgtagtcagtgagactacaattaattctagctttgcaagttgtaatatgtgacctgtactaaattacttagtgtctactaacctagtttactaatctacattgggaaaaataatttataaagtataatgtatgtaaaaaactaaacacacaacctggcacatgttaccactgaatacataatagatatttcaactatttttaacacaattgccattttattatttctgatttgcattagagtgtgttaaaataactcattaattaggcgtctcatgtcagtgtggtacatcttttttgcaatgtttggttcaattgttttaagtcttccaattgtttataattaaggtcagatttgcattttatggaaatgatttcatccttacttttattaaaaattaaaactgctttcatgaaatctaggtgtgtgattgagaattaatgtttgacattcacaatttgatgtatccatattaaaaatttatttttaaagtttggtctaaatataatatacaaaatgtaatggttacaaaatccaaaattaattgttcattgtcatgatggttatgggtttcactctaaattacatggattggcaaacctattattatgtatgcatctacttgagtgattctccagcggcaatgatgtgaatactctaagaaatccttaaacatagtttatattttggctcgtttttcaccttgaattattcacgtgaataaagttctaccttgattttcgtctatatcaactttacctcaggtgcatcacagccagtacttacaatcttctactaaatgagatgagctagtagagaaacagggagaggagcaacacttacctactgtcatcagaaagccacacgcccttcagtggagaggtcaggttacctctgaaagacacaaacgttatctgtgatcttcacaggctgccctttgaagggtcagagtgaggcaagagtggaaaaagtagattcctcaccaatgtgtcactgcagatttgaacaggaaattctcaccctagggctattttgaatcagtttgtctcatcacacactttagaatataggagactttgggtggctagtgtgtcatttagtttgtccattttaaagtgcctcttagaaattatttttatggtcgacaagatgaggggagagcagagatttgatccatgctggtgattgtttccatctcagtcacaaacaccaaagttttgtaacttttcaaaaggatcttaggtggttgctttctacatttagacaaggtggctgaaacttgacattatatacttctttatcatatacccctataatatcactgctatcataataacaaaatttaaataatgattttatcaataggaatttaatgtacttgtcactattttgagaaaatgctgcattttcaacttaattgtaactgacatgcattctcaaacttatcttcttgctttctttgccttagttcttaaaattccctcattcaatttttcttctttatataagttaaccagattcctctgattaaaataaatgtctcttgaaagaataaaatattaaacaatactgagctatatctctatgccagagactgaaataataaaaaaaactacctactatattgttcaccggttccttctctaatcatgacttattgtctacattttaatagaaatatttgttgtaaatgattaaagcctaagttaaactatgaagggaggttaaagcaatttttaaaacatcacctacttaaaaatggggaggccagaaaatggagatttttttaaaacacaagtaaaatgatacatgaatgtccgggcgtggtagctcatgtcagtaatcccagcactccaggatcacttgagctcaggagtttgaggttagcatgatacacaggatgaaaccccatctcttaaaaaaaaatatatatatatatataaaaattagccgaggatgctggtgtttgcttgtagtcccatctgctctggaggctgaggtgagaggatcgcttgagcccattggggtcaaggctgcagtgaactgttagtgtcactgcactgtagcctgggcaacagagccagaccttgtctcaaaaacaaataaacaaaaattttaaaaaaataaatggtatatgaacatcagggaaaaaactataaattatctagttgtattaaataaaaatcttttcatcatttattttctatcaagaaaagggggaatgtttatgcataattctattgcccaggctggagtgcagtggtgccatctcagctcactgcaacctctgcctcctgggctcaagcgattctcctgcctcagcctcctgagtagctgggattacaggcgtgtgccaccaggcccagctaattttttttgtatttttagtagagatgaggtttcaccgtgttagccaggatggtctcgatctcctgacctcgttatccgtctgcctcggccttccaatgtgctgggattacaggcgtgagccactgtgcccggctattctctaaaatctaaaaagttggaatttaaacccatatttatttctttgcaatgagaattattatttgcccttccatcagaatggctaatggtggctaggtatatatgtttttctgtaaaatatattgtaatatattttcacaaaattaattaataatgtcatatgcatatatgcttgtgttcatattgtatctttttctattacaagtatatttatatttacattttattacattttcataaactaggttactttttctattagtcacgttatggaactaaaacaataaaatcattcactaaagatgccacataatgtatcattcactgatgttttctatttaagtttgaagtgctgatgtctactattgctacaaacatccacttggtgttttccattagtgttataccgttattgtttgcataatgacagggatacctctgaggaatatgtctttaggcaatttcatccctgtgtcaacatcaaagagtttatttacacaaacctagatggtacagctactacactcctgtgttatatgggataggctattgctccaaggatacaaacctgtacaatatgttactgttgtgaataatgcaagcagtgaccagaatggtaatttttgtttatctaattatatataaaccaaaaaacagtaaaatatggtttaaaaaaaggttaaaaatggcatccttttatagggcacttactatgaatgaagactgcagaaatggaattttccctgggtgagtcagtgagtaagtagcaagtgaaagtcaaggcctaggatattacagcacactactgtaggatttatacactgtacactagggtacactatatttatgcagcactttttttcttgagctaataataaattaactttactgcacctttgttggtttctaaatttttcatattttaaaaatcttctgcctctttttaaatacactttatttaaaaacacaaattgcacagtcttaacaactatattcttttttatgagcttttttctatatttcattttaatttttttctttttaaactttttttaaaaacgaagacacgaaaacatacattagcctaagcctacgcagtgtcagcaagatcaatctcactgtcatcccctccacatcttgtcccactggaaggttcaggcaataacacacgtgcagctgtcctctcctatggtaacagtgccttcttctggaattcctcctgagggacctgcccaaggttgtttttcaggtaactgtttttatagaagtagaaggagtacactctaaaataataattaaaagtatactacagtaaatacataaaccaataacattgtcatttattatcattatcaaatattatgtagtgtatgtaattgtttgtgctatacttttattccactggcagcaaggtaatttacaccagcatcaccacagacatgtgaataatacactgtactgaaactattgctatgacgtcactaagtcataggaaatttccagctccgttataatctagtgggaccactatctacgtgcagtcagtcattgaccaaaacatcattttgtggcacgtgactgtatatcatgtcctttgttaatcgaaacaatacagatttctactgtttgagtatttaacgtgaatgatgtttatgcttatataaaggcacaatatataattacacaaatatataaaaacaaatatatataaaaacaaaaattacacacgataactggagcacttagaatttactctatatgatatgtgtatatatatatgtttatatgatgtaaatacacacacacacacagaacttacgatgattaatattaggtgtcagcctgattggattgaaggatgcctggatagctggtaaagtgttgtttctggctgtgtctgtgacggtgttgccagaggagactgacatttgactcagtggactgggcgaagaagacccatcctcggtgtgggtgggcaccatccaatggctgccagagcgagtagaacaaagcagctagaagaaggtggggtaagctggcttgctgtgttcggctttcatttttttcccgtgctggatgcttccttcgttcctcctgcccttggacatcagactccaggttcttcagcctttggactcttgtacttacaccagtggttctacaggggctcctaggccttcggccacagactgaaggctgcacttttggcttctctgcttctgaggcttttactgagccactactggcttctttcttcccccagcttgcagatggcctattgtgggactttgccttgtgatcgtgtgagccaattctccctaataaactccctttcatatatacacgtatcctattagttctgtccatctggagaaccctaacaccgaacctacatatgaattactgtgactattgcaaataatggcaatatctggtttcctatgggttatggctaagttggaagtcaataagaagtgaaaatatacttttaatgtaacatgaaataaaataattttcaagcagtttaagaaattggagtgaattagttattacaaactctaaagaaaataaaattcaaatttcttcaatagattaagcacaccttcccaatgaaaacttggatattcaaaaagaagacttaaagtaaaggaattatgtggatatacctaattggatattgaatagatagtgtattaatgacaaagtttccaacattgaaataaatatttgtattagaatttggggagcagatacaggctaactggcaaataaaatagagagtaatcttactttgtttgtactgctataataaaatatcacaaactaagcaatctattaaccatacagatatattactcacagttcagacaacagggaggtcccagatcaaagtgccagcaggtgtgttgtaaattgtattaaattaacaagtttctatgtggaaagtaaacaatgaaaatatttattatgaaaacataagggaacaacagagtttaaacacttggtaatgttcaatcagaatgtaataaaaatgaagttataattaatacctgtgcttacatatttccatataaataaaatacataagaattatattttagatattgataattatattaagtatagagtaatttgaatttaaaagcaaagaatgtatatattcagtaataactgtttgttgtctttattagacatgcctttcatgtaagcataaagaaaaatgaatataaaagtggagccaccatatgatccagcaatcccactcccaggtatatacccaaaagcaagaaaatcagtttatctaagggatagctgtactcccatgtttgttgcagcactgttcacaatagctaagatctggaagctacctaagtgtccatcaacagatgaatggacaaagaaaatgtggtatatataaacaatggagcaatattcagccataaaaaaggaatgagaccctgtcatttgctataacatgaatggaaccaggggtcattatgttaaataaaataagccagtcgcaggaagacaatcatcacatgctctcacttacctgtgggatttaaaaatcacaacaattgaactcatggagagagacagtagaaggatggttaccagagattgagaaggatagtggaagggtagtagtagggaggtgaaaatggttaattaatgggtacgaaaaaaagatagaaaggatgagtaagacctagtgtttgatagcacaacagggtcactacagtcaataataatttaattgtacttttaaaaataactaaagagtataactggattgtttgtaacaaaagaataaatccttagggagatggaaacaccatttttacatgatgtcattattatgcactgcatgtctccctcaaaacagctcacggaccccatgaacatatacacctactatgtacgcactgaaattaaaattaaaatatttaaacaaggaaagatgaggataaaatatttaacaacatataccatgcctcacaaactggtagaacactattacagttgtaatagtgccgtcttaatataaggcaagccctttactggaattgaggaagcatgcttcataatgtaagattaattttccaaaccactagtaatatacattttttatcattgcatgtacctaatgctacaagttcaacatataattgaataaagtgaataagtaacaatcataaatgggattttaaacccttttctctcagtgcttaacacataaacaagccacagagctgacagaaagatctgaactagacacgtagttatcactcatatgcacacactcacacacgtagaatactcacatatttaatttcacatatttttcccaaatacactgtaatctcataattctaagcatattagtaaaaaatataggactatgatttcaatgtagtaccactagccaagcttggccagtggatagttaaaaaatagctattctaattcaacattaattaataccaaataaataacatataaagccagtttctcagcacactagccacatctttgcatacaaagatgaagaatatttccagcttcatagaaaatgttctaactacagtttacctacaatagaagtcaataaaaaaatctgacaacctcaatggttttaaattcagtaatatatatccaaataacatatgggtgaaataaattatcaaaatgaatggtcacaatttttatatgaattataaggaaaatagaatgaaaatctctcttgtaaaaactgattgccctcaatgtacatatattacaaaagatgacctaaaaattaaataaccattgaatgcactaaaataaattaaaaatagaaaagctaaaactaaatacaagtggtgtataagaaaataatgaataaacagtaaaaaatcacgataaagaataatgttacaatagagagaacagcaaggccaaaggtattttcattgaaaatgcttttaaaacttgatgaacgactactaaaaatatacacctactaacgtatccacaaaaataataaatttaacattttaaaaaattgataagggccaggcacaatgatgcctcccaaagtgctgggattataggcttgagccaccacaactggcctatttctagattaaacatggcaataccattatggtctttacagttatttagtggcaataaaactgtattttcattacattttaatgtctatatgaaatagaaaattcatacatactcattaccaaacgcagtgcatcaaatagaaatccgagtatatcctacatgttttaaagaaattcagtttagacataaactttcctagaaaaatagtctacaaactcagatggcataactagtgaattataacatttaaaaataaagcagtacgctcaataaatgcttctaggttatagaaaaagagaaattcttcccaagatagccttgatatcaaaacctttcaagtatatagctatgaataaaaacatggtcaaatatccttgtgaacgtggatgaagaaacaaatcttaccctacataaaatatatatgcactaattttttttttttttttttttttttgagacagagtctccctctgtcgccaggttggagtgcagtggtgcactctcggctcactgcaacctccgacccctggtttgaagtgattctcctgcctcagcctctcgagtagctgggactataggtgcacaccaccacacccagctagtttttgtatttttagtacagatggggtttcagcacgttggctaggatggtctcaatctcttgacctcctgatccaccggcctcagtctcccaaagtgctgggattacagacatcagccaccacacccggccagcactgatattttatgagggaaatatacaatgatcaccatggatttatttcagaaacaaaggctggtttaacatttgaaaaaataaaagtagtttataaaatgttatataaatacaacatatatcattccaactgctacaaattaataaaaatgttacaattgataaaatctattagaaaataggaatattataaaactgcttcgatatgagaaagataggatgaaaacaacaccaagctttgtaaatatgaataatatgtttaagtattttttgccaaaatcagaaaacgatacatatgatacacacagaactttgattgtaccttctattcaactatgggtataaaaccctagccagtgaaaataaatgaaaataaaactacgttatagcatatagattaaaaaaataaaagtgtgatcatgtgcagataaaattgctcgttatatagaacacccagaaataaatcaatagttgacataatagatttacatatataaaatcagtggaataagtagatataaaatcaaaatgcagacatcagttgtatttctatttataacaacaaaaattactaaagggaattttagaatcaggatgccatttacaaaagcataaatgtaaaatacctacatttctgtatgacttcaatcccccaaaatacaaaatacaatagagagaaattaaagataacacagtacattgaaggaaacactttatattgattagaaaagtcaatattataaagaagctaatctttaaaaattactttagagaataaatgcagtcacaaataatcccaggagaggctttttttttttttctggatagctttattgaagtgtcgtgtacaaagcatacatttcatgcacttaaaatgattaaaaatcaatgatgtttagtatattcgcagagttacaaccatcaccactactgaaatttagaaagttttcatcacgacacaaagtaacgttctatcagttagaggtcatctcctatttcaacctccctcagacattggcaaccactattctactttctgtctccatgggtttgactgttcttggtacttcctataagctgactcacataacatgcaacttttagaaaggctgaaaaccacaaataccatgttgagcaaaatgagcccgacacaaatgctaggatgtctgtactttagtaattgtgtgtatcctgtttcaataattgatttagaattttcttattagagcaaataacataattcattttaagatttatgcaatcataatatatttctattttaagaaatatacaatttatctgatgcactgcaaatgcaaacgctttacctctaaagcttatgcttacaatgatatattattgaagatccacactgggctgatttaagtcgatttacttgtagcactgcacagttaagttcagcattatctgagtcttttatcctgtaatggagaaaaatccatattctgttacattttaagcaaatgattcatgagacgaaagcattttccatgtactgtaagaaaataatttcatggaaaagggtaattaaatttttcataatattagtaagagtcattattctgaacactcaacagagtagtcccccttcatccacgagggatatgtttcaagattccagtggatgcctgaaacggcagatagtgcagaacctatagagagattatgttttctctacacattcataactgtgataaaatttaatttataaattaggcacaataagagattgacaacaataactactaataacaaaattatagcaatatgccaacagcactactcttgtgctttgaggatattcttaagaaaaaaagtaagtgtggctttttaataaaaacaagcactgcaattccctgatagtccagctcgagcttgtccaactcgctgcccacgggccgcatgtgacccaggacagcttcaaatgcggcccaatacatatacgtaaactttcttaaaacattctgtgattttttttttcttttttttgctcgtcagctatcgttagtgttagtgtattttatgtgtggcccaagactcttcttcttccaatgtggcccacagaagccaaagattggacacctgataatcaagaaggttactagctgaccaatgagcggttgaaatatatggactactatggtctattgtaaaatatttatgtcagcatttcactaactttccacatctttcttcatctctatgattccacatagatttattcatattattcttctgaatttatcctttatatatatattgttatatagcgccatacaaaacaacttactcatgtttgaaagccaaaccattcattgtcacccatggatgatgactgctgttacgaaacacaccaatccatgaggatggtgaaatgatggacagaaatttctaaaagaaaagaaagaattttcacttaaataataattatgaaaacattacaaaaacaatatattaaatttgaaaaccactatttgcagtgccaaaaactttcataaatgtttataattttgatataaatgaacccgtcaatgtttatacttagtacttttattcttctcatgttaataaagaagttttaattcttgcattataatagttaccccaattgactgaataaacacagtaaggatttaaataagtctcctgatactgtgcattcattcctccagatactgtgactaaatcaaactatttttgtgctatatttctcagagttggagatttagaagagaaattagaggttgtgattcagaaataaatgacatggaagctacatattgggttttctgggtaccacaccattctttaactagataagccctcacttttttatctgatttggttttggtggaataacagtgatcctgaccaggtggtgtagactcgtctctctctgctactccctactaaaaacaactataaactctgggattaatgaaagacaaaagcaatggagaactctgaaaggtggaaagagaaagatgaaattgtctgggaccctagcatcagggatcaaccaagtgtccgagcgagcatgttaagtcctccacacgacagaagaaggtgacctaggcctgctgtttccctacacccaacctggcaataggaggaggcccagcaaagctcactcctgttctgtattgaaggggagtcccctccgcaacaacaggcaaggctggtaccactggcaaggatgatctaccaggagacttgctaccaatacagccagaggaagtacttccttctcataccaagagacaccagagtggatgtgggtgaggaggatcagcaaaggaacccaatgactaccagtgcaccacccagggtcctctttgtccctgagggcatgagactcacttccccatccagagacacaggattgaatggattcttagtgttctttgtacatactacagcagtgaacagtaataaacgacagataaccgcaataatatggaggaattgcataaatatcagataggagtgaaaaacacagacatgaaattcacagtgtatgattccctttatataaattcaaaagcaggtaaacgttatttataacattaaaagtcaagacagtgttttggagaggagtcaggataagtgatgagggcatacacaggggtggaactactagagctggaaacttttatttcatgatctgacttgtatcacaggagttcattcactttgtgatcaatctgcatgaccagatcacatcatgcccgataaaattagatagcaaaatgtattgtggattgaaagcatttctagaagcatggttttccatgaaaagcaaaaactgaaaataatcaaaagtacattagcagtatatgaattttaaaacattattaagtcaatcaattaaatactacataaacttgaaaacatataagctaaatgtatatacccacacatatggatgatttctacaaatatattatcgaccgaaagaagcttttcataaagtgtttaaaacatttacatcttaccatttcttcttcattatctatagaaagcagactggagttcttcgaagtacaggccagcaaactctcttcccaagttcttctttccttaccaatgtagtaacaactgttggaatatgtaatccactcctcaggacaatggccacaatgacgtgctaaataaagatatgaattactatctagaccaatatgaatttttaaaaatgaaaattagttcacatatttgcaaacatataaacctatacgtatgcaacatatctatacatcttcatgggctggtaaatatatagtgtcaaaatacccagtcacttatacacacatgcgcaataaagggtcagcctttcatctcctaattgtgttcccatataaagcaaaccagcaaacaaaaatccactctatacatgtcttgaaaaatcaatgaactaatctgatttttaaggaacaataaataacttgtatcttatcatattatagcagtaagaatttgaacacaacagataaaaagaaagcatagtgattttacttatagttgatgacaagtgaatgccttactctaattttatttatgaacacttattgccaaattttataatttttcacccaaaattttatttttgtacagcctaagatcaagaaaaaataaactgtacaatattaaaactttaaaaattattatatacctttctgagttcttgtattcagggaagaattgttgtgcctctgtattaatgtagctagaaaaattaaagtaatctttgtaaaaaaattagcatctaaatcaatcataataattttaagtttttgtttgaatttttttgtattatttagagttagaataatatggaataaaattgattttaagaaaaatttgataaagtaatggtggttttttggaaaagtatttcatagatctaaagaaccaaatttcaccatctcatatagttcttataattcttgatttaactactttcaaaaattaatttctatttctcagtaaggtttttcagactcctagaacatatttttgagttatgaaatccaaatatatacatacgattgcatcagaagcgaatactttcaacaattattctttcatttattctttgacaaattcagaataatcattccacatttagtccaaatatatacattacaatgagaactctattccctgaaaatatgaaatgtttagaggcacattcaatcattaacgtgaaaattccccttgtaatcttcgaaaatagacttacagggaataacaactatcgttaccacagaggccattaagataagacagataattcccaggatcccaacaatgagcttctctggagctgatggtaaatctgcagggagagaaatgggaacagtgcgaaaggagaggtggatacagtcgtttagaagattcacagacaagagaacctgaatgcacaggaatcatacagagaaacttggaccccaaaccctcatctcccattgtaatctttttctcagaataatataccattgaattttcaggaaaaataatgctccatgaattatttgacaaagactacaaacttcaacaatgagttcaatcagtcttcatactttacattgaaatagcatatctcaacttggaattctgatctttgcaaatagaagatatatgagcactcccttctctttccccacattcctgtaccccaagctgcacatcctagactgttatattgaggatcttttaaatgctttacctttgcagtgataggttttgtcattcccttgaaaatcctgagaagctttttgaaggtttaattccgcataggttatttcctgttcagttgctaaaatggagtttttattgcctttaggttttcgttgctgcctctttgggtttgggggcagattcaggtctgagtagattactccttggttatccatctctgcagtgtgtgatgtcagggactgtactctataataacagtagttaagaagttaataaatggtttatatacaggattccctagtgcaattaaaagggtgaggtggagaacgagtattggagctcattttgcattaaataatctaaagttctttctctgattttcttcaagcctaaacacgtttcttatgaatatttgttttaaaaaaagatttttaggccgggcgcggtggctcacgcctgtaatcccagcactttgggaggccgaggcatgccgatcacgaggtcaggagatcgagaccatcctggctaacacggtgaaactccgtctctactaaaaatacaaaaagtagtcgggcatgatgtcaggcgcctgtagtcctagctactcgggaggctgaggcaggagaatctcttgaacatgggcggcagaggttgcagtgagcggagattgtgccactgcactccagcctgggcgacagagtgagactccgactcaaaaaaaaaagataaattttctgcatttgacaaaatattattgctggggcaatgagaagcaataaattactaaggaataaagaagttcaggaataaaaatatatttcttaaagtctgatgttttacctgtgttaaaaattaaaatgttgtattagaaaaacttctgcactcatttttatgttaattttgaaatccagtaatggttaagactatgtggtctgcacatgagtaatagtaaagttgacatatatatatataaaaatttcttgcactacattacttttaattagtaatttatacacattaatgaaaatcaatagaggtaattaaatggtcttttcttaatggctgaaatgttctaagaaattattaaaaattatttattaaaaattataaaaaattaaatatttgtatatgacagaaaatgctatgtgacacagttaacttatgcataacctaaatagtattaggaacactacataaattgttaatacttacagaagtattggtaatttaattagtaattggtaatttatttcctggctaaattatgaaccaaaaaatgataaataaaagtataggtaattcatgttaaagcacatttcatttaaacttatagaatgattttatggttgtcaaagtgagtaaaggccactttagttgtataagtacttgtaaaatttcagataatgtaattaaatcatttagtcaatgggctctggagtcagtgagatctagaattaattctagctttgacacttataatgtgcgacctttaaaaagttattctatttttaataacccagtttgttaatctaaaatgggcataagaacatataaaacgttgcatgtaaaacatttaccactcaacctggcacttaaagttctcaataagcattagctactttaattattattttagtcacaattgttatgttactgtttctgattcatgtcagttaaagcatggaaaataaatcttcagataagtctcctatgtccatgcgctacatctttttttgcaatattttgatcaatttttaaaaagtatttttattgctttgtaatacctttagcattttatgtaatctacctcattctgatttttattaaaaataaaaactgcttttctctaatctacgtgtctgaggaattgtatttggctttcatcaattgattgatttattttaataatctttaatggctaagctaaatataaattattattcaaagatacatgatgtactgattacaaaatacaaaattaattgttcattattgtgatgttaatagctttcccttaaacgatattgatcaacaaacccactagatttccacaaacaataatttgaaaactttaagaaatccttcaacatatttcatattttaggtttttaccctgagttattcaaatgaagacagcaatattctactttgattttattgtatattaattatacctcctttgtatcatattgagcacttgaaatcacccactaaatgaggtaggctagtagagagttggagagtagcaatacataccttctgtccccagaaagtcacacatcctttagtggagaggccaggttagtctcataaaaaggcctgctatagctgtgtaataaaaggtgaaatttaaaggcataaatccaagacaagaacaaacaatgcctgcaatcttcgcagactgccctgtgaaggctcagagtgagtcaagagtggaaaaagtagatttctcatcaacgtgttactaaggtttgaacaggaaattctacacatgggctattgtgaaatcagttttatctcatcacacacctccaaaatataggatacttggtctattaaaagtacaaggttgactttgaaagtgtgtcatttagttggttcatttttcaagtgcctatgagaattttttttttttctgtcttgatcacgaacattgtcaaccctcaccttgttaagagtgccttttagactaggttgctaaatcttaacattgcatacttcttttctttatattattttattatgtcacttccattataatagaaaacattctaaaactcatagtaatattatcaactgatatctactgattttttccttaattattctgaaaaattactgcagtaattactcaattgattgtagctggcacaaaaagcatcattgccaaagttatattattaacttctcttagttcttaaatttttgcacttaatttttaaaaatagattatttaatcttcagattacccttgataaaaatatcttggataggtaaaatattaatcaattttgaaatatattagcataccagaaattgaaatattaaatagctattcattacattcttcatttattcatcctccgccataacaaattatgtcgactttcatagaaatatttagttgtaaatgacaaaaactgaagtcaaactatgtatggggaaaaagtaattttaaaatcttactaggaggaaagtcagtaaattggcagaataggtggtcccccacacatatgcccccacagcaacaataatttttcagccatccacagacaaaagttcctttgagggagtttggaattcaagtaggagtttgtaaaatgccagtggaacccaagacctaggaaggttgttttagggaatagatttgcatccaagtggcagacttaccaacagtgattccatctccagacctgaaaagggacccatcctcctgtgcttgccttcagccccatttaggccttggtcatgctgccaaaaccatttgcccaggggcccaggaggagactcacacactagtgtctcaggaggtaggcatatcaactgtagtctcaatgtagaccctgaaacagccctctaacttggctttaactagtgtcagccacaacttgagatcagtccttcacccacagagacttcctgggagacatatacatctgtacctctggggcatgcttgctgacctctgtcctacagaagatactaaaatggccctgaatctccactcaaactcctctcaactgtgacctgagttaatcacaggaaattgctgtgagactcaatcatctttgtcagcagtacaggcttgctgacttcagttccacggtagtttctgaaacagccttgaatcttgaccttcacccttctcagctgtggactgtgagcagtcttgccagctcagggatacagagggaggacatgtgcatccatgtcccaactaggagaccattgacctaggtttcacagcagatcctttaattggacagaaaaggggcttcgacacttctcagctatgctagagagcagtttgcccatacagggacctggagagagacatcattagtgcccctgcaggcacagaccttagttttatttcagatcttgaaacaattctggatccagctccagcccaactcaactacagtctgaggcaaatctgcctgcccacagacctgccagaaaacacactcaaccatgaccccagagacagacatgaagacactggtttcagctatagaccccgaggaaaccttgtgacttagcactaactcctctgtgccacaggttgaggaacccactcagagacccatgagcagccttcccagcaaactagataaactcttccccaactacacacctaataatagacccaccatttacagaccttgaagtggaccctcatcccctccccagccctatacagtatgattctagagccagtttggccctctgaggcactaaataggatacaagcctgctagaagccctagtaaaaggatcatgaaccaaagatcccactctggacccgtaagcaaccatgtgatctggctgtaaccccattcaaccatgatactgaaggcaatctcatcagcccaggacactaacaggagaagcttttaacctaccgaaaccagtctgtaaagactgaaagagagtctgctctttcaaatgcacagacatcagtacaaggataaacaaataacaaagcatcagacaaatatgacaccaccaaaggaaactaataaagctttagcaactgatccaaataaatggagatctataagtttcctttaaagtaattcaaaacaatcatcttaaaaaatctcagtgagatgcaaaagaaaagagtaaacaaaaaatacaactaaaacaaaaaatacatgaacaaaataaaaatttaataaagaaatataaactattaaaaagaaccaaacaaaaattctggagctgaagaacacaatgaaagaaataaataagtcaatagagagttttaatgcccgactcaatcatgcagaggaattagtgaactcaaaaaaagagtcttttaaaattaacaaattagagtaaaaaaagaataaaaagtggcaaagaaagcatgagacctttgagacaccaccaagaatatggtatagaaagtatagaaacttcagaaggagaagagagacataaaaagtcaaaaatattttttctttaaagacatactgtctgaaaaccttcctcacttgggaaggatatggaaatccagattcatgaagctcaatgaatcatgagcaagatcagcccagaaaagactattatgaggcataatataatcaaattgtcaaaagtctaagataagagaatctcgtgggggggttttgtttattttttagcttaatgtgatctcgtttgtccatttttgctttggtttcctgtgattgtggggtattactcaaaaaatctttggccagtcaactgtccttgagaatttttccaattttttttctttcaacttttatttttagatacagggagtacatgtgctggtttgttacatgggtatattataccagaatagtgagtataatccaaagtaggtagttttctgaaccattcttccctgctctcctctcccctctagtagtctgcagtgtcttttgttcccatatttacgtctaagggtgctcagtgtttagctcccacttataagtgagaaccttcagtagttggttttctgttcctgcattaatttgcttaggattatggcctccagctctgtccatgttgctgtagaggacatggttttatcttttttatggctgagtactagtccatggtgtatatatgccacattttctttatccagtccaccactgatgagcacataagttgattccatatctttgctgttgtgaatagtgctgtgataaaaatgtgagtgcatgcgtctttttgatataatgatctattttcatttggttatattcccagtagtgcaattgagggtcaaatggtagctctgtttgaagtattatgagaaatctccaaactactttccacagcggttaggctagtttacattcccaccaatagtgtattagcattttcttttttctgcagcctcatcagcatctgttgtttttggacttttaaatagtggtcattctgactagtgtaagatggtatcttactgtggttttgatttgcatttctctgttgattagtgatgataagtgttttttaatatgcttgctggatacttgtatgtcttcttttaaggagtgtctgtttatgtcctgtgcccatttttaaatgaggttattgtttttccttgttgttctgtttaaattccttatagattctggatattagacctttgtcagatgcatagtttgcaaataatttttcccactctgtaggttgtctgtatatttcattaatagtttattttgctgtgcagaagctttttagtttaggtctcatttgtcaatttttgtttttattgcccttgcttttaaggacatagccaaaaaattgtttgccaaggctgatgttgagaaaggtatttcctaggtgttcttctaaaatttttacagattgaggtatcacatttaaaattttaattatcttgagttaattcttctatatggtgaaaggtaagggtccattttaactcttctgcacatggctagacagttacactagtgatacaggaacgagaaagaaattatttaggcagatagtgagggtaaaggaattctcagcaaggcttcccttttaacaaaaagcagccccaaataacttcttttctaacaaagagcagcctgaaaaatgaagcagcagacatagataagcaggctggagacttgcatgtgtgcatgctggcagctgtgccaatagaaaaggggctgactggaagccaggcattttcaacctggaggctccatcttcccttttctttgtcactaataaagaaccaggcaacatggcacaggccaggtagacaaccatctgcataataaaagactagggttgagtggccagcttctttaagcgctatgcaaatggcatgcctagtccgaccaatctttcgtgccctatgtaaatcagacactgccccctcaagctcatctataaaaccttctacatttcactgcagaagcagcaacccatttctccagtacccatccctgggcagagatctcttctctttcttttgcccattaaacttcctgtcttaacctcactctggtgtgttcacgtcctagttttctgtggtcatgggacaacaaacctcagatattaccctagacaacaaggcgatttcatagcatcatttattgtataagcagtccatttatattcctttttttcttgtctgtctttttgaaaatcagatggctgtaagtgtgcagctttatttctgagttttctattctgttccattaggatagatgtctactttgtaccataccatgctgttctgattaccgtagtcttattgtaaaattggaagttggacagtgtaatgcctccagctttcttctttttgcttaaaattgctttagctattcaggctcttttttggttccatatgaattttagaatagtttttttctaattctgtgaagaatggcattggtagtttgataggaattgcactgaatctgtaaattgccttaagcagtaaggccattttaacaatattgatccttccaatacatgagcttggaaagtttttccattaatttgtgttatctttgatttttttcagtagaattttgtagttctccttgtagagatctttcacctccctggtaggctgtatttattcctatgtatttcattttctttgtgtgtatcataaatgggattgtgttttatattttactctcagcctggagattattagtgtatgggaatgctactgcttttgatacattgatttgatatcctgagaccttactaagatcatttatcagttctggtagccttttggcagtctttttctcatcttttagttttaggtttagaatacatgtgagggtttattacataggtaaactcatgtcgtgggggtttatttacaaattatttcatcacccaagtatgaagcccagtacccaatagttatcttttctgctcctctccctcctcccaccactctccactctcaagtaggccccagtgtctgttgtttctttccttgtgttcatatgttctcatcatttaacttgtacttataagtgagaacatgcagtgtttggttttctgctcctgttagttttctgaggataatagccttgatctccaccaacattcccactaaatatataatcttgttcttttttatggctgcatattattccatgatgtttatgtaccacattttctttatccaatctgtcattgatgggcatttaggttgattccttgtctttgctatcataaatagtgctgcagtgaacatttgcatacatgtgtcattaacgtaaaatcatttatattcctctgggtatatacccagtaatgggatggctgggttgaatggtagttcctcttttagctttttgaggaatcaccatactgctttccacaagggtcgaactaatttgcactctcataaatggtgtataagtgttcccttttctccacaaccttgccagcatcttttttttttttttttttttttttactcttatatagtcatttttactagtgtaaagtggtatctcattgtggctttgattgcatttctgtaacgatttgtgacattgagcttttcttcatatgcgtattggctgcatgtatgtcttcttttggaaagcgtctgttcatgttctttgcccactttttaatggagtttgtttttctctcgtaaatttatttatgttccttatagattctggatatcaaacctttgtcagatgcatagtttgcaaatattttctcccattctgtaggttgactgttgactctgttgatagtttcttgtcctgtgtagaaactcttaagtttaattagatcccacttgtcaatttttgcttttgttgcaattgcttttagtgtctttgtcgtgaaatctttgctcattcctatgtccaggatggtattgcctaggttgcctttcagggtttttatggttttgggttttaaatttaagtctttaatccattttgaattaacttttgtatatagtgtagggaaagggttcagcttcattcttctgcatatagctagacagttatcccagcaccatttattgaatagggagtcttttccccatttcttgtttttgccagcttttttgaagatcagatgatcatgagtgtgcagccttatttctgggctctctattctgtttcattggtctaggtgcctgtttttgtgccagtgccatgttgttttggttactatagccctctattatagtttgaagtcaggtaatgtgatgcttctagctttgttccttttgcttaggattgccttagccactgagactctttttggttccagatgaattttaaaatagttttatttatctagttctgtgaagaatatcgtggtagtttgatagaaatagcactgaatttgtaaattgctttgggcagtatggccattttaacaataatgattcttcctatccatgaccatgggatgttttcccatttgtttgtgtcttctctgattactttgagcagtgttttgtcattctcattgtagacatcttttacttccctggttagctttattcctaggtattttattcattctgtggcagttgtgaacaggactgcctttctgatttggctctcagattgactgtttttggtgtacaggaatgttagtaatttttgtatgtcaattttgtatcctgaaactttactgaagttatcagctgaaggagattttggggtgagactatggggttttctagatgtaaaattatgttgcctgcaaaaagagggagtttgacttcctctcttcctatttggatgtcctttatttccttcccttgcctgattgctctggctaggacttctaataccatgttgaataggaggggtgacagaagtcattcttgccttgtgctgattttcaagggaaatgctttcagcttttgcccattcagtatgatgttaactgtgtatctgtcatagacagctctcattattttgaggtatgttccttcaatacctagtttgttaagagttttaaaatgaaggggttttgaatttatcaaaagccttttctgtatctattaaaataatcatttggtttttgtctttagttctgtttatgtgatgaatcacatttattgatttgcatatgttgaaccagccttgaatcctggggatgaagcctgctcaatcatggtgaattagctttttgatgtgctgctgaattttgtttgcaagtgtttcattgaagatttttgcattgatgttcatcaaggttattggcctgaagtatttttttttttttttagacagagtcttgctctgtcaccaggctggagtgcagtggcgccatcttggctcactgcaacctctgcctcccaggttcaagcaattccccagcctcagcctcccgagtaactgggactagaggcacgcatcaacatgcccagttaatattttgtattttaatagagatggggtttcaccatgttggccaggatcctgacttcgtgatccacctgcctcagcctcccaaagtgctgggattacaggcatgagccaccacggctggcctgaagttttctttttttgttgtgtctctaccagttttggtatcaagatgatgctagcctcacagaataacttagggaagagtcccccctcttcaattttttggaatagcttgtataggaatggtaccagctcttctttgtagaacttgtagaatttggctgtgactctattgggtcctgggcttttattggttggtaggctgtttattacagattcaatttcaaagcttgctcttggtctcttcctggttcagtcttggaagggtgtatctgtccgggtgtttatccatctcttctaggttttccactttgtgtgcatagaggtatttgtggtagttttggtggttgtttttatttctggggggtcaatggtaacagtctattcatcattcataattgtgtttatttgggtctattattctagcaagtggtctatctattgtattatttttttcaaaaaacaactcttggacacattggtcttttcaatggcttttggtgtcttgatttccttcagttcaactccaattttggtcatttcttgtcttctgctagctttggggctggtttgttcttgcttctctaattctttcagttgtgatgttaggtggttaatttgagatctaacttttgatgtgtgtatttagtgttatgaatttccttcttaatgctgccttagctgtgtcccagagattctgctatgttgtatcttttttctcattatattcaaagaacatttttatttctgccttaatttcattatttatccaaaagtcattcaagtgcatgttgtttagtttccatgtaattgcatagttttgagcgatttttatagatttgacttctatttttgattgtgctattgtctgagagtgtgcttggtatgattttcattcttttgcatttgctgaggatggttttatgtttaattatgtgactgactttagagtatgtgccatgtgatgatgagaagaatgtatattctgttgttttggtgtggagagttctgttaaggtctatcagatccatttcatccattgttgagttcaggtcctgaatatctttgttaattttctgcctcaataatctgtctaatagtgtcagtgaagtgttggagtctcccactattattatgtgagagtctatctctttttgtaggtctctaagaacttgctttataaatctggatgctcctttgttgggtgcatatatacttaggatagttaggtcttgttgtctaattgaacctttatcattatgtaatgtcctttgtctttttttgatctttgttggtttaaagtctgttttctctgaaattaggattgaaacccctgcttttttctgtttttcatttgcttggtagattttcctctatccctttattttgagcctatgagtgtcattacatgtgagattggacttttgaagacagcatgccattgagtattgcttttttatccatcttgtcactcctctgcctttttagtggggatatttagccaatttacattcaaggttagtattgatatgtgtgttagctggttatgtttgcttgtttgtgtggttgctttatagtgacactggtctgagtgtttaagtgtgtttttgttttagctggtagtggtctttcctttctatatttagtgctcctttcaaaatttcttgtaaggaaatctggtgacaaaaaactccctcaagatttgtatcagaaaagaatcttatttctccttcacttaggaagcttagtttggtcagatatgaaattcttggctgaagatttttttctttaagaacgttgaatacaggcccccagtctcttctggctgtagagtttcagctgagagactggctgttagcctgatggggtttccttgaagttgacctgccttttctcttgaactgactttaacattctttctttcatttctaccctggaaaatctgatgattatatgtcttggggatgatctttttgtgcagaatcttgcaggagttccctgtatttcctgagtttgactgttggcctctctagcaaggttggggaaattttcatagatgatatcccggaatatgttttccacgttgtatgctttctccccctccctttcagggatgctaataattcatagatttggcctctttatatggaatcttatactcctcagaagttttgttcatttctttttatttttgtctgactgtcttatttcagagaaccagtcttcaacttctgagattctttactcagcttgatttactctgttgttaattcttgcgattgcactgcgaaattcttgtactgcgttattcagctctgtcagagctgttaaattcttttttacactggctatttcattgttcagctcctatatcactttactgtgattcttagtttccttgaattgggttttattatcctcttgaaactcaatgatcttcattcgtatccatattctgaattccatttctgtcgtttcagccagcttacctggttaagagctctcgttggataactggggcggttgtctggagacattctggccttttgagttactggagttcttgctttggttctttctcgtctctgagtgtggatggtcccacaatgagataccatctcattgaattttgatttgcatttctctaatgagcagtgatgatgaactttttttcatatgtttgttggccacataaatgtcttcttttgagaagtgtctctccatatcctttcccactttttgatggggttctttgtttttttcttaagttccttgtagattctggatattagacctttgtcagatggatggattgcaaaaattttctcccattctgtaggttgcctgtttactctgatgatagtttcttttgctgtgcaggagatcttcagcttaatgagatcccatttgtcaattttggcttttcctgcaattgtttttggtgttttggtcatgaagtctttgcccatgcctatgtcctggatggtattgcttaggttttcttctagggtttttatggttttaggtcttactttcaagtgtcagatccatcttgatttaatttttgtataaggtgtatggaaggggtccagattctactttctgcatatggcaagccagttttcccagcaccatttattgaacagggaatcctttccccattgcttgtttttgtcaggtttgtcaaagatcagatggttgtagatgtatggtgttatttctgaggcttctgttctgttccattggtatatatagctgtttacttaccagaactatgctattttcattcctgtaaccttgtagtatactttgaagtcaggtagtgtgatgcctccagctttgttctttttgcttaagattctcttggctatacgggctcttctttggctccatgtgaaatttaaagtagttttttctaattctgtgaagaaagtcaatggtaacttgatgggaataccattgaatctataaattactttgggcagtatgtctgtcttcacgacattgaatcttcctatctatgaccatggaatgtttttccatttgtttgtatcctctcttagttccttcagcaagggtttgtagttcttcttgaagaggtctctcatctcctttgtaagttgtattcctaggtattttattctctttctagcaattgtgaatgggagttcactcatgatttggctctctgcttgtctattgttggtgtataggaatgcttgtgacttttgcacattgattttgtatcccgagactttgctgaggttgcttataagcttaaggagtttttgggctgagacgatggggttttctaaatatacaatcatgtcaatggcaaacagagacaatttgacgtccttttttcctatttggatactctttatttctttctcttgcctgattttcctgccagaacttccaatactatgttgaataggagtagcgagagacggcatccttgtcttgtgctggttttcaaagagaatgcttccagtttttgcctattcagtatgatattggctgtgggcttgtcataaatagctcttattattttgagatatgttccatcaatacctagtttattgagaatttttaatatgaagtggtgttgaatcttatcaaaggccttttctgcatctattgagataatcatgtggtttttgtcactggttctgcttatgtgatggattacgtgtattgatttgcctacttctgtcaatttgtctatctcattctccatccagttttgtgcccttgctgaagaagaactgcgatcatttggaggagaagaggcattctggtttttggaattctcagtgtttttgtgctgttttttcttcatcttcatggatttatctacctttgatctttgaggctgatgaccttcagatgggatttttgtggaggggtcctttttgctgatcttgatgctattgttttttttttggttagtttttcttctaacagtcaggcctctcttctgcagatctgctgcagtttgctagaggtccactccagaccctctttgcctgagtatcaccagtggaggctgcagaacagcaaagattactgcctgctccttcctctggaagctttgtcccagaggggcaccgaattgatgccagctggagctctcctgtatgcagtgtctgttgacccctgttgggaagtctctcccagtcaggaggcatgggggctcagggacccacttgaggaggcagtctgtcccttagcagagctggtgtgctgtgctgggagaatccctcttgtcaggattagttggtctcttcagagccagcatgcaggagagattaaatccgctgaagctgcatccacagccgccctttcgcccagctgctctgtcccagggagacgggagtttatctgtaagccccatggggctgttacctttccttcagagatgccctgcccattgaggaggaatctagagaagcagtctggccacagatgctctgctgcactgtggtaaattctgcccagtctaaatgtcctagcctccttagcactatcaggggaaaactacctactaaagcctcagtaatggcagatgcccctccccccaccaagctggatcatcccaggttgatttcagaatgctctgctggcagtgagaatatcaagccagtggttcttagcttgctgagctccatgggagtgggacccactgagcaataccactgggctccctggcttcagccccctttccagggaagtgaacagttctgtcttgctgaggttccaggtgccactggggtatgaaaaaaactcctgcagctagctcagtgtctgcccaaacagccacccagctttgttcttaaaactcagggcccaggtggcgtaggcacatgagagaatctcctgatctgcagattgcaaaaaccatggcaaaagcataggaaaacatgtagtatctgcaccagatagcacagtccctcatggcttcctttgactgtgggagggaggttcccccggctccttgcacttcccaggtgaagtgatgccccaccctgcttctgctcaccctccatgggttgtacccagtgcctaaccagtaccaatgagataaactgggtatctcagttggaaatgcagaaatcacctgccttctgcattggtgtcaataggaattgcagactggagctggcctgaaatcctgtattgtcattctttgtccttcatttttgttggtttaaatctttttttctgatgtgataatatgactcccgttctttgttttttttttctttcctggttgcatggcagtccttattctatccctttattttaagactgtgggtgttgttacttgtgagatgagtctcttgaaggcagcagatggttggttattttctttttatccagcttgccactctgtcttttaagtgggttgtttagcctgtttacattcatggttagtattgatatgtgtgattttgaaaccgtcaccatgtggtcagcaggttgttatgtagatttgattgtgaatttgctttatagtacttatgggccataagtttaagtgtgttttgtggtagcaggtgtcaatcttttagttccaagtttagctctcccttaataacctcttgtaaggccgatttgtttaaaaaaattccctcaaaatttgcttgagaaggatttttttccacttaagaagcttagttcagtggaatatgaaattcttggttggaattttttccttctgggtgctgaaaatatgcccccaatatcttctggcttctaaggtttctgctgagatgtctgctggtagcctaatggcatcccctctgtctgtgacttcacccttcaatctagctgcctttaagatacttttcttttgtattgacattgtgaatttgatgactatgtgccttcagtctggtcattgtgtatagtatctcattgggattccctatatttattagattgtgtgtcaacctctctagtgagattagggaaattttcttggactatgtcctcaaatatgttttctaagttgtttattctctctcctcctctcgaagatgccaaggagttgtagattttgtctctttacataatcccacatttcttgaaggatttgttcaatttttaaaattcttttttctgtatttttgtctgactgagttgatttgatgatctggtctttgagttcagagattatttcctcagtttggtccattctgctgttagtacttctgattgtattataaaatactgtagtgaaatttttagctccagaagttcagtccagttatttctcaaaatgactatttcatctttcagctcatttattgtcttactctatttgttggattccttggattaggtttcaactttcttgtgaatcttgatgagttttcttgccatccagattctgaattctatgtttgtccagtcatttctgactggtgaagaactattgcgggggagctagtggactagtttggaggtaagagagaactctggctgcttgaattgccagagttcttgcaccagttttttctcatctgggaggacggatgttcttttaactgtggggtaagtttagtcacttggcttcatttctgaaaactttcaatgggacacacagggaagacagtttggctgtctctccacagggtggctgcgatgtattggaggcatgaacaaagaagcaaagcaatcagggtatttgttccttctccagcccaggaacagcaagggtgggtaccacagtaggcagtcatagaggggctctcagttgcctctgggagaatcacagatccactaccaatcagagtaatcatccagggctagggtgtctgcactgcaggcccaagccagagggctatgcctggcaaaaccagaagggtcagagactatcggggaagatgagctgtcctctttgtaggatggccactggcactttaattgcctgaaattagtcagactctttgtatcctccatatcctagggggagaagggactggaatcactgtggaggcaatggcagagagcctgatggttgcctctgggagttccactttagagcaatacaggacggccattgccattgaataaagtgatcaggcaggggaaaggcagctgcattgggccccaggccaggagatcctgcccagtaagatgtagcagggtcgagaagccatgtggacaatggcctggccacttttccatatggcagtgcagcacgctggaggccaatgacagttcttgggctattcactccatccccagcctgacggcagcagtggcagggagcatgacagcagcattcacagcaagcctgtcagttacatctgggagctccattacagagaaataaagagctacaaccagctgtagtgctcaggcaggaatggagtggctacatcatggtaacaggccaattggctttgcttggagagatgcagcagaggcaaggcctgaagtccatctgctcctcagcactgtggatgtggccaataacatgagggtatttaagactgcctgacaactcttgttgggaggcctatgggatctgttgctgaggtcctcaacaacagaggaccttgcattccttgaggaatgcaagacctatgggactacacatgggcctgagaagcctctctacccagatagcaggcagatcttcatgttggtctgaaggctaggggagagaaagcagttagaggggatctcccatgcccaggaatgaaagttctgttgcagaagtgttggtcccctgggattcttgctcactcaccctttctccatggtagaaaggtccccttggctctgtacctatcccaggccaggagagagagaatattgaaatcagtaagaaatgacataatcgaatacaggggaaactacataatactatcagcaaacattttaacaaaaattttgcaagacaaaagacagtgggctgatatattcaaagtgctgaaaaagaaaaaaatcttcaaaccaaaatactaaacctggaaaaactgttcttcaggaatgaaaggaaaataaagacatttccagataaacaaaagctgagggagttcaccaccactagacttgccttacaagaaatgctcaagagaatttccacagttgcaatgaaataacgctaattaataacattaaaaacaaaaataaaaaaactcacttgtaaaggtaaatatgtagtcaaattcagaatactctaatactgtaatagtcgtgtaaatcatttatattactagtataaacttaaaagacaaaactatcaaaaagacttatacctacaataatttgttaaaggatacacaacatttaaaaatgtaaattgtgcatcaaaaacattaaatgagggaaaaagtgtagagttgtgatatgcaatcaaactggagttgttattagtttaaaataaattggcataactgcaagattttctatgttagcttcattttaatcacaaatcaaaaacctatagcagatacacaaaagaaaaagagaaagaaatcaaaacatactgatatggtttggctctgtgtccctacccaaatctcatctcaaattgtaatccccataatccctacatgtggagggcaggacctggtgggaggtgattggatcataagggcagttgctcccacgctgttctcatgatagtgagtgagttttcacttgagatctgatggttttataaggggctcctcccccttcacttccttcacgtgttctctcccttgtcaccatgtaagacatgcctgcttacccttctgctgtaattgtaagtttcctgaggcctccccagccatgcagaactgtgagtcaatgaaacctctttattttataaattacccagtctcaggtagtatttttatagcagtgtgagaatggattaatatatataccattacagaaaataataaaatcacaaaagtataaaaaaagagaaaaagaaaggaacaaaagatctccaaaaaaccacaaacaataaaatggtagtagcaaatttttttctatcaatgattaccttgaatcaagaaagaatgaactattcaatcaaaagacatagattggctgaatggaaaaacaagacacccagctatatggtgcctacaagagacccatttcagcttaagtacaaatgtagactgaaagggaaggaataaagaaagataattcatgcaaatagaaaccaagagacagcaggaatagctatacttctatcagacaaaataaactataactcaaaaactgtaatatatacacttagcaagagatcacctaaatatataggccaaatattaataggtctgatgaggaagatagatagcaatacattaatagtagaggatttcgatatgtcaattcaataacagattactcagacagaaattcaataatacacaggacttgaaatgaactttaaaccaaataagtctatcagacatatacagaacatttcatcccaaagcagaagaataaacattcttatgaagcgcacataagtcattctccaggatagattacatgtcaggccacaaaaaagtcttcaaaaattttaaaaagattgaaatcatactaagcattttttctgaccacaaaggtatgagatgaaaaaccattaacagggtgagattttaaaaatcccgaaatatgcagaaagtaaacaacatgctcctgaataaccaatggatcagagaagaaatcaagaaggaaataaaaaagatcttgagactgacaaatgaaaatggaaatagtaaaacttatggtatgcagaaaaaacagttctaggagaaaatttatagcaataaacacctacataaaaaagaagaaagatctgaaataaagaattcaattttacaactcaaggaactagatgaagaacaacaaagcataaattttgtagaagaaagaaaataataaagaacaaattagaaatcaacgaaataacctataaaacaatagaaaagttaatgagcttaagagttagttttttgagaagataaatgaaattgacaaacatttagttagactaagaataaagggagaataatcaagtaaataaaatcagacatgaaagaggcagcattataacttacattgtataaatgtacagtgccataaaagactattgtgaacaattatacatcaaatagttggataacttggaagaaactgatatagtccttgaaacatacaatctattaagaataaatcactaagaaatagaaaatatcaactgatcaataattagtaagggcattgaaaaagtaatcaagatttctcaaggactgcagggcttgacagctttataacaaacatttaaataatagctgataccattggcctacatacctactttttttttttttttaactagtaccatgttgtttgggtaactatagcctggtagtatagtttgaagtaaggtaatgtgatgctctagatgtagtttttatttatttatttatttatttttattatactttaagttctagggtacatgtgcacaacgtgcaggtttgttacgtacatatacatgtgccatgttggtgtgctgcacctgttaactcgtcattaacaggtatataacattaagtatatatcgatatatcgatataacattaagtatatctcctaatgctatccctcccccatccccccaccccacaataggccccaatgtgtgatgttcctcatcctgtttccaagtattcccattgttcaatccccagctatgagtgagaacatgcggtgtttggtttcctgtcctttcgatagtttgctgagaataatggtttgcagcttcatccatgtccctacaaaggtcatgaactcatcctttttaatggctgcatagtattccatggtgtatatgtgccacattttcttaattcagtctgtcattgatggatatttgggttggttccaagtctttgctattgtgaatagtgccacaataaacatacgtgtgtgtgtgtctttacagcagcatgatttataatcctttcggtatatgcccagtaatgggatggctgggtcaaacggtatttctagttctagatccctgaggaatcaccacactgttttccacaatgattgaactagtttacactcccaccaacagtgtaaaagtgttcctatttctccacatcctctccggcacctgttgtttcctgactttttaatgatcatcattctaactggtgtgagatggtatctcattgtggttttgatttgcatttctctgatggccagtgatagtgagcattttttcatctgtctgttggctgcataaatgtcttcttttgagaagtgtctgttcatatcctttgcccactttttgatggggttgtttgattttttcttgtaaatttgtttgagttctttgtagattctggatattagccctttgtcagatgggtagattgtaaaaaatttctcccattctgtaggttgcctgttcactctgatggtagtttcttttcctgtgcagaagctctttggtttaattagatcccatttgtcaattttggcttttgttgccattgcttttggtgttttagtcatgaagtccttgcccatgcctatggcctgaatggtattgcctaggttttcttctagggtttttatggtttgaggtctaacatttaagtctttaatccatcttgaattaatgtttgtataaggtgtaaggaagggatccagtttcagctttctacatatggctagccacttttcccagcaccatttattaaatagggaatcctttcgccatttcttctttttgtcaggtttgtcaaagatcagatggttgtagatgtgtggtattatttccgagggctctattctgttccattggtctatatctctgttttgataccagtaccatgctgttttggttactgtagccttgtagtatagtttgaagtcaggtagtgtgatgcctccagctttgttcttttggcttaggattgtctcggcaatgtggactcttttttggttccatatgaactttaaagcagtttttttccaattatgtgaagaaagtcattggtagcttgatgggaatggcattgaatctgtaaattaccttgggtagtatggccattttcacaatattgattcttcctatccatcaacatggaatgttcttctatttctttgtgtcctcttttattttgttgagcagtggtttgtagttctccttaaagaggtccttcaaatcccttgtaagtaagattcctaagtattttattctctttgaagcaattgtgaatggagttcactcatgatttggctcctgtttgtctgttattggtgaataggaatgtttatgatttttgcacattgattttgtatcctgagactttgttgaagttgcttatcagcttaaggagattttgggctgagatgatggggttttgtaaatatacaatcatgtcatctgcaaacagggacaatttgacttcctcttttcctaattgattaccctttatttccttctcctgactaattgccctggccagaacttccaacactatgttgcataggagtggtgagagagggcatccttgtcttatgccagttttcaaagggaatgcttccagcttttgcccattcggtatgatattggctgtgggtttgtcataaatagctcttattattttgagatatgccccatcaatacctagtttattgagagcttttagcatgaaaggttgttgaattttgttgaaggccttttctgcatctattgagataatcatgtggtttttgtctttggttctgtttatatgatggattatgtttattgatttccatatgttgaaccagccttgcatcccagggatgaagccaacttgatcgtagtggataagctttttgatgtactgctggattcagtttcccagtattttattgaggatttttgcatcgatgttcatcagcgatactgatctaaaattccttttattgtgtctgtgccaggctttggtatcaggatgatgttggcctcataaaatgaattagggaggatttcctctttttctattgattggaatagtttcagaaggaatggtaccagctcctccttttacctctggtagaatttagctgtgaatccgtctggtcctggactttttttggttggtaggctattaattattgcctcaatttcagaacctgttattggcctattcagggatacaacttcttcctggtttagtcttgggagggtgtatgtgtccaggaatttatcgattttttctagattttttagtttatttgcgtagaggtgtttacagtgttctctgatggtagtttgtatttctgtgggatcggtggtgagatcccctttatttatttattcatttatttattttgcatctatttgattcttctctcttttcttctttattagtcttgctagcgatctatcaattttgttgatcttttcaaaaaaccagctcctggattcattgattttttgaagggttttttttggctctatctccttcagttctgctctgatcttagttatttcttgccttctgctagcttttgaatgtgtttgctcttgttttttagttcttttttttgagatggagtcttgctctgttccccaggctggagtgcagtggcgtgatctcggctcactgcaacctccacctcctgggttcacgccattctcctgcctcagcctcccgagtacctgggactacaggcacccaccacgtctggctaattttttatgttttcagtagagacaggatttcactgtgttagccaggaaggtcctgatctcctgacctcgtgatccacctgccttggcctcccaaagtgctgggattacagatgtgagccaccgtgcccagcgaattttctagttcttttagtggtgatgttagggtgtcaattttagatctttcctgctttctctcgtgggcatttagtgctacaaatttccctctacacactgctttaaatgtcccagagattcttgtacattgtgtctttgttctcattggcttcaaagaacatctttatttctgccttcatttcgttatgtactcagtagtcattcaggagcaggttgttcagtttccatgtagttgagcggttttgagtgagtttcttaatccttcgttctagtttgattgcactgtggtctgagagacagtttgttataatttctgttcttttacatttgctgaggagtgcttcacttccaactatgtggtcaattttggaataagtgtgatgtggtgctgagaggaatgtatattctgttgatttgaggtggagagttctgtagatgtctattaggtccgcttggtgcagagctgagttcaattcctggatatccttgttaacttcctgtctcattgatctgtctaatgttgacaatggggtgttaaagtctcccttattattgtgtgggcgtctaagtctctttgtaggtctctaaggacttgctttatgaatctgggtgctcctgtattgggtgcatatatatttaggatagttagctcttcttcttgaattgatccctttaccattatgtaatggccttctttgtctcttttgatctttgttggtttaaagtctgttttatcagagactaggattgcaacccctgcatttttttgttttccatttgcttggtagatcttcctccatccctttattttaagcctatgtgtgtctccgcacgtgagatgagtctcctgaatacagcacagtgatgggtcttgactcttcatccaatctgccagtctgtgtcttttaattggagcatttagcccatttacatttaaagataatattgttatgtgtgaatttgatgctgtcattatgatgttagctggttattttgctcgttagttgatgcagtttcttcctagcattgatggtctttacaatttggcatgtttttgcagtggctggtaccagttgttcctttccatgtttagtgcttccttcaggagctcttttagggcaggcctggtcgtgacaaaatgtctcagcatttgtttgtctgtaaagtattttatttctccttcacttatgaagcttagtttggctggatatgaaattctgggttgaaaattcttttctttgagaatgttgaatattggcccccactctcttctggcttgtagagtttctgccgagagatctgctgttagtctgatgggcttccctttgtgggtaacccgacctttctctctggctgcccttaacattttttccttcatttcaactttggtgaatctgacaattatatgtcttggggttgctcttctcaaggagtatctttgtggtattctgtgtatttcctgaatttgaatgttggcctgcctcactaggttggggaagttctcctagataatatcctgaagagtgttttccaacttggttccattctccccatcactttcaggtacaccaatcagatgtagatttagtcttttcacatagtcccatatttcttggaggctttgtttgtttctttttactcttttttctctaaacttcttttctcgcttcatttcattcatttgatcttcaatcactgatatcctttcttccacttgatcaaatcggctactgaagcttgtgcatgcatcacatagttctcgtgccatggttttcagctccatcaggtcatttaaggacttctctacactgttgattctagttagccattcgtctaatttttttcaacgtttttagcttctttgtgatgggttcgaacatcctcctttagcttagagaagtttgttattactgatcttctgaaggcttcttctctcaactcgtcaaattcattctccatccagctttgttccattgctagtgaggagctgtgttcctttggaggagaagaggcactctgatttttagaatttttggcttttctgctctggtttcttcgcatctttgtggtttttacctacctttggtctttgatgatggtgatgtacagatggggttttggtgtggatgtcctttttgtttgttagttttccttctaacagtcaggaccctcagctgcaggtctgttggagtttgctggaggtccaccccagaccctgtttgcctgggtatcaccagcagaggctgcagaacagcaaatattgcagaacggcagatgttgctgcctgatacttcctctggaagcttcgtctcagaggggcacctggctgtatgaggtgtcagttggcccctattgggacgtgtctcccagttaggctactcgggttcagggacccacttgaggaggcagtctgtccgttctcagatctcaaactccgtgctgggagaaccactactctcttcaaagctgtcagatagggatgtttacatctgcagaagtttctgctgccttttgttcagctacaccctgcccccagaggtgcagtctacagaggcaggcaggcctccttgagctgtggtgggctccacccagtttgagcttcccagccactttgtttacctactcaagcctcagcaatagtggacgcccctcccccagcctcactgccaccttgcagtttgatctcagactgctgtgttagcagtgagtgaggctccatggcatgggaccctccgagccaggcgcaggatataatctcctggtgtgccacttgctaaggccattggaaaggcacagtattagggtgggagcgccccaattttccaggtactgtctgtcacagcttccctttgctaggaaagggaattccagaccccttgcgcttcccgtgtgaggtgatgccccaccctgctctgtgggctgcacccattgtctgataagccccagtgagatgaacccggtacctcagttggaaatgcagaaatcacccgtcttctgcactgctcatgcttggagctacagaatggagctgttcctatttggccatcttggaacctcctttatttttatttttattttttgcttagtcttgctttggctatgtgggctctgttttggattcaagaatttggtgtcaatgtggtgaaaagggagcacttttacactcctaatgggactataaacttgtacaaccactatggaaaacagtatggagattccttaaagaactataagtagaagtgccatttgatccagcaatcccactactgggtatctacccagaagaaaagaagtcattacatgaaaaagacacttctacatgcatagaactagcctaaatgcccatcaaccaaggagttgataaagaaaatgtggtatatatatatattatacgcacacacacacacacacacacacacatacacacacaccctggaatactactcgctcataataagaaaaaaaataatagcattcgcagcaacttggatggagctggagaccattattctaagtgaagtaactcagaaatggaaaatcacttatgttttcacttataagtgggagctaagctatgaggacacaaaggcatatgaatgatataatggactttgcggattcaggggaagggtaggaggggggcaaggaataaaagaatacatactgtgtacagtgtacactgcttgagtgatgggtgcaccaaaatctccgaaatcaccactaaataacttatccatataaccaaaaaccacctgttctcccgaaactattgaaatataattaaatttaatctaatttaaaaagaagaactaatactaatccttcacaaactcttctaaaaattcaaagaggagggaatactttctaactcattttatgagtccagcattaccctgatactaaagcaaaacaagcacactacaaaaagaaaataacaggaaataacaggacaatatccctaatgaacatagatgcaaaaatcttcaacataatagtaccaaattgaatttaacagcatgttaaaaggatcatttaccattattaagtgggatgtattactggaatgcaagtgtagttcaacctatgcaaatcaataaacataatacaccattttaatggaataaatgacaaaaaactatatggtcatctcaatagatgcagaaagacatttgacaaaatttaacatctttttaaaataaaaactatcaacaattaagtatatataaaatacatctttacataattaaagggcatatatgacaagcccacagctaacatcatactccattgtgaaaaattaaaagatatttctaatttcaggatcaaaacaaggatattcactctcaccatttttagtcaacatagtactgaaagttctagccatagcaattaggctaaaaaaaattaaaggtacccaaattggaaagaaaaaggttaaattggctctgcagacaacttgattttagatacagaaaaccataaagtcttaaccaaaaaactgttacaaataatcaattaattcagtaaatttacaggataccaaaacaacatacaaaaattaataatgtttcaatgcactaatagtaagccatttgaaaaaaaattgagaaaacaatctcactttacaaaagcattaaaaaatgcttaggaatatagttgaccaaaaaagtaaaagatctgtacactgaaaactatgtaacaatgatgaaaaaaattgaagaagacaaaaataaatagaaagatatcctgttttcatgaactggaataatcaatattattaaaatgttcgtaacacccaacacaacctactaattcaatgtaatcttcatcagtatcccagtggcatttttactgaaatagagaaaaatagtcttaaaattcatataaaatcacagaagacctcaaatagccgacatcttcagcagaaaggacaaagctgaaaatatcactattttagttcaaatttgctacaaaggtgaataatccaaacagcttggtattggcacaatagagatatgtagaccaactgaacagaatggagatcctagaagtaaatccacacatttatggtcaacttgctttcaacaagtgccaagaaaacacaatagacaaaagacaatcttttcaataaatagtgtaaaggaaactagatattcacaagcataaaaaagaaatgggacccttttcttatcctttataaaaaatcaacacaaaataaacaactaaatgtaagacatgaagctgtaaaactactaaaggaaaacacaatgaaaaatcttcttgacattgatctgggcaaagacattttgacattacctcaaaacaaaagcaagagggtggctggcaagatggccaaataggaacagctcctgtctgcagctcccagcaagatcaacacagaaggtgggcgattcctgcatttccaactgaggtagccagttcatctcattgggactggttagacagtgagtgaatcccacaaagagcgagctgaagcagggtggggtgatgcctcacctgggaagtggaaggggtcggaaaactcactcccttagccaagggaagctgtgagggactgtgccatgaggaatgatgcactccagcccatatactaggcttttcccatggtcttcacaacttgcagaccaggagattctctcaggtgcctacaccaccagagccctgggtttcaagcacaaaactgggtggccatttgggcgggcaccgagctagccgcaggagtttttttcacaccccagtggtgccttgaacacctgcaagacagaaccattcactcccctggaaaggcggctgaagccagggagccaagtggtctagctcagtggatcccacccccacggagcccagcaagctaagattcactggcttgaaattctcactgccagcacagcagtctgaagttgacctgtgatgcttgagtggggaggggcatctgccattattgaggcttgagtaggtggttttccccttacagtgtaaacaaagccaccaggaagttcgaactgggtggagcccaccacagctcagcaaagcccctgtagccagactgcctctctagattccgcctgtctgggcagggcatctctgaaagaaaggcagcagccccagtcaggggcttatagataaaactcccatctccctgggacagagcacctgggggaagggtggctatgggtgcagcttcagcagacttaaatgttcctgcctggcagctccaaagagagcagcagatttcccagcacagcgctcgagctctgataagagacagactgcctcctcaagtgcgtccctgacccccatgccgcctgactgggagacatctcccagcaggggtgacaaacacttcatacaggagagctcctgctggcatctagcgggtgcccttctggggcgaagcttccataggaaggaacaggtagcaatctttgctgttctgcaacctccactggtgatacccaggcaaacagggtctagagtggaccttcagcaaactgcagcagacctgcagcagaggggccagactgttagaagaaaaactaacaaacaggaatagcatcaacatcaacaaaaaggatgtccacaccaaaaccccaaaggtcaccaaaaatccaaaggtcaccaacatcaacgaccaaatgtagataaatccatgaagatgaggaaaaactggtgcaaaaaggctgaaaactctaaaaaccagaatgcctcttcacctccaaaggatcacaactcctcgccagcaagggaacaaaataagggagaatgagtttgacgaattgacagaataggcttcagaaggtgggtaataacaaacttctctgagctaaaggagcatgttctaacccaatgcaagaatgctaagaaccttgaaaaaaggttagaggaatagctaactagaataactagtttagaaaggaacataaatgacctgatggaggtgaaaaacaccccaagagaatttcgtgaagcatatacgagtagcaatagccaaatcgatcaagtggaagaaaggatatcagagattgaagataaacttaatgaactaaattgtgaagacaaaattagagaaaaaagaatgaaaaggaacaaacaaaccctccaagaaatacgggactatgtgaaaagaccaaacctccatttcattggtgtacctgaaagtgatggggagaatggaaccaagttggaaaacactcttcaggatattatccaggagaacttcccgaatctagcaagacaggccaacattcaaattcaggacatacagagactaccacaaagatactcctcaagaagagcaatcccaagacacataatcatcagattcaccaaggttgaaattaaggaaaaaatgttaagcacagccagagagaaaggtcgggttacccacaaagggaatcccatcagaccaacagcagatctctctgcagagaccctacaagccagaagagagtgggggccaatactaaaccttcttaaagaaaagaattttcaacccagaatttcatatccagccaaactaggtttcataagtgaaggagaaaaataatcctttacagacaagcaaatgctgagagattttgtcaccactaggcctgcctcacaagagcttctgaaggaagcactacgtatggaaaggaaaatctagtaccaaccatgcaaaaacacacaaaaatataaagaccaatgacactatgaagaaactgcatcagctaatgtgcaaaataatcaggtagcatcataatgacaggattaaattcacacataacaatattaaccttaaatgtaaatgggctaaatgccccaattaaaaggcacagattggcaaatggataaagaggcaagacccattggtgtgttgtattcaggggacccatctcacatgcaaagacacacataggctcaaaataaaggggtggaggaagatttaccaagcaaatggaaagaaaaaaaaagggagggtttgcaatcctagtctctggtaaaactgactttaaaccaataaagatcaaaagagacaaaggccgttacataatggtaaagggatcaattcaacaagaagatctaactatcctaaatatatattcacccaacacacgagcacccagattcataaagcaagttcttagagacctacaaagagacttagactcccacacagtaatagtgggagactttaacaccccactcttaatattggacagatcaacgacacagaaaattaataaggatattcaggacttgaactcagctttggaccaagaagaccaaatagacatctacagaactttccaccccaaatcaacagaatatacattcttctcagcaccacatcacacttactctaaaattgactacataattggaagtaaaacactcctcagcaaattcaaaagaacagaaataataccaaacagtctctcagaccatagtgcaatcaaattagaactcaggattaagaaactcactcaaaattgcacaactacatggaaactgaacaaccttctgaatgactgctgggtaaataacaatattaaggcagaaataaataagttctttgaatccaatgagaaaaaagacacaacataacaaaatctctgggacacagctaaagcagtgtttagagggaaatttatggcactaaatacctacaggagaaagtgggaaagagctaaaattgacaccctaatatcacaatgaaaagaactagagaaacacaagtacacaaattaaaaagctagcagatgacatgaaataactaagatcagagcagaaccgaaggagataaagacaaaaaaaaccttcaaaaaataaatgaatccaggaggtggttttttgaaaagatgaacaaaaaacatagaccactagccagactaataaagaagaaaagagagaagagtcaaatagacacaataaaaaatgataatgggaatatcaccactgatcccacggaaatataaattatcatcagagaatactataaacacctctgtgcaaataaactagaaaatttagaagaaatggataaattcctggacacatacaccctcccaagactaaatcaggaagaagtcaaatccctgaatagaccaataaccagttgtgaaattgaggcagtaattaatagcatacctaccaaaaaaagcctaggaccagacggattcacacccaaattctaccagaggtacaaagaggagattgtagcattccttctgaaactattccaaacaatagaaaaagagaaactcctccctaactaattttatgaggccagcatcatcctgacactcaaatttggcaaagacaacaaaaaaaaagaaagtttcaggccaatatccctgatgaacatcgatgtgaatgtcctcaataaaatgctggcagaccaaatccagcagcacatcaaaaagtttatctaccacgatcaagtcagcttcatccctgagatgccaggctagttcaacatatgcaaatcaataaatgtaatccattacataaacagaaccaatgacaaaaacacatgagtatctcaatagatgcagaaaaggccttcaataaaattcaacacaccttaatgctaaaaactcactaaactgggtattgatggaatgtatctcaaaataataagaagtatttatgacaaacccacagccaatatcatactaaatgggcaaaagctggaagcattccctttgaaaactgacacaagacaaggatgccctctctcaccactcctgttcaacatagtattggaagttctggccagggaaatcaggcaagataaagaaataaagagtattcaaataggaagagagaaagtcaaactgtctctgtttgcagaagacatgattgtatatttagaaaaccccattgtctcagcccaaaatcttaagctaataaataacttcaggaaagtctcagcatacaaaaatcaatgtgcaaaaatcacaagcaatcttgtacaccaacaatagacagagagccaaattatgagtaagctcccattcacaattgctacaaaagagtaaaatacctaggaatacaacttacaagggatgcaaagggcctcttcaaggagaactacaaatcactgctcaaggaaacaagagaggacacaaacaaatggaaaaacattccatgctcatggacagcaagaatgaatatcgtgaaaatggccatactgcccaaagtaatttatagattcaatgctattcccatcaagttaccattgactttcttcacagaattagaaaaaattactttaaatttcatatggaaccaaaaaagagcctgtatagccaagacaatcctaagcaaaaagaacaaagttggagccatcatggtacctgacttcaaactatactaacaaggctacaggaaccaaaacaacatggaactggtaccaaaagagaaatatagatcagtgaaacagaacagaggcctcagagataacgccacacatctacaaccatcttatctttgacaaacccgtcaaaagcaagcgatagggaaaggattccctatttaataaacggtgttgggaaaactggctagccatatgcagaaaactgaaactggaccccttccttacaccttatacaaaaattaactcaagatggattaaagacttaaatgtaagacctaaaaccctagaagaaaacctaggcaataccattcaggacataggcatgggcaaatacttcacgactaagacaccaaaagcagtggtaacaaaagccaaaattagcaaatgggatctaattaaactaaagaccttctgcacagcaaaacaaactatcatcagagtaaacaggcaacctacacaatgggagaaaatttttgcaatctatccatctgacaaagagctaatattcagaatctacaaggaacttaaacaaatgtacaagaaaaaaaaacaagcaatcccatcaaaaagtgggcaaaggatatgaagagacacttctcaaaagaagacatttatgtggccaacaaacatatgaagaaaagctcatcatcactggtcattagagaaatacaaatcaaaaccacaatgagataccgtctcatgccagttggaatggcgatcattaaaaagtcaggaaacagcagatgctggagaggatgtggagaaataggaacgcttttatactgttggtgggagtgtaaattagttcaaccattgtggaagagagtgtggcgatttctcaaggatgtagaatcagaaatatcatttgacccagcaatccccttactgggtatatacccaaaggattataaatcattctgctataaagacacatgcacatgtatgtttatggcagcactgttgacaatagcaaagaattggaaccaacccaaatgctcaccaatgatagactggataaagaaaatgtggcacatatacaccatacaccatggaatactatgcagccataaaaaaggatgagctcatgtcctttgtagggacatggatgaagctggaaaccatcattctcagcaaagtaacacaggaacagaaaaccaaacactgcatgttctcactcattaagtgggagttcaacaatgagaacacatggacacagggaggcaaacatcacacactgagagctgtcggggagtggagggctaggggaaggatagcatttggagaaatacctaatgtagatgacgggttgatgggtgcagcaaatcagcagggcacatgtatacctatgtaataaatctgcaagttctgcacatgtatccccagaacttaaagtgtaataataaaaaaagcaagagacaaacaaaattacatcaaacgtaaaaagctactgcactgaaaaagaaaaaaaaaacaacagagtaaagaggcaatctaaaaaattagggaaaatattttcaaaccatatgtctgacaaaaggttaataatcaaaatatataaggaactaaacaactcaataaaaaatatattaaaaatggacaaagaacctgaaaatgtatttcttaaaagaagatatacaaatggccaacagatatataaaaacatgctcaacatcactaatcatcaggaaaatgcaaattacaaacaggataactaatcatttgacatctgttaggaaggctgttataaaaaaaacaaaagatgtcacatgttcattaggatatgaaaaaaagggaacccatgcacattcttagtggaaatgtaaattagtacagtagtaatgaacaacagtgtggagatttctcacaaaattaaaaaataaagctaccatatgatccaacaattcaactactggttatatttccaaagggaagcatattaatatatcaacaatctatctccttgtccacgtatattgcagcattatttaagatagccatgaaatgtaatcaaactaagcgtttatcagtggatccatagataaagaaaatgtggtatgtacaaacaaaggaatatgactcagccttaaaagagaaggaaactgtcatttgtgacaacataaatgaatctagaggacatccagctaagtgaaaaatgccagccatataaagacatatatcatatgatctaacatggatgtatattccaaaaacagttgaactcatagaaatagcgacaagaatagtattaagtctatagattactttgggccatatggccattttaacattattgattcttcctacccatgaacatggaatttctttttattagtttgtgtcatctatgacttctttagcagtgttttctatttctcttcatagatatttttcaccacctttgttagatgtattcctaggtatgttgtgtgtgtgtgtgtggctgttataaatgggattatgttcttgatttggctctcagcttgaatattatcggtatatagaaatgctactgatttttgtatatttactttgtttcctgaaaattgattaaagccacttatcagtgcaagggttcttttggagcagtctttagggatttctgggtatcaaatcacataatctgcaaagagaggtagcttgacttcttcttttcttatttggatgtgttttatttatttctcttccctgattgctctggctaggaattccagtcctatgttgaataggagtgatgagagtgggcatccttgtctttttctagttttcaagggaaatgcttctagttattgcctattcagtatgatattgcctgtggtttgtcatagatagctcttctcattttgagatatgttccttcagtgcctagtttgttgtgagtttttatcaagaagccatgttagatttcatcaaaaaatttttctgcatctgttgagatgatgatattttttttgtttttgattgtttatgtggtaaatcacatgtatggatttgcatatgttgagtcaaacttgcattccaagaataaagcccacatgattgtggtgaattgttttttttgaggtactgctgaattcagtttgctagtattttcttgaggatttctgtatctatgttcatgagggatattggcctgcagatttctttttctgatgtgtctttgtctcgtttggtaccagggtaatattggcctcatagaatgagttgaagcttattacttcctcctctattttttcagaatagtgtgagtaggattggtattagttctttaaatatttggtaaaatttatcagtgaagccatcaggtctcaggctattctttgctggaagactttttattgcagctttgatttcattatttgttattggtctattcaggttttgaatttctttatggttcaatcttgggaggttatatgtgtttatgagtttatccaactttaagttttcaaattcattggcatatagctgctcagagcagtctctaatgattctttaaatttctgcagtgtcagttgtattgtctccttgttcatctctgatttttttattttggtcttctttctttttttcgtagtctggctaaaagtttgtcaattttgtttatctttttgaaaaacaaactttttgattaatcttttgtattttttaaaatttcaatttcacttattgcaagtctgatttttattatttctttccttctaattttgggtttggtttgctttcacttttctacttcaagatccattgttgggttgtttatttgaagtttttctacatttttcatgaagttgcttattactctaaactttcctcttagcactacttttgttgtatcccataagttttgttattgtatatttccattttcatttgtttcaaaataattttgtattcccttcttaatttcttcattgacttactggtcattccggagcatattgcttaatttttatgtatttgtatagtttccaaagttcctcttgttgtcaatttctagtttattccactgtagtcagaaaacatacttgctatgagttcaatttttttgaattttttaaagtcctgttttgtggtctaacatttgaaagaaacaaatataatctattcctattctactttttatatttcatatagaacttctagaaattaaaatgcaatactggatggatgggcgcagtggctcacacctgtaatcccagcactgtggaaggccaaaacgggcagatcacctgaggtcaggagttccagatcagcctgaccaacatggagaaaccctgtctctactaaaaatacaaaattagctgggtgtggtggtgcatacctgtaatcccagctactcaggaggctgaggcatgagaatcgcttaaagctgggagccaggggttgaggtgagctgagattgcaccattgcactccagcctgggcaacaagagtgaaactcaaaaaaaaaaaaaaaatacaatactggaaataaaaacatcataaacaagataaatactagattagattacacaatgcaaaagaataaatcagggataagaactatccagaatgaaaacagaagaaagcttcaaaaatatgtaaaaggaccgaacagtaaagaattagtggttagacaatacaagaaaatacaccacatatataatcggtgtcacaaaagaacatgagagacaatatggaacataaaaaatatatatggaaaaatattaaaagtatttctcactcaaaaagagtcagaaaggaacattcagcatactattataaagttttatactacacaataagtgatataatactatttaaagatagactgtgtagggaagtttggataacttttaatatagaacaaccaataaaaacaaaagaaaaggttattgctaataagccagtattgaaaaaaaatgaagtaattttaaaaactcaatataattgaaggtagtaattatgggacaaagcagaaacaaagagaaagattatagatgtaaattcaaccatttgaacaattacattaaatataaatggtctgactacagttaatagacatataatatcagattggataaagaaacattattcaatgatatactgtatttgtaaaaccatttacgtttatatgaataaataatatactaacagttaaaatatggaaattatgtaccatgtaaacattaatctaaagaaaccaggagtggttatatttacgccagacaaaatgtaattcagaagaagaaatattaccatgaataaaaagcagtatcacataatgataaattaatcaaacattccagaagacataaaaacactaaatgtgtgtgcatctattaagtgggattcaaaatgcttaatgattaaaaataaaatgaaattagaaaaaatacaaaattacatttggatattttaactctcttttctttttaaaaacattttttgatgtatatttgtacatatttgtggggttcatgtgatattttgtggcatgcatagaatgtgtaatgattaaattagggtatttacgatatccataactcaaacatttgtcatttcttgcgttggaaacattgcaagttctttcttctagctattttgaaatatacaatacattgtttttaactgtagtcactactgtgctagctaacattagaagtcgtttattttatctaaccatgtttgtacccaatctctctttatcccctcccctccatatacgctttccaggctttggtaactattattctcctctctacttctatgagattgacttttcaagctcccacctttaattgataaaacaaaaagagggaaaattagtaaggttgcagaataatttattaacaatatcaaccagcttaactttgtttgcatgtttagagcaaacactaccactaacagcagcagaatgaagattcttcataactgcatacgaaacattcaccaagttcgttcatacactggacataaaaccagactcaataagtcttggaggatagaaattatgcacagtatgttctctcatacaataaaaataaattagaaattgttagcaagatgacactagaaaatccactaatatttagaaaattaaaagcatgcctctacataaatccatgagacataaaattacaaaatattttaataaataaaaattaaacacctatcaaaatttgggagatgtgttaatagtgagtagaaagataattatttcattaagtaaaaaataaagggtctcaaataattgacttaagctttaccctaacgtactaccaagtgaaaaataagttaaccccaaatgagcaaaaggaaagaaataataatacagcagaaaagtatgaaataagaacttaatagataaaattgattactgtgaaagccagtctttgaatagatcagtaagtttgaaataactagagttaacagaaaaaaagagacaagacaaaaattatcattatctgaatgaaaaggtgtggggaacatttgcaaaaatcttacagatattaaatggagaatgagtgacttatgaacaaatgccaataaatgtattgacttagattaaaatcgattccttgaaaaatacaactaaagatgcctatacaggaattagaagccctacattgaactgcatcaattaaagttaaatttttgttaattattttgcaacaaaggaaacagtaggttcaaatgattttactggttaactcttccaaatctttaaagaacacagttctcttgattttttgtttgtttgtttgtttgtttgttttgaggcggagtctcgctctgtcgtccaggctggagtgcagtggcgcgatctcggctcactgcaagctccgcctcccgggttcacaccattctcctgcctcagcctccccagtagctgggactacaggcgcccgccaccacgcccagctaattttttgtatttttagtagagacggggtttcaccgtgttaaccaggatggtctccatctcctgatctcgtgatccacctgcctcagcctcccaaagtgctgggattacaagcgtgagccaccgcgcccggcctctcttgatgttttaaaacaaacttttccagagagcttattcaaagaataatatgagaaaacttcctaaatccacgtaattggacattaaactgtagaaacacaaaggactccagctaggatgaacaataaacattgacactgagactcattataccctgtcaaaagtcaaagacaaagaatcttgaaaacagcaaaggaaaagcaactaatcatgtataagaaagtttccataagattatcggcagatttattagcaggaacatagcacaccagaattaagtgggataagatattcaaagtgctgggaaaaaatgctaaccaggaatactgtacctacctttcctcctggtagttctgaggaaacgaggcagtccagatgagtgggtttcctctcagcgaagcacatccctccactaagggactgtcagagtgcttcgttaaatgggtcctgttccctgtgccacgcaactgggtgagaccctccagcaggggttgtcagacaccctatacaggagtgatcctactggtgtcaggttggtgtctcttgaggtcagagatcccacaggaaggagcaggcactcatctttgctgttctccagccaccttgagtgacatctccaggcgagggagtgaaccagttgaacaggcctgaagtgaacccccagcaaaatgcagcaaccctacagaagagggagctgaccattgaaagaaaagcaaacaaacagaaagcaacaacaatagaatcaacaacaacaacaaaaatccccacaaaaaccccatccaagggtcagcagcttcaaagatcaaaactggataaactcgtgaagatgagaaaaaaatcaacaaaacaacgctgaaaaccaaaaatgccagagtgcctcttctcctccaaatgatggcagtgcttctctagcaagggcacataaccggatagaggatgaaatggacgaattgacagaagtaggtttcagaagatgggtaataaaaaactctgctgagctaaaggagcatgttataactaaatgcaaagaagccaagaaccttgataaaaggttagaggagctgctaactagaataaccagtttagagaggaacacgcatgaccttacggaacagaaaaacacagcacaaaaacttcgtgaagcatacacaagtatcaacacccaaattgaccaagcagaagaaaggatatcagagtttaaagaccaccttgctgaaataaggcatgcagacaagattaaagaaataagaatgaaaaaaaacaaagcctccaagaaaaatgggactaggtaaaaagactaaacctacgattgattggagtaccagaaggagacggggagaatggaaacaagctggagaacacacttcaggatattatccaggagaacttccccaacctagcaggacaggacagtcttcaaatgcagaaaatgcagagaacgccacaaagatatcccacaagaaggtccaccccaagacacataatcatcagattctccaaggtcaaaatgaaggaaaaaaggttaagggcagccagagagaaaggtcaggtcatccacaaaggccgaggatccctctgcagaaaccctataagccagaagagagtgggggggtcaatattcaacattcttaaagaaaagaattttcaacccagaattgccctacagcctgggtgacagagtgagaccctgtccccagcaccccccaaaaaaagggaaacagaggaaaaaggaaacaaaatgactacaagaaatacaagaagcgctgaagaaaatggcaatagtaaatcctttcatgtaattaattaagtataagtggattaaattattcaataaaaagacccagtgtggctgaatgagtaaaaagccagatctaactgtattctgtctataacagaaacacttttgatgtaagggcacgcacagtctgaaaatgaaaggactgaaaaagaaattccatgcaaatgggaaccaaaagaaaaaggggtggccgtatttacatcagataaaataaatgttaagttataatgataaaggatcagataaccaggaggacataacaattataaacatatattagagcacccaaatatatgaagggaatattaaaataacccttcaaagacaagactgtccactgtctaccgtatcccattctggataattctcaacatccaatattcaatacttaattctgggttgctgacagtaacatctcactgttgaattttgatagcagaaggaatagaataatagctttcttatttttaaaccttctagaaaggaaaaagatttgacaatatcaactgcttgaaagataggtttaggacctacgctgccatatataaaacacattagtaggctgagtctgacaaaaacagaattaattctttatgtctctgggtaaacatttgaaaatcgtattgaatttagtctgggatctattctcttcagaagctctgcttttaaagaagacagacttgtttcctaagtctgtctcagaaaaaaagaaatcttctgagttagaatctttattaaatacatcattataaattaaattaaatatgtatatcaacgttcacattattttcacagatatagcaatttaaacctggctaagattcctgaaatatttcctgaaggaaaatagcaaacagaaaattccccaaaagctctttggaatatcagcatgcagattaatataatttgtattatgtctatacattctaagtcctataataaaatgtatttccataaataaaatt

SEQ ID NO: 1819 - DNA, 70376 bp, Homo sapiens
taatgttccatgagtggattgcagattacagttgattacagttgaacaatgcctgaataaaattagtcttctgatttcatattagaatattagatcccatttatgaactctgattctcacaagtgtaaaatattccctaatctttcctcacccttctgcattcaactgcacatcccagaacaataacattgaagatatatttaatgttttaccttggcagtcatatattttatcaatcccttgatgattcagagaagcattttgaaggtttaattctacttggaatatttcctgttcggttcctgaaatggagcttttattgcctttaggtttcctttgctgccactttgggtcctgggccagactcacttctgagaaggttcctctttgtttactcatctctgcagctgtgtgatgtgagggactgtgctctatgataactgcacttaagaagctataaatggtgtatattttgacaggatccctggtataggcaatgtgcatgtgttggggctgagtaataatgtttactttgctgttaacctaggtaaaattctgctactaatttcctaaagctttaaacaaaaatcacacgatataattggccattttttagatgtattctgtatttgacataatattactagtgggaacaataaaaacattaaacttgtgagaactaggaagttcatgaaaaaaattggtattaaattaaggttagattcttcaaaaatgtttaacaccaatagactgcatactttaacaattaaaatactgtatttagaaatacactaattttaccatagttttaagagtcattgatggttaatgattgtgtgccataagataaaatagttctgtcagcatacagagtaacttcttatactaacatacattgttagtgagttacattcatttattaaaaggacctgaggtattgtcaactgattatttttctaaattaggaaatcagaaaaatcattaaaattttaaaaatatatcttgtaaaacattacattactgtatgcataaatactattgaaaacataatatatttttaaattgctgcttttacacaagaaattggtaattgatttaatgactaaaataggaaaacttaaaatgataaataaacgtgtgggccgtctatggaagaatagtgtccaatcaaactttcagaaagctcctatgattgtataagtcagtgagggtcgctttggttgtataagtaattgtaatagttcagataatgtaatttaataatctagtcaatgagctctgtagtcagtgagactacaattaattctagctttgcaagttgtaatatgtgacctgtactaaattacttagtgtctactaacctagtttactaatctacattgggaaaaataatttataaagtataatgtatgtagaaaactaaacacacaacctggcacatattagcactgaatacataatagatatttcaactatttttaacacaattgccattttattatttctgatttgcattagagtgtgttaaaataactcattaattaggcgtctcatgtcagtgtggtacatcttttttgcaatgtttggttcaattgttttaagtcttccaattgtttataattaaggtcagatttgcattttatggaaatgatttcatccttacttttattaaaaattaaaactgctttcatgaaatctaggtgtgtgattgagaattaatgtttgacattcacaatttgatgtatccatattaaaaatttatttttaaagtttggtctaaatataatatacaattaaaccagtaatgattacaaaatccaaaattaattgttcattgtcatgatggttatgggtttcactctaaattacatggattggcaaacctattattatgtatgcatctacttgagtgattctccagcggcaatgatgtgaatactctaagaaatccttaaacatagtttatattttggctcgtttttcaccttgaattattcacgtgaataaagttctaccttgattttcgtctatatcaactttacctcaggtgcatcacagccagtacttacaatcttctactaaatgagatgagctagtagagaaacagggagaggagcaacacttacctactgtcatcagaaagccacacgcccttcagtggagaggtcaggttacctctgaaagacacaaacgttatctgtgatcttcacagactgccctttgaagggtcagagtgaggcaagagtggaaaaagtagattcctcaccaatgtgtcactgcagatttgaacaggaaattctcaccctagggctattttgaatcagtttgtctcatcacacactttagaatataggagactttgggtggctagtgtgtcatttagtttgtccattttaaagtgcctcttagaaattatttttatggtcaacaagatgaggggagagcagagatttgatccatgctggtgattgtttccatctcagtcacaaacaccaaagttttgtaacttttcaaaaggatcttaggtggttgctttctacatttagacaaggtggctgaaacttgacattatatacttttttatcatatacccctataatatcactgctatcataataacaaaatttaaataatgattttatcaataggaatttaatgtacttgtcactattttgagaaaatgctgcattttcaacttaattgtaactgacatgcattctcaaacttatcttcttgctttctttgccttagttcttaaaattccctcattcaatttttcttctttatataagttaaccagattcctgattaaaataaatgtctcttgaaagaataaaatattaaacaatactgagctatatctctatgccagagactgaaataataaaaaaactacctactatattgttcaccggttccttctctaatcatgacttactgtctgcattttaatagaaatatttgttgtaaatgactaaagcctaagttaaactatgaagggaggttaaagcaatttttaaaacatcacctacttaaaaatggggaggccagaaaatggagattttttaaaacacaagtaaaatgatacatgaatgtccgggcatggtagctcatgtcagtaatcccagcactccaggatcacttgagctcaggagtttgaggttagcatgatacacaggatgaaaccccatctcttaaaaaaaaaaaaaaaaaaaaaaaaaatatatatatatatatatatatatatgaattagccgaggatgctggtgtttgcttgtagtcccatctgctctggaggctgaggtgagaggatcgcttgagccctgggggtcaaggctgcagtgaactgttagtgtcactgcactgtagcctgggcaacagagccagaccttgtctcaaaaacaaataaacaaaaacttttaaaaaataaatggtatacgaacatcagggaaaaaactataaattatctagttgtattaaataaaaatcttttcatcatttattttctatcaagaaaagggggaatgtttatgcataattctattgcccaggctggagtgcagtggtgccatctcggctcactgcaacctctgcctcctgggctcaagcgattctcctgcctcagcctcctgagtagctgggattacaggcgtgtgccaccaggcccagctaattttttttgtatttttagtagagacgaggtttcaccgtgttagccaggatggtcttgatctcctgacctcgttatccgtctgcctcggccttccaatgtgctgggattacaggcgtgagccactgtgcccggctattctctaaaatctaaaaagttggaatttaaacccatatttatttctttgcaatgagaattattatttgcccttccatcagaatggctaatggtggctaggtatatatgtttttctgtaaaatatattgtaatatattttcacaaaattaattaataatgtcatatgcatatatgcttgtgttcatattgtatctttttctattacaagtatatttatatttacattttattacattttcataaactaggttactttttctattagtcacgttatggaactaaaacaataaaatcattcactaaagatgccacataatgtatcattcactgatgttttctatttaagtctgaagtgctgatgtctactattgctacaaacatccacttggtgttttccattagtgttataccattattgtttgcataatgacagggatacctctgaggaatatgtctttaggcaatttcatccctgtgtcaacatcaaagagtttatttacacaaacctagatggtacagctactacactcctgtgttatatgggataggctattgctccaaggatacaaacctgtacaatatgttactgttgtgaataatgcaagcagtgaccagaatggtaatttttgtttatctaattatatataaaccaaaaaaacagtaaaatatggtttaaaaaaaggttaaaatggcatccttttatagggcacttactacgaatgaagactgcagaaatggaattttccctgggtgagtcagtgagtaagtagcaagtgaaagtcaaggcctaggatattacagcacactactgtaggatttatacactgtacactagggtacactatatttatgcagcactttttttcttgagctaataataaattaactttactgcacctttgttggtttctaaatttttcatattttaaaaatcttctgcctctttttaaatacactttatttaaaaacacaaattgcacagtcttaacaactatattctttttatgagcttttttctatatttcattttaatttttttctttttaaactttttttaaaaacgaagacacgaaaacatacattagcctaagcctacgcagtgtcagcaagatcaatctcactgtcatcccctccacatcttgtcccactggaaggttcaggcaataacacacgtgcagctgtcctctcctatggtaacagtgccttcttctggaattcctcctgagggacctgcccaaggttgtttttcaggtaactgtttttatagaagtagaaggagtacactctaaaataataattaaaagtatactacagtaaatacataaaccaataacattgtcatttattatcattatcaaatattatgtagtgtatgtaattgtttgtgctatacttttattccactggcagcaaggtaatttacaccagcatcaccacagacatgtgaataatacactgtactgaaactattgctatgacgtcactaagtcataggaaatttccagctccgttataatctagtgggaccactatctatgtgcagtcagtcattgaccaaaacatcattttgtggcacgtgactgtatatcatgtcctttgttaatcgaaacaatacagatttctactgtttgggcatttactgtgaatgaagtttatgcttatacaaaggcacaataaatatataaaaacaaaacaaaaattacacaagataactggagtacttagaatttatatgatgtgtgtgtgtgtgtatatatgtttatgtgacgtaaatacacacacacacacacacagaacttacgatgattaatattaggtgtcagccggattggattgaaggatgcctagatagctggtaaagtgttgtttctggctgtgtctgtgacggtgttgccagaggagattgacatttgactcagtggactgggcgaagaacacccatcctctgtgtgggtgggcaccatccaatggctgccagagcgagtagaacaaagcagctagaagaaggtggggtaagctggcttgctgtgttcggctttcatttttctcccgtgctggatgcttccttcgttcctcctgcccttggacatcagactccaggttcttcagcctttggactcttgtacttacaccagtggttttacaggggctcctgggccttcggccacagactgaaggctgcacttttggcttctctgcttctgaggcttttgactcggactgagccactaccggcttctttcttcccccagcttgcagatggcctattgtgggactttgccttgtgattgtgtgagccaattctccctaataaactctctttcatatatacatgcatcctattagttctgtccctctagagaaccctaacaccgaacctacatatgaattactgtgactattgcaaataatggcaatatctggtttcctatgggttatggctaagttggaagtcaataagaagtgaaaatatacttttaatgtaacatgaaacaaaataattttcaaggaatttaaaaaattggagtgaattagttattacaaactctaaagaaaataaaatttaaatttcttcaatagattaagcacaccttcccaatgaaaacttggatattcaaaaagaagacgtaaaggaattatgtggatatacctaattggatattgaatagatagtgtattaatgacaaagtttccaacattgaaataaatatttgtattagaatttggggagcagatacaggctaactggtaaataaaatagagagtaatcttactttgtttgtactgctataataaaatatcacaaactaagcaatctattaaccatacagatatattactcacagttcagacagcagggaggtccaagatcaaagtgccagcaggtgtgttgtaaattgtattaaattaacaagtttctatgtggaaagtaaacaatgaaaatatttattatgaaaacataagggaacaacagagtttaaacacttggtaatgttcaatcagaatgtaataaaaatgaagttataattaatacctgtgcttacatatttccatataaataaaatacataagaattatattttagatattgataattatattaagtatagagtaatttgaatttaaaagcaaagaatgtatatattcagtaataactgtttgttgtctttattagacatgcctttcatgtaagcataaagaaaaatgaatataaaagtggagccaccatatgatccagcaatcccactcccaggtatatacccaaaagcaagaaaatcagtttatctaagggatagctgtactcccatgtttgttgcagcactgttcacaatagctaagatctggaagctacctaagtgtccatcaacagatgaatggacaaagaaaatgtggtatatataaacaatggagcaatattcagccataaaaaaggaatgagaccctgtcatttgctataacatgaatggaaccaggggtcattatgttaaataaaataagccagtcgcaggaagacaatcatcacatgctctcacttacctgtgggatttaaaaatcacaacaattgaactcatggagagagacagtagaaggatggttaccagagattgagaaggatagtggaagggtagtagtagggaggtgaaaatggttaattaatgggtacgaaaaaaagatagaaaggatgagtaagacctagtgtttgatagcacaacagggtcactacagtcaataataatttaattgtatattttaaaataactaaagagtataattggattgtttgtaacacaaaggataaatccttagggagatggatgcatcatttttacatgatgtcattattatgcactgcatgtctccctcaaaacagctcacggaccccataaacatataccctactatgtacgcactgaaattaaaattaaaatatttaaacaaggaaagatgaagataaaatatttaacaacatataccatgcctcacaaactggtagaacactattacagttgtaatagtgccgtcttaatataaggcaagccctttactggaattgaggaagcatgcttcacaatgtaagattaattttccaaaccactagtaatatacatttttatcattgcatgtacctaatgctacaagttcaacatacaattgaataaagtgaataagtaacaatcataaatggaattttaaacacttttctctcagtgcttaacacacaaacaggccagagagccgatagaaagatttgaactagacaagtagttatcactcatatgcacacactcacacacatgtagaatactcacatatttaatttcacatatttttcccagatacactgtaatctcataattctaagcatattagtaaaaaatataggactatgatttcaatgtagtaccactagccaagcttggccagtggatagttaaaaaatagctattctaattcaacattaattaataccaaataaataacatgtaaaaccagtttctcagcacactagccacatctttgcatacaaagatgaagaatatttccagcttcatagaaaatgttctaactacagtttacctacaatagaagtcaataaaaaaatctgacaacctcaatggttttaaattcagtaatacatatctaaataacatatgggtgaaataaattatcaaaacgaatggtcacaatttttatatgaattataaggaaaatagaatgaaaatctctcttgtaaaaaccgattgccctcaatgtacatatattacaaaagatgacctaaaaattaaattaccattgaatgcactaaaataaattaaaaatagaaaagctaaaattaaatacaagtgatgtataagaaaaagatgaataaacagtaaaaaatcacgataaagaataatgttacaatagagagaacagcaaggccaaaggtattttcattgaaaatgcttttaaaacttgatgaacgactactaaaaatatacacctactaacgtatccacaaaaataataaatttaacattttaaaaaattgataagggccaggcacagtgatgcctcccaaagtgctgggattataggcttgagccaccagaactggcctatttctagattaaacatggcaataccattatggtctttacagttatttagaggcaataaaactatttttcattacattttaatgtctatatgaaatagaaaattcatacatactcattaccaaatgcagtacctcaaatagaaatctgagtatatcccaccatgtattaaagaaattcagtttagacataaactttcctagaaaaatagtctacaaactcagatggcattactagtgaattataacatttaaaaataaagcagtactctcaacaaatgcttctaggttatagaaaaagagaaattcttcccaagatagccttgatatcaaaacctttcaagtatatagctatgaataaaaacatggtcaaatatccttgtgaacatggatgaagaaacaaatcttaccctacataaaatatatatgcgctaatttttttttattcatcttttttgagacagagtctccctctgtcgccaggttggagtacagtggtgccctctcggctcactgcaacctccgacccctggtttaaagtgattctcctgcctcagcctctcgagtagctgggactataggtgcgcaccaccacgcccagctaatttttgtatttttagcacagatagggtttcagcacgttggccaggatggtctcgatctcttgacttcatgatccacctgcctcagcctcccaaagtgctgggattacagacgtgggccaccacacccggccagcactgatattttatgagggaaatatacaatgatcatcatggatctatttcagaaacaaaggctggtttaacatttgaaaaaataaaagtttataaaatgttatataaacaaaacatatatcattccaacggatacaaattaataaaaatgttacaattgataaaatctattagaaaatagtattataaaactgcttcgatatgagaaagataggatgcaaaaaacaccaagctttttaaatatgtataacatgttgaagtattttttgccaaaaccagaaaatgatgcatatgatccacaaagaactttgattgtgccttctattcaactatgggtataaaaccctagccagtgaaaataaatgaaaataaaactaagttatagcacatggattaaaaaaaataaaagtgtgatcatttgcagataaaattgctcgttatatagaacacccagaaataaatcaatagttgacataatagatttaaatatataaaatcagtggaataagtagatataaaatcaaaatgcagacatcagttgtatttctatttataacaacaaaaattactaaagggaattttagaatcaggatgccatttacaaaagcataaatgtaaaatacctacatttctgtatgacttcaatcccccaaaatacaaaatacaagagagagaaattaaagataacacagtacattgaaggaaacactttatactgattagaaaagtcaatattataaagaagctaatctttaaaaattactttagagaataaatgcagtcataaacaatcccatcagaggcttttttttttctggatagctttattgaagtgtcatgtacaaagcatacatttcatgcacttaaaatgattaaaaatcaatgatgtttagtatattcgcagagttacaaccatcaccactactgaaatttagaaagttttcatcacgacacaaagaaacgttctatcaattagtggtcatctcctatttcaacctccctgagacattggcaaccactattctactttctgtctccatgggtttgactgttcttggtacttcctataagctgactcacataacatgcaacttttagaaaggctgaaaaccacaaataccatgttgagcaaaatgagcccgacacaaatgctaggatgtctgtactttagtaattgtgtgcatcctatttcaataattgatttagaatttttgtatcagagcaaataacataattcattttcagatttatgcaatcataatatttctattttaagaaatataaaatgtatctgatgcactgcaaacgcaaatgctttacttctaaagcttatgcttacaatgatatatcattgaagatccacactgggctgatttaagtcgatttacttgtagcactgcacagttaagttcagcattatctgagtcttttatcctgtaatggagaaaaatccattttctgttacattttaagcaaatgattcatgagacgaaagcattttccatgtactgtaagaaaagaatttcatggaaaagggtaattaaatttttcataatattagtaagagtcattattctgaacactcaacagagtagtccctcttcatccacgagggatatgtttcaagaccccagtggatgcctgaaatggcagatagtgcagaacctatagagagattatgttttctctacacattcataactgtgataaagtttaatttataaattaggcacaataagagattgacaacaataactaataataaaaaaattatagcaatatgccaacagcactattattgtgctttgaggatattcttaagtaaaaaagtaagcgtggctttttaataaaaacaagcactgcagttccctgatagtccagctcgaggttgtccaactcgctgcccatgggccgcacgtgacccaggacagctttgaatgcggcccaacacaaatacgtaaactttcttaaaacattctgtgattttttttttttttttagctcgtcagctatcgttagtgttagtgtattctatgtgtggcccaagactattcgtcttctaacgtggcccacagaagccaaagatgggacacccctggtccatctgataaccaagaaggttactagcagaccaatgagcggttgaaatatatggactactatggtctattgtaaaatatttatatcaacatttcactaactttccacatctttcttcatgtcaatgattccacataaatttattcatattattcttctgaatttatcctttatatatattttttatatagcgccatacaaaagaacttacttatgtttgaaagccaaaccatttattgtcacccatggatgatgactgctgttacgaaacacaccaatccatgaggaaggtaaaatgctggccagaaatttctaaaagaaaagaaataattttcacttaaataataattatgaaaacattacaaaaacaatatattaaagttgaaaaccactatttgcagtgccaaaaactttcataaatgtttgaattttttatttaaatgaactcttcaacgtttatacttagtactttcattcttattctcatgttaataaagacattttaattcttgcaatgtaatagttactccaattaacagaataaacgcaggaagggttttaataagtttcctgatactgtgcattcattcctccagatactgtgactaaatcaatctatttttgtgctatatttctcagagttggagatttagaagggaattgaggggttgtcattcagaaatagatgacatggaagctacagattgggttttctgggtaccacaccattctttaactagataagccctcaatttttatccgattcggtttttgcggaataacaggggtcctggccaggtggtgtagactcgtctctctctgctactcccgactaaaaacaactataaactctgggattaatgaaagacaaaagcaatggagaactctgaaaggtggaaagagaaagatgaaattgtctgggaccctagcatcagggatcaaccaagtgtccgagtgagcatgttaagtcctccacacgacagaagaaggtgacctaggcctgctgtttccctacacccaacctggcaataggaggagggtatcgaaggagagtcccctccacaataccaggcaaggctggtgccactggcaaggatgatctaccaggagacctgctaccaatatggagctagagaaagtgcttccttctcataccaagagacaccaggatggctgtggatgaggaggatcagcaaagggaccccatgactaacagtgcaccgtaaaccacctagggtcctctttgtccctgagggcatgagacccacttccccatccagagacaaggactcaatggattcttactgttctttgtacatagtacagcagtgaacagtaacatactactgataactgcaataatatggaggaattgcacaaatatcagataggattgaaaaagacatgaaattcacactgcttgattccctttatataaataaattcaagaacaggcaatcattatttataatattaaaagtcaagactgcgttttggagaggagtcaggataagtgatgagggcatacacaggggtggaactgctagagctggaaacttttatttcatgatctgacttgtatcacatgcattcattcactttgtgatcaatctgcatgaccagatgatatcatgcccgataaaattagatagcaaaatttattgtggattcaaagcacttatagaagcatggttttccttgaaaaacaaaaactgaaaataaatgtacattagcagtatataactttaaaaacattattaagtcaatcaattgaatattacatacacttgaaaatatatgagataaatatatgtacacacatatggatgttttctacaaatgtattattcactgaaggaagcttttcataaaatgtttgaaacatttacatcttaccatttcttcttcattatctatagaaagcagactggagttcttcgaagtacaggccagcaaactctcttcccaagttcttctttccttaccaatgtaataacaactgttggaatatgtaatccactcctcaggacaatggccacaatgacgtgctaataaagatatgaattactatctagaccaatatgaatttttaaaaatgaaaattagttcacatatttcaacagtataaacatatatgtgcttaacatatttacgcatccttacaggcttataaatgtatatttttaataactgagtcagtcatacacacatgcacagacaagggttagcctctcctccctaattgtgttcccatataaagcaaatgaacaaacaaaaatacactctacacatgtgttgaacatcgctgatacacaactgcttttttagaatagtaaaattatttatttggtatcatctcacagcagtaggaaacctctgttaattgggagaaagagggtagaatgattttaagtgagtatttctactcactggagaaaaggaaatgctgcctcataatctttctttataaatatttatggctgaatttatggcttattttctgcaaaaatgccactattcttttacatgccttaaaacagacacaaaatataaattgtactaatatcagaacattgaaaataaaaatgtacctttctgcgttcttgtattcggggaaaaattgttctgctccaggactgtaatagaaaaattaaaatgatttttataaaaactgatatctagataaaccataacgagtttagtttcttactttgaaactttgtgtgttatttaaaatggggagaatctttaataaaattaactttttctataaaaatatataaagtaatagacctttgaaataaacatttttaaagactttagcacaaacttcaccatctcttgtagtatttgatgtaaccactttcaaaaattaatttgtttttctaaatacttttcttctatagcatgcctttgaattatgaaatcagaaaatatctttgtgtgtgtatgtatatacatatatatagattacacacaaaaaataaacacatgttctctacaatgattttgttatttatgttgtgaaaaattcagaataaccatattacttttggttccaaattgtactaatatcagaactttgaaaataaaaatgtacttttctgggttcttgtatttggggaagaattgttctgctccaggactgtaacagaaaaattaaaatgatttttataaaaagtaatatttagataaaccataatgagtttagtttcttactttgaaactttgtgtgttatttaaaatggggacaatctttaataaaattaactttttctataaaaataaatgaagtaatagatctttgaaagaaacagtaaaataagagttctattcttcaacagtatgaaatattttgaggcacttccaagcattaaagtaaaacgttcccttctaatctttcaagaatatgcttacaaggaataagaactattgtttttaacacagtggccatcaggacaatgcaaatgattcctaggacctcggcagtgagcttctctggaggtggcagtaaacctgcagggagagaaatagaggcactgagagaggggagatagagagttgattaggattacatactagagaattacatactagagaacccacatgcacagggaaacataatgataaactctggcctctaaatctacatctactctagtaatctttctctcagaatataccatttcattttcagtaaatataatgttccatgagtggaccgcagattacagttgaacaatgcccgaataaaattagtcttctgatttcatattagaattttagatcccaattatgaactccgattctcacaagtgcaaaatattccctaatctttcctcacccttctgcattcaactgcacatcctagaacaataatattgaagatatatttaatgttttaccttggcagtcatatattttatcaatcccttgatgattcagggaaggattttgaagatttaattctacttggaatatttcctgttcggttcctgaaatggagcttttattgcctttaggtttcctttgctgccgctttgggtcctgggccagactcacttctgagaaggttcctctttgtttattcatctctgcagctgtgtgatgtgagggactgtgctctatgataactgcacttaagaagctataaatggtgtatattttgacaggatccctggtataggcaatgtgcatgtgttggggctgagtaataatgtttactttgctgttaaccaatgtaaaattctgctactaatttcctaaagctttaaacaaaaatcacacgatataattggcaattttttagatgtattctgtatttgacataatattactagtgggaacaataaaaacattaaacttatgagaactaggaagttcatgaaaaattggtattaaattaaggttagattcttcaaaaatgtttaacaccaatagactgcatatgtcaacaatcaaaatactgtatttagaaatacacaaattttatcatagttttaagagtcattgatggttaaggattgtgtgccataagataaaatagttctgtcagcatatagagtatcttcttatactaaaatacattgttagtgacttacattcatttattaaaaggacctgaggtattgtcaaatgattttttttctaaattaggaaatcagaaaaatcattaaaattttaaaaatatatcttgtaaaacattacattactgtatgcataaatattattgaaaacgtatttttaaattgctgcttttacacaagaaattggtaattgatttaatgactaaaataggaaaacttaaaatgataaataaacgtgtgggccgtctatggaagaatagtgtccaatcaaactttcagaaagctcctatgattgtataagtcagtgagggttgctttggttgtataagtaattgtaatagttcagataatgtaatttaataatctagtcaatgagctctgtagtcagtgagactacaattaattctagctttgcaagttgtaatatgtgacctgtactaaattacttagtgtctactaacctagtttactaatctacattgggaaaaataatttataaagtataatgtatgtaaaaaactaaacacacaacctggcacatgttaccactgaatacataatagatatttcaactatttttaacacaattgccattttattatttctgatttgcattagagtgtgttaaaataactcattaattaggcgtctcatgtcagtgtggtacatcttttttgcaatgtttggttcaattgttttaagtcttccaattgtttataattaaggtcagatttgcattttatggaaatgatttcatccttacttttattaaaaattaaaactgctttcatgaaatctaggtgtgtgattgagaattaatgtttgacattcacaatttgatgtatccatattaaaaatttatttttaaagtttggtctaaatataatatacaaaatgtaatggttacaaaatccaaaattaattgttcattgtcatgatggttatgggtttcactctaaattacatggattggcaaacctattattatgtatgcatctacttgagtgattctccagcggcaatgatgtgaatactctaagaaatccttaaacatagtttatattttggctcgtttttcaccttgaattattcacgtgaataaagttctaccttgattttcgtctatatcaactttacctcaggtgcatcacagccagtacttacaatcttctactaaatgagatgagctagtagagaaacagggagaggagcaacacttacctactgtcatcagaaagccacacgcccttcagtggagaggtcaggttacctctgaaagacacaaacgttatctgtgatcttcacaggctgccctttgaagggtcagagtgaggcaagagtggaaaaagtagattcctcaccaatgtgtcactgcagatttgaacaggaaattctcaccctagggctattttgaatcagtttgtctcatcacacactttagaatataggagactttgggtggctagtgtgtcatttagtttgtccattttaaagtgcctcttagaaattatttttatggtcgacaagatgaggggagagcagagatttgatccatgctggtgattgtttccatctcagtcacaaacaccaaagttttgtaacttttcaaaaggatcttaggtggttgctttctacatttagacaaggtggctgaaacttgacattatatacttctttatcatatacccctataatatcactgctatcataataacaaaatttaaataatgattttatcaataggaatttaatgtacttgtcactattttgagaaaatgctgcattttcaacttaattgtaactgacatgcattctcaaacttatcttcttgctttctttgccttagttcttaaaattccctcattcaatttttcttctttatataagttaaccagattcctctgattaaaataaatgtctcttgaaagaataaaatattaaacaatactgagctatatctctatgccagagactgaaataataaaaaaaactacctactatattgttcaccggttccttctctaatcatgacttattgtctacattttaatagaaatatttgttgtaaatgattaaagcctaagttaaactatgaagggaggttaaagcaatttttaaaacatcacctacttaaaaatggggaggccagaaaatggagatttttttaaaacacaagtaaaatgatacatgaatgtccgggcgtggtagctcatgtcagtaatcccagcactccaggatcacttgagctcaggagtttgaggttagcatgatacacaggatgaaaccccatctcttaaaaaaaaatatatatatatatataaaaattagccgaggatgctggtgtttgcttgtagtcccatctgctctggaggctgaggtgagaggatcgcttgagcccattggggtcaaggctgcagtgaactgttagtgtcactgcactgtagcctgggcaacagagccagaccttgtctcaaaaacaaataaacaaaaattttaaaaaaataaatggtatatgaacatcagggaaaaaactataaattatctagttgtattaaataaaaatcttttcatcatttattttctatcaagaaaagggggaatgtttatgcataattctattgcccaggctggagtgcagtggtgccatctcagctcactgcaacctctgcctcctgggctcaagcgattctcctgcctcagcctcctgagtagctgggattacaggcgtgtgccaccaggcccagctaattttttttgtatttttagtagagatgaggtttcaccgtgttagccaggatggtctcgatctcctgacctcgttatccgtctgcctcggccttccaatgtgctgggattacaggcgtgagccactgtgcccggctattctctaaaatctaaaaagttggaatttaaacccatatttatttctttgcaatgagaattattatttgcccttccatcagaatggctaatggtggctaggtatatatgtttttctgtaaaatatattgtaatatattttcacaaaattaattaataatgtcatatgcatatatgcttgtgttcatattgtatctttttctattacaagtatatttatatttacattttattacattttcataaactaggttactttttctattagtcacgttatggaactaaaacaataaaatcattcactaaagatgccacataatgtatcattcactgatgttttctatttaagtttgaagtgctgatgtctactattgctacaaacatccacttggtgttttccattagtgttataccgttattgtttgcataatgacagggatacctctgaggaatatgtctttaggcaatttcatccctgtgtcaacatcaaagagtttatttacacaaacctagatggtacagctactacactcctgtgttatatgggataggctattgctccaaggatacaaacctgtacaatatgttactgttgtgaataatgcaagcagtgaccagaatggtaatttttgtttatctaattatatataaaccaaaaaacagtaaaatatggtttaaaaaaaggttaaaaatggcatccttttatagggcacttactatgaatgaagactgcagaaatggaattttccctgggtgagtcagtgagtaagtagcaagtgaaagtcaaggcctaggatattacagcacactactgtaggatttatacactgtacactagggtacactatatttatgcagcactttttttcttgagctaataataaattaactttactgcacctttgttggtttctaaatttttcatattttaaaaatcttctgcctctttttaaatacactttatttaaaaacacaaattgcacagtcttaacaactatattcttttttatgagcttttttctatatttcattttaatttttttctttttaaactttttttaaaaacgaagacacgaaaacatacattagcctaagcctacgcagtgtcagcaagatcaatctcactgtcatcccctccacatcttgtcccactggaaggttcaggcaataacacacgtgcagctgtcctctcctatggtaacagtgccttcttctggaattcctcctgagggacctgcccaaggttgtttttcaggtaactgtttttatagaagtagaaggagtacactctaaaataataattaaaagtatactacagtaaatacataaaccaataacattgtcatttattatcattatcaaatattatgtagtgtatgtaattgtttgtgctatacttttattccactggcagcaaggtaatttacaccagcatcaccacagacatgtgaataatacactgtactgaaactattgctatgacgtcactaagtcataggaaatttccagctccgttataatctagtgggaccactatctacgtgcagtcagtcattgaccaaaacatcattttgtggcacgtgactgtatatcatgtcctttgttaatcgaaacaatacagatttctactgtttgagtatttaacgtgaatgatgtttatgcttatataaaggcacaatatataattacacaaatatataaaaacaaatatatataaaaacaaaaattacacacgataactggagcacttagaatttactctatatgatatgtgtatatatatatgtttatatgatgtaaatacacacacacacacagaacttacgatgattaatattaggtgtcagcctgattggattgaaggatgcctggatagctggtaaagtgttgtttctggctgtgtctgtgacggtgttgccagaggagactgacatttgactcagtggactgggcgaagaagacccatcctcggtgtgggtgggcaccatccaatggctgccagagcgagtagaacaaagcagctagaagaaggtggggtaagctggcttgctgtgttcggctttcatttttttcccgtgctggatgcttccttcgttcctcctgcccttggacatcagactccaggttcttcagcctttggactcttgtacttacaccagtggttctacaggggctcctaggccttcggccacagactgaaggctgcacttttggcttctctgcttctgaggcttttactgagccactactggcttctttcttcccccagcttgcagatggcctattgtgggactttgccttgtgatcgtgtgagccaattctccctaataaactccctttcatatatacacgtatcctattagttctgtccatctggagaaccctaacaccgaacctacatatgaattactgtgactattgcaaataatggcaatatctggtttcctatgggttatggctaagttggaagtcaataagaagtgaaaatatacttttaatgtaacatgaaataaaataattttcaagcagtttaagaaattggagtgaattagttattacaaactctaaagaaaataaaattcaaatttcttcaatagattaagcacaccttcccaatgaaaacttggatattcaaaaagaagacttaaagtaaaggaattatgtggatatacctaattggatattgaatagatagtgtattaatgacaaagtttccaacattgaaataaatatttgtattagaatttggggagcagatacaggctaactggcaaataaaatagagagtaatcttactttgtttgtactgctataataaaatatcacaaactaagcaatctattaaccatacagatatattactcacagttcagacaacagggaggtcccagatcaaagtgccagcaggtgtgttgtaaattgtattaaattaacaagtttctatgtggaaagtaaacaatgaaaatatttattatgaaaacataagggaacaacagagtttaaacacttggtaatgttcaatcagaatgtaataaaaatgaagttataattaatacctgtgcttacatatttccatataaataaaatacataagaattatattttagatattgataattatattaagtatagagtaatttgaatttaaaagcaaagaatgtatatattcagtaataactgtttgttgtctttattagacatgcctttcatgtaagcataaagaaaaatgaatataaaagtggagccaccatatgatccagcaatcccactcccaggtatatacccaaaagcaagaaaatcagtttatctaagggatagctgtactcccatgtttgttgcagcactgttcacaatagctaagatctggaagctacctaagtgtccatcaacagatgaatggacaaagaaaatgtggtatatataaacaatggagcaatattcagccataaaaaaggaatgagaccctgtcatttgctataacatgaatggaaccaggggtcattatgttaaataaaataagccagtcgcaggaagacaatcatcacatgctctcacttacctgtgggatttaaaaatcacaacaattgaactcatggagagagacagtagaaggatggttaccagagattgagaaggatagtggaagggtagtagtagggaggtgaaaatggttaattaatgggtacgaaaaaaagatagaaaggatgagtaagacctagtgtttgatagcacaacagggtcactacagtcaataataatttaattgtacttttaaaaataactaaagagtataactggattgtttgtaacaaaagaataaatccttagggagatggaaacaccatttttacatgatgtcattattatgcactgcatgtctccctcaaaacagctcacggaccccatgaacatatacacctactatgtacgcactgaaattaaaattaaaatatttaaacaaggaaagatgaggataaaatatttaacaacatataccatgcctcacaaactggtagaacactattacagttgtaatagtgccgtcttaatataaggcaagccctttactggaattgaggaagcatgcttcataatgtaagattaattttccaaaccactagtaatatacattttttatcattgcatgtacctaatgctacaagttcaacatataattgaataaagtgaataagtaacaatcataaatgggattttaaacccttttctctcagtgcttaacacataaacaagccacagagctgacagaaagatctgaactagacacgtagttatcactcatatgcacacactcacacacgtagaatactcacatatttaatttcacatatttttcccaaatacactgtaatctcataattctaagcatattagtaaaaaatataggactatgatttcaatgtagtaccactagccaagcttggccagtggatagttaaaaaatagctattctaattcaacattaattaataccaaataaataacatataaagccagtttctcagcacactagccacatctttgcatacaaagatgaagaatatttccagcttcatagaaaatgttctaactacagtttacctacaatagaagtcaataaaaaaatctgacaacctcaatggttttaaattcagtaatatatatccaaataacatatgggtgaaataaattatcaaaatgaatggtcacaatttttatatgaattataaggaaaatagaatgaaaatctctcttgtaaaaactgattgccctcaatgtacatatattacaaaagatgacctaaaaattaaataaccattgaatgcactaaaataaattaaaaatagaaaagctaaaactaaatacaagtggtgtataagaaaataatgaataaacagtaaaaaatcacgataaagaataatgttacaatagagagaacagcaaggccaaaggtattttcattgaaaatgcttttaaaacttgatgaacgactactaaaaatatacacctactaacgtatccacaaaaataataaatttaacattttaaaaaattgataagggccaggcacaatgatgcctcccaaagtgctgggattataggcttgagccaccacaactggcctatttctagattaaacatggcaataccattatggtctttacagttatttagtggcaataaaactgtattttcattacattttaatgtctatatgaaatagaaaattcatacatactcattaccaaacgcagtgcatcaaatagaaatccgagtatatcctacatgttttaaagaaattcagtttagacataaactttcctagaaaaatagtctacaaactcagatggcataactagtgaattataacatttaaaaataaagcagtacgctcaataaatgcttctaggttatagaaaaagagaaattcttcccaagatagccttgatatcaaaacctttcaagtatatagctatgaataaaaacatggtcaaatatccttgtgaacgtggatgaagaaacaaatcttaccctacataaaatatatatgcactaattttttttttttttttttttttttgagacagagtctccctctgtcgccaggttggagtgcagtggtgcactctcggctcactgcaacctccgacccctggtttgaagtgattctcctgcctcagcctctcgagtagctgggactataggtgcacaccaccacacccagctagtttttgtatttttagtacagatggggtttcagcacgttggctaggatggtctcaatctcttgacctcctgatccaccggcctcagtctcccaaagtgctgggattacagacatcagccaccacacccggccagcactgatattttatgagggaaatatacaatgatcaccatggatttatttcagaaacaaaggctggtttaacatttgaaaaaataaaagtagtttataaaatgttatataaatacaacatatatcattccaactgctacaaattaataaaaatgttacaattgataaaatctattagaaaataggaatattataaaactgcttcgatatgagaaagataggatgaaaacaacaccaagctttgtaaatatgaataatatgtttaagtattttttgccaaaatcagaaaacgatacatatgatacacacagaactttgattgtaccttctattcaactatgggtataaaaccctagccagtgaaaataaatgaaaataaaactacgttatagcatatagattaaaaaaataaaagtgtgatcatgtgcagataaaattgctcgttatatagaacacccagaaataaatcaatagttgacataatagatttacatatataaaatcagtggaataagtagatataaaatcaaaatgcagacatcagttgtatttctatttataacaacaaaaattactaaagggaattttagaatcaggatgccatttacaaaagcataaatgtaaaatacctacatttctgtatgacttcaatcccccaaaatacaaaatacaatagagagaaattaaagataacacagtacattgaaggaaacactttatattgattagaaaagtcaatattataaagaagctaatctttaaaaattactttagagaataaatgcagtcacaaataatcccaggagaggctttttttttttttctggatagctttattgaagtgtcgtgtacaaagcatacatttcatgcacttaaaatgattaaaaatcaatgatgtttagtatattcgcagagttacaaccatcaccactactgaaatttagaaagttttcatcacgacacaaagtaacgttctatcagttagaggtcatctcctatttcaacctccctcagacattggcaaccactattctactttctgtctccatgggtttgactgttcttggtacttcctataagctgactcacataacatgcaacttttagaaaggctgaaaaccacaaataccatgttgagcaaaatgagcccgacacaaatgctaggatgtctgtactttagtaattgtgtgtatcctgtttcaataattgatttagaattttcttattagagcaaataacataattcattttaagatttatgcaatcataatatatttctattttaagaaatatacaatttatctgatgcactgcaaatgcaaacgctttacctctaaagcttatgcttacaatgatatattattgaagatccacactgggctgatttaagtcgatttacttgtagcactgcacagttaagttcagcattatctgagtcttttatcctgtaatggagaaaaatccatattctgttacattttaagcaaatgattcatgagacgaaagcattttccatgtactgtaagaaaataatttcatggaaaagggtaattaaatttttcataatattagtaagagtcattattctgaacactcaacagagtagtcccccttcatccacgagggatatgtttcaagattccagtggatgcctgaaacggcagatagtgcagaacctatagagagattatgttttctctacacattcataactgtgataaaatttaatttataaattaggcacaataagagattgacaacaataactactaataacaaaattatagcaatatgccaacagcactactcttgtgctttgaggatattcttaagaaaaaaagtaagtgtggctttttaataaaaacaagcactgcaattccctgatagtccagctcgagcttgtccaactcgctgcccacgggccgcatgtgacccaggacagcttcaaatgcggcccaatacatatacgtaaactttcttaaaacattctgtgattttttttttcttttttttgctcgtcagctatcgttagtgttagtgtattttatgtgtggcccaagactcttcttcttccaatgtggcccacagaagccaaagattggacacctgataatcaagaaggttactagctgaccaatgagcggttgaaatatatggactactatggtctattgtaaaatatttatgtcagcatttcactaactttccacatctttcttcatctctatgattccacatagatttattcatattattcttctgaatttatcctttatatatatattgttatatagcgccatacaaaacaacttactcatgtttgaaagccaaaccattcattgtcacccatggatgatgactgctgttacgaaacacaccaatccatgaggatggtgaaatgatggacagaaatttctaaaagaaaagaaagaattttcacttaaataataattatgaaaacattacaaaaacaatatattaaatttgaaaaccactatttgcagtgccaaaaactttcataaatgtttataattttgatataaatgaacccgtcaatgtttatacttagtacttttattcttctcatgttaataaagaagttttaattcttgcattataatagttaccccaattgactgaataaacacagtaaggatttaaataagtctcctgatactgtgcattcattcctccagatactgtgactaaatcaaactatttttgtgctatatttctcagagttggagatttagaagagaaattagaggttgtgattcagaaataaatgacatggaagctacatattgggttttctgggtaccacaccattctttaactagataagccctcacttttttatctgatttggttttggtggaataacagtgatcctgaccaggtggtgtagactcgtctctctctgctactccctactaaaaacaactataaactctgggattaatgaaagacaaaagcaatggagaactctgaaaggtggaaagagaaagatgaaattgtctgggaccctagcatcagggatcaaccaagtgtccgagcgagcatgttaagtcctccacacgacagaagaaggtgacctaggcctgctgtttccctacacccaacctggcaataggaggaggcccagcaaagctcactcctgttctgtattgaaggggagtcccctccgcaacaacaggcaaggctggtaccactggcaaggatgatctaccaggagacttgctaccaatacagccagaggaagtacttccttctcataccaagagacaccagagtggatgtgggtgaggaggatcagcaaaggaacccaatgactaccagtgcaccacccagggtcctctttgtccctgagggcatgagactcacttccccatccagagacacaggattgaatggattcttagtgttctttgtacatactacagcagtgaacagtaataaacgacagataaccgcaataatatggaggaattgcataaatatcagataggagtgaaaaacacagacatgaaattcacagtgtatgattccctttatataaattcaaaagcaggtaaacgttatttataacattaaaagtcaagacagtgttttggagaggagtcaggataagtgatgagggcatacacaggggtggaactactagagctggaaacttttatttcatgatctgacttgtatcacaggagttcattcactttgtgatcaatctgcatgaccagatcacatcatgcccgataaaattagatagcaaaatgtattgtggattgaaagcatttctagaagcatggttttccatgaaaagcaaaaactgaaaataatcaaaagtacattagcagtatatgaattttaaaacattattaagtcaatcaattaaatactacataaacttgaaaacatataagctaaatgtatatacccacacatatggatgatttctacaaatatattatcgaccgaaagaagcttttcataaagtgtttaaaacatttacatcttaccatttcttcttcattatctatagaaagcagactggagttcttcgaagtacaggccagcaaactctcttcccaagttcttctttccttaccaatgtagtaacaactgttggaatatgtaatccactcctcaggacaatggccacaatgacgtgctaaataaagatatgaattactatctagaccaatatgaatttttaaaaatgaaaattagttcacatatttgcaaacatataaacctatacgtatgcaacatatctatacatcttcatgggctggtaaatatatagtgtcaaaatacccagtcacttatacacacatgcgcaataaagggtcagcctttcatctcctaattgtgttcccatataaagcaaaccagcaaacaaaaatccactctatacatgtcttgaaaaatcaatgaactaatctgatttttaaggaacaataaataacttgtatcttatcatattatagcagtaagaatttgaacacaacagataaaaagaaagcatagtgattttacttatagttgatgacaagtgaatgccttactctaattttatttatgaacacttattgccaaattttataatttttcacccaaaattttatttttgtacagcctaagatcaagaaaaaataaactgtacaatattaaaactttaaaaattattatatacctttctgagttcttgtattcagggaagaattgttgtgcctctgtattaatgtagctagaaaaattaaagtaatctttgtaaaaaaattagcatctaaatcaatcataataattttaagtttttgtttgaatttttttgtattatttagagttagaataatatggaataaaattgattttaagaaaaatttgataaagtaatggtggttttttggaaaagtatttcatagatctaaagaaccaaatttcaccatctcatatagttcttataattcttgatttaactactttcaaaaattaatttctatttctcagtaaggtttttcagactcctagaacatatttttgagttatgaaatccaaatatatacatacgattgcatcagaagcgaatactttcaacaattattctttcatttattctttgacaaattcagaataatcattccacatttagtccaaatatatacattacaatgagaactctattccctgaaaatatgaaatgtttagaggcacattcaatcattaacgtgaaaattccccttgtaatcttcgaaaatagacttacagggaataacaactatcgttaccacagaggccattaagataagacagataattcccaggatcccaacaatgagcttctctggagctgatggtaaatctgcagggagagaaatgggaacagtgcgaaaggagaggtggatacagtcgtttagaagattcacagacaagagaacctgaatgcacaggaatcatacagagaaacttggaccccaaaccctcatctcccattgtaatctttttctcagaataatataccattgaattttcaggaaaaataatgctccatgaattatttgacaaagactacaaacttcaacaatgagttcaatcagtcttcatactttacattgaaatagcatatctcaacttggaattctgatctttgcaaatagaagatatatgagcactcccttctctttccccacattcctgtaccccaagctgcacatcctagactgttatattgaggatcttttaaatgctttacctttgcagtgataggttttgtcattcccttgaaaatcctgagaagctttttgaaggtttaattccgcataggttatttcctgttcagttgctaaaatggagtttttattgcctttaggttttcgttgctgcctctttgggtttgggggcagattcaggtctgagtagattactccttggttatccatctctgcagtgtgtgatgtcagggactgtactctataataacagtagttaagaagttaataaatggtttatatacaggattccctagtgcaattaaaagggtgaggtggagaacgagtattggagctcattttgcattaaataatctaaagttctttctctgattttcttcaagcctaaacacgtttcttatgaatatttgttttaaaaaaagatttttaggccgggcgcggtggctcacgcctgtaatcccagcactttgggaggccgaggcatgccgatcacgaggtcaggagatcgagaccatcctggctaacacggtgaaactccgtctctactaaaaatacaaaaagtagtcgggcatgatgtcaggcgcctgtagtcctagctactcgggaggctgaggcaggagaatctcttgaacatgggcggcagaggttgcagtgagcggagattgtgccactgcactccagcctgggcgacagagtgagactccgactcaaaaaaaaaagataaattttctgcatttgacaaaatattattgctggggcaatgagaagcaataaattactaaggaataaagaagttcaggaataaaaatatatttcttaaagtctgatgttttacctgtgttaaaaattaaaatgttgtattagaaaaacttctgcactcatttttatgttaattttgaaatccagtaatggttaagactatgtggtctgcacatgagtaatagtaaagttgacatatatatatataaaaatttcttgcactacattacttttaattagtaatttatacacattaatgaaaatcaatagaggtaattaaatggtcttttcttaatggctgaaatgttctaagaaattattaaaaattatttattaaaaattataaaaaattaaatatttgtatatgacagaaaatgctatgtgacacagttaacttatgcataacctaaatagtattaggaacactacataaattgttaatacttacagaagtattggtaatttaattagtaattggtaatttatttcctggctaaattatgaaccaaaaaatgataaataaaagtataggtaattcatgttaaagcacatttcatttaaacttatagaatgattttatggttgtcaaagtgagtaaaggccactttagttgtataagtacttgtaaaatttcagataatgtaattaaatcatttagtcaatgggctctggagtcagtgagatctagaattaattctagctttgacacttataatgtgcgacctttaaaaagttattctatttttaataacccagtttgttaatctaaaatgggcataagaacatataaaacgttgcatgtaaaacatttaccactcaacctggcacttaaagttctcaataagcattagctactttaattattattttagtcacaattgttatgttactgtttctgattcatgtcagttaaagcatggaaaataaatcttcagataagtctcctatgtccatgcgctacatctttttttgcaatattttgatcaatttttaaaaagtatttttattgctttgtaatacctttagcattttatgtaatctacctcattctgatttttattaaaaataaaaactgcttttctctaatctacgtgtctgaggaattgtatttggctttcatcaattgattgatttattttaataatctttaatggctaagctaaatataaattattattcaaagatacatgatgtactgattacaaaatacaaaattaattgttcattattgtgatgttaatagctttcccttaaacgatattgatcaacaaacccactagatttccacaaacaataatttgaaaactttaagaaatccttcaacatatttcatattttaggtttttaccctgagttattcaaatgaagacagcaatattctactttgattttattgtatattaattatacctcctttgtatcatattgagcacttgaaatcacccactaaatgaggtaggctagtagagagttggagagtagcaatacataccttctgtccccagaaagtcacacatcctttagtggagaggccaggttagtctcataaaaaggcctgctatagctgtgtaataaaaggtgaaatttaaaggcataaatccaagacaagaacaaacaatgcctgcaatcttcgcagactgccctgtgaaggctcagagtgagtcaagagtggaaaaagtagatttctcatcaacgtgttactaaggtttgaacaggaaattctacacatgggctattgtgaaatcagttttatctcatcacacacctccaaaatataggatacttggtctattaaaagtacaaggttgactttgaaagtgtgtcatttagttggttcatttttcaagtgcctatgagaattttttttttttctgtcttgatcacgaacattgtcaaccctcaccttgttaagagtgccttttagactaggttgctaaatcttaacattgcatacttcttttctttatattattttattatgtcacttccattataatagaaaacattctaaaactcatagtaatattatcaactgatatctactgattttttccttaattattctgaaaaattactgcagtaattactcaattgattgtagctggcacaaaaagcatcattgccaaagttatattattaacttctcttagttcttaaatttttgcacttaatttttaaaaatagattatttaatcttcagattacccttgataaaaatatcttggataggtaaaatattaatcaattttgaaatatattagcataccagaaattgaaatattaaatagctattcattacattcttcatttattcatcctccgccataacaaattatgtcgactttcatagaaatatttagttgtaaatgacaaaaactgaagtcaaactatgtatggggaaaaagtaattttaaaatcttactaggaggaaagtcagtaaattggcagaataggtggtcccccacacatatgcccccacagcaacaataatttttcagccatccacagacaaaagttcctttgagggagtttggaattcaagtaggagtttgtaaaatgccagtggaacccaagacctaggaaggttgttttagggaatagatttgcatccaagtggcagacttaccaacagtgattccatctccagacctgaaaagggacccatcctcctgtgcttgccttcagccccatttaggccttggtcatgctgccaaaaccatttgcccaggggcccaggaggagactcacacactagtgtctcaggaggtaggcatatcaactgtagtctcaatgtagaccctgaaacagccctctaacttggctttaactagtgtcagccacaacttgagatcagtccttcacccacagagacttcctgggagacatatacatctgtacctctggggcatgcttgctgacctctgtcctacagaagatactaaaatggccctgaatctccactcaaactcctctcaactgtgacctgagttaatcacaggaaattgctgtgagactcaatcatctttgtcagcagtacaggcttgctgacttcagttccacggtagtttctgaaacagccttgaatcttgaccttcacccttctcagctgtggactgtgagcagtcttgccagctcagggatacagagggaggacatgtgcatccatgtcccaactaggagaccattgacctaggtttcacagcagatcctttaattggacagaaaaggggcttcgacacttctcagctatgctagagagcagtttgcccatacagggacctggagagagacatcattagtgcccctgcaggcacagaccttagttttatttcagatcttgaaacaattctggatccagctccagcccaactcaactacagtctgaggcaaatctgcctgcccacagacctgccagaaaacacactcaaccatgaccccagagacagacatgaagacactggtttcagctatagaccccgaggaaaccttgtgacttagcactaactcctctgtgccacaggttgaggaacccactcagagacccatgagcagccttcccagcaaactagataaactcttccccaactacacacctaataatagacccaccatttacagaccttgaagtggaccctcatcccctccccagccctatacagtatgattctagagccagtttggccctctgaggcactaaataggatacaagcctgctagaagccctagtaaaaggatcatgaaccaaagatcccactctggacccgtaagcaaccatgtgatctggctgtaaccccattcaaccatgatactgaaggcaatctcatcagcccaggacactaacaggagaagcttttaacctaccgaaaccagtctgtaaagactgaaagagagtctgctctttcaaatgcacagacatcagtacaaggataaacaaataacaaagcatcagacaaatatgacaccaccaaaggaaactaataaagctttagcaactgatccaaataaatggagatctataagtttcctttaaagtaattcaaaacaatcatcttaaaaaatctcagtgagatgcaaaagaaaagagtaaacaaaaaatacaactaaaacaaaaaatacatgaacaaaataaaaatttaataaagaaatataaactattaaaaagaaccaaacaaaaattctggagctgaagaacacaatgaaagaaataaataagtcaatagagagttttaatgcccgactcaatcatgcagaggaattagtgaactcaaaaaaagagtcttttaaaattaacaaattagagtaaaaaaagaataaaaagtggcaaagaaagcatgagacctttgagacaccaccaagaatatggtatagaaagtatagaaacttcagaaggagaagagagacataaaaagtcaaaaatattttttctttaaagacatactgtctgaaaaccttcctcacttgggaaggatatggaaatccagattcatgaagctcaatgaatcatgagcaagatcagcccagaaaagactattatgaggcataatataatcaaattgtcaaaagtctaagataagagaatctcgtgggggggttttgtttattttttagcttaatgtgatctcgtttgtccatttttgctttggtttcctgtgattgtggggtattactcaaaaaatctttggccagtcaactgtccttgagaatttttccaattttttttctttcaacttttatttttagatacagggagtacatgtgctggtttgttacatgggtatattataccagaatagtgagtataatccaaagtaggtagttttctgaaccattcttccctgctctcctctcccctctagtagtctgcagtgtcttttgttcccatatttacgtctaagggtgctcagtgtttagctcccacttataagtgagaaccttcagtagttggttttctgttcctgcattaatttgcttaggattatggcctccagctctgtccatgttgctgtagaggacatggttttatcttttttatggctgagtactagtccatggtgtatatatgccacattttctttatccagtccaccactgatgagcacataagttgattccatatctttgctgttgtgaatagtgctgtgataaaaatgtgagtgcatgcgtctttttgatataatgatctattttcatttggttatattcccagtagtgcaattgagggtcaaatggtagctctgtttgaagtattatgagaaatctccaaactactttccacagcggttaggctagtttacattcccaccaatagtgtattagcattttcttttttctgcagcctcatcagcatctgttgtttttggacttttaaatagtggtcattctgactagtgtaagatggtatcttactgtggttttgatttgcatttctctgttgattagtgatgataagtgttttttaatatgcttgctggatacttgtatgtcttcttttaaggagtgtctgtttatgtcctgtgcccatttttaaatgaggttattgtttttccttgttgttctgtttaaattccttatagattctggatattagacctttgtcagatgcatagtttgcaaataatttttcccactctgtaggttgtctgtatatttcattaatagtttattttgctgtgcagaagctttttagtttaggtctcatttgtcaatttttgtttttattgcccttgcttttaaggacatagccaaaaaattgtttgccaaggctgatgttgagaaaggtatttcctaggtgttcttctaaaatttttacagattgaggtatcacatttaaaattttaattatcttgagttaattcttctatatggtgaaaggtaagggtccattttaactcttctgcacatggctagacagttacactagtgatacaggaacgagaaagaaattatttaggcagatagtgagggtaaaggaattctcagcaaggcttcccttttaacaaaaagcagccccaaataacttcttttctaacaaagagcagcctgaaaaatgaagcagcagacatagataagcaggctggagacttgcatgtgtgcatgctggcagctgtgccaatagaaaaggggctgactggaagccaggcattttcaacctggaggctccatcttcccttttctttgtcactaataaagaaccaggcaacatggcacaggccaggtagacaaccatctgcataataaaagactagggttgagtggccagcttctttaagcgctatgcaaatggcatgcctagtccgaccaatctttcgtgccctatgtaaatcagacactgccccctcaagctcatctataaaaccttctacatttcactgcagaagcagcaacccatttctccagtacccatccctgggcagagatctcttctctttcttttgcccattaaacttcctgtcttaacctcactctggtgtgttcacgtcctagttttctgtggtcatgggacaacaaacctcagatattaccctagacaacaaggcgatttcatagcatcatttattgtataagcagtccatttatattcctttttttcttgtctgtctttttgaaaatcagatggctgtaagtgtgcagctttatttctgagttttctattctgttccattaggatagatgtctactttgtaccataccatgctgttctgattaccgtagtcttattgtaaaattggaagttggacagtgtaatgcctccagctttcttctttttgcttaaaattgctttagctattcaggctcttttttggttccatatgaattttagaatagtttttttctaattctgtgaagaatggcattggtagtttgataggaattgcactgaatctgtaaattgccttaagcagtaaggccattttaacaatattgatccttccaatacatgagcttggaaagtttttccattaatttgtgttatctttgatttttttcagtagaattttgtagttctccttgtagagatctttcacctccctggtaggctgtatttattcctatgtatttcattttctttgtgtgtatcataaatgggattgtgttttatattttactctcagcctggagattattagtgtatgggaatgctactgcttttgatacattgatttgatatcctgagaccttactaagatcatttatcagttctggtagccttttggcagtctttttctcatcttttagttttaggtttagaatacatgtgagggtttattacataggtaaactcatgtcgtgggggtttatttacaaattatttcatcacccaagtatgaagcccagtacccaatagttatcttttctgctcctctccctcctcccaccactctccactctcaagtaggccccagtgtctgttgtttctttccttgtgttcatatgttctcatcatttaacttgtacttataagtgagaacatgcagtgtttggttttctgctcctgttagttttctgaggataatagccttgatctccaccaacattcccactaaatatataatcttgttcttttttatggctgcatattattccatgatgtttatgtaccacattttctttatccaatctgtcattgatgggcatttaggttgattccttgtctttgctatcataaatagtgctgcagtgaacatttgcatacatgtgtcattaacgtaaaatcatttatattcctctgggtatatacccagtaatgggatggctgggttgaatggtagttcctcttttagctttttgaggaatcaccatactgctttccacaagggtcgaactaatttgcactctcataaatggtgtataagtgttcccttttctccacaaccttgccagcatcttttttttttttttttttttttttactcttatatagtcatttttactagtgtaaagtggtatctcattgtggctttgattgcatttctgtaacgatttgtgacattgagcttttcttcatatgcgtattggctgcatgtatgtcttcttttggaaagcgtctgttcatgttctttgcccactttttaatggagtttgtttttctctcgtaaatttatttatgttccttatagattctggatatcaaacctttgtcagatgcatagtttgcaaatattttctcccattctgtaggttgactgttgactctgttgatagtttcttgtcctgtgtagaaactcttaagtttaattagatcccacttgtcaatttttgcttttgttgcaattgcttttagtgtctttgtcgtgaaatctttgctcattcctatgtccaggatggtattgcctaggttgcctttcagggtttttatggttttgggttttaaatttaagtctttaatccattttgaattaacttttgtatatagtgtagggaaagggttcagcttcattcttctgcatatagctagacagttatcccagcaccatttattgaatagggagtcttttccccatttcttgtttttgccagcttttttgaagatcagatgatcatgagtgtgcagccttatttctgggctctctattctgtttcattggtctaggtgcctgtttttgtgccagtgccatgttgttttggttactatagccctctattatagtttgaagtcaggtaatgtgatgcttctagctttgttccttttgcttaggattgccttagccactgagactctttttggttccagatgaattttaaaatagttttatttatctagttctgtgaagaatatcgtggtagtttgatagaaatagcactgaatttgtaaattgctttgggcagtatggccattttaacaataatgattcttcctatccatgaccatgggatgttttcccatttgtttgtgtcttctctgattactttgagcagtgttttgtcattctcattgtagacatcttttacttccctggttagctttattcctaggtattttattcattctgtggcagttgtgaacaggactgcctttctgatttggctctcagattgactgtttttggtgtacaggaatgttagtaatttttgtatgtcaattttgtatcctgaaactttactgaagttatcagctgaaggagattttggggtgagactatggggttttctagatgtaaaattatgttgcctgcaaaaagagggagtttgacttcctctcttcctatttggatgtcctttatttccttcccttgcctgattgctctggctaggacttctaataccatgttgaataggaggggtgacagaagtcattcttgccttgtgctgattttcaagggaaatgctttcagcttttgcccattcagtatgatgttaactgtgtatctgtcatagacagctctcattattttgaggtatgttccttcaatacctagtttgttaagagttttaaaatgaaggggttttgaatttatcaaaagccttttctgtatctattaaaataatcatttggtttttgtctttagttctgtttatgtgatgaatcacatttattgatttgcatatgttgaaccagccttgaatcctggggatgaagcctgctcaatcatggtgaattagctttttgatgtgctgctgaattttgtttgcaagtgtttcattgaagatttttgcattgatgttcatcaaggttattggcctgaagtatttttttttttttttagacagagtcttgctctgtcaccaggctggagtgcagtggcgccatcttggctcactgcaacctctgcctcccaggttcaagcaattccccagcctcagcctcccgagtaactgggactagaggcacgcatcaacatgcccagttaatattttgtattttaatagagatggggtttcaccatgttggccaggatcctgacttcgtgatccacctgcctcagcctcccaaagtgctgggattacaggcatgagccaccacggctggcctgaagttttctttttttgttgtgtctctaccagttttggtatcaagatgatgctagcctcacagaataacttagggaagagtcccccctcttcaattttttggaatagcttgtataggaatggtaccagctcttctttgtagaacttgtagaatttggctgtgactctattgggtcctgggcttttattggttggtaggctgtttattacagattcaatttcaaagcttgctcttggtctcttcctggttcagtcttggaagggtgtatctgtccgggtgtttatccatctcttctaggttttccactttgtgtgcatagaggtatttgtggtagttttggtggttgtttttatttctggggggtcaatggtaacagtctattcatcattcataattgtgtttatttgggtctattattctagcaagtggtctatctattgtattatttttttcaaaaaacaactcttggacacattggtcttttcaatggcttttggtgtcttgatttccttcagttcaactccaattttggtcatttcttgtcttctgctagctttggggctggtttgttcttgcttctctaattctttcagttgtgatgttaggtggttaatttgagatctaacttttgatgtgtgtatttagtgttatgaatttccttcttaatgctgccttagctgtgtcccagagattctgctatgttgtatcttttttctcattatattcaaagaacatttttatttctgccttaatttcattatttatccaaaagtcattcaagtgcatgttgtttagtttccatgtaattgcatagttttgagcgatttttatagatttgacttctatttttgattgtgctattgtctgagagtgtgcttggtatgattttcattcttttgcatttgctgaggatggttttatgtttaattatgtgactgactttagagtatgtgccatgtgatgatgagaagaatgtatattctgttgttttggtgtggagagttctgttaaggtctatcagatccatttcatccattgttgagttcaggtcctgaatatctttgttaattttctgcctcaataatctgtctaatagtgtcagtgaagtgttggagtctcccactattattatgtgagagtctatctctttttgtaggtctctaagaacttgctttataaatctggatgctcctttgttgggtgcatatatacttaggatagttaggtcttgttgtctaattgaacctttatcattatgtaatgtcctttgtctttttttgatctttgttggtttaaagtctgttttctctgaaattaggattgaaacccctgcttttttctgtttttcatttgcttggtagattttcctctatccctttattttgagcctatgagtgtcattacatgtgagattggacttttgaagacagcatgccattgagtattgcttttttatccatcttgtcactcctctgcctttttagtggggatatttagccaatttacattcaaggttagtattgatatgtgtgttagctggttatgtttgcttgtttgtgtggttgctttatagtgacactggtctgagtgtttaagtgtgtttttgttttagctggtagtggtctttcctttctatatttagtgctcctttcaaaatttcttgtaaggaaatctggtgacaaaaaactccctcaagatttgtatcagaaaagaatcttatttctccttcacttaggaagcttagtttggtcagatatgaaattcttggctgaagatttttttctttaagaacgttgaatacaggcccccagtctcttctggctgtagagtttcagctgagagactggctgttagcctgatggggtttccttgaagttgacctgccttttctcttgaactgactttaacattctttctttcatttctaccctggaaaatctgatgattatatgtcttggggatgatctttttgtgcagaatcttgcaggagttccctgtatttcctgagtttgactgttggcctctctagcaaggttggggaaattttcatagatgatatcccggaatatgttttccacgttgtatgctttctccccctccctttcagggatgctaataattcatagatttggcctctttatatggaatcttatactcctcagaagttttgttcatttctttttatttttgtctgactgtcttatttcagagaaccagtcttcaacttctgagattctttactcagcttgatttactctgttgttaattcttgcgattgcactgcgaaattcttgtactgcgttattcagctctgtcagagctgttaaattcttttttacactggctatttcattgttcagctcctatatcactttactgtgattcttagtttccttgaattgggttttattatcctcttgaaactcaatgatcttcattcgtatccatattctgaattccatttctgtcgtttcagccagcttacctggttaagagctctcgttggataactggggcggttgtctggagacattctggccttttgagttactggagttcttgctttggttctttctcgtctctgagtgtggatggtcccacaatgagataccatctcattgaattttgatttgcatttctctaatgagcagtgatgatgaactttttttcatatgtttgttggccacataaatgtcttcttttgagaagtgtctctccatatcctttcccactttttgatggggttctttgtttttttcttaagttccttgtagattctggatattagacctttgtcagatggatggattgcaaaaattttctcccattctgtaggttgcctgtttactctgatgatagtttcttttgctgtgcaggagatcttcagcttaatgagatcccatttgtcaattttggcttttcctgcaattgtttttggtgttttggtcatgaagtctttgcccatgcctatgtcctggatggtattgcttaggttttcttctagggtttttatggttttaggtcttactttcaagtgtcagatccatcttgatttaatttttgtataaggtgtatggaaggggtccagattctactttctgcatatggcaagccagttttcccagcaccatttattgaacagggaatcctttccccattgcttgtttttgtcaggtttgtcaaagatcagatggttgtagatgtatggtgttatttctgaggcttctgttctgttccattggtatatatagctgtttacttaccagaactatgctattttcattcctgtaaccttgtagtatactttgaagtcaggtagtgtgatgcctccagctttgttctttttgcttaagattctcttggctatacgggctcttctttggctccatgtgaaatttaaagtagttttttctaattctgtgaagaaagtcaatggtaacttgatgggaataccattgaatctataaattactttgggcagtatgtctgtcttcacgacattgaatcttcctatctatgaccatggaatgtttttccatttgtttgtatcctctcttagttccttcagcaagggtttgtagttcttcttgaagaggtctctcatctcctttgtaagttgtattcctaggtattttattctctttctagcaattgtgaatgggagttcactcatgatttggctctctgcttgtctattgttggtgtataggaatgcttgtgacttttgcacattgattttgtatcccgagactttgctgaggttgcttataagcttaaggagtttttgggctgagacgatggggttttctaaatatacaatcatgtcaatggcaaacagagacaatttgacgtccttttttcctatttggatactctttatttctttctcttgcctgattttcctgccagaacttccaatactatgttgaataggagtagcgagagacggcatccttgtcttgtgctggttttcaaagagaatgcttccagtttttgcctattcagtatgatattggctgtgggcttgtcataaatagctcttattattttgagatatgttccatcaatacctagtttattgagaatttttaatatgaagtggtgttgaatcttatcaaaggccttttctgcatctattgagataatcatgtggtttttgtcactggttctgcttatgtgatggattacgtgtattgatttgcctacttctgtcaatttgtctatctcattctccatccagttttgtgcccttgctgaagaagaactgcgatcatttggaggagaagaggcattctggtttttggaattctcagtgtttttgtgctgttttttcttcatcttcatggatttatctacctttgatctttgaggctgatgaccttcagatgggatttttgtggaggggtcctttttgctgatcttgatgctattgttttttttttggttagtttttcttctaacagtcaggcctctcttctgcagatctgctgcagtttgctagaggtccactccagaccctctttgcctgagtatcaccagtggaggctgcagaacagcaaagattactgcctgctccttcctctggaagctttgtcccagaggggcaccgaattgatgccagctggagctctcctgtatgcagtgtctgttgacccctgttgggaagtctctcccagtcaggaggcatgggggctcagggacccacttgaggaggcagtctgtcccttagcagagctggtgtgctgtgctgggagaatccctcttgtcaggattagttggtctcttcagagccagcatgcaggagagattaaatccgctgaagctgcatccacagccgccctttcgcccagctgctctgtcccagggagacgggagtttatctgtaagccccatggggctgttacctttccttcagagatgccctgcccattgaggaggaatctagagaagcagtctggccacagatgctctgctgcactgtggtaaattctgcccagtctaaatgtcctagcctccttagcactatcaggggaaaactacctactaaagcctcagtaatggcagatgcccctccccccaccaagctggatcatcccaggttgatttcagaatgctctgctggcagtgagaatatcaagccagtggttcttagcttgctgagctccatgggagtgggacccactgagcaataccactgggctccctggcttcagccccctttccagggaagtgaacagttctgtcttgctgaggttccaggtgccactggggtatgaaaaaaactcctgcagctagctcagtgtctgcccaaacagccacccagctttgttcttaaaactcagggcccaggtggcgtaggcacatgagagaatctcctgatctgcagattgcaaaaaccatggcaaaagcataggaaaacatgtagtatctgcaccagatagcacagtccctcatggcttcctttgactgtgggagggaggttcccccggctccttgcacttcccaggtgaagtgatgccccaccctgcttctgctcaccctccatgggttgtacccagtgcctaaccagtaccaatgagataaactgggtatctcagttggaaatgcagaaatcacctgccttctgcattggtgtcaataggaattgcagactggagctggcctgaaatcctgtattgtcattctttgtccttcatttttgttggtttaaatctttttttctgatgtgataatatgactcccgttctttgttttttttttctttcctggttgcatggcagtccttattctatccctttattttaagactgtgggtgttgttacttgtgagatgagtctcttgaaggcagcagatggttggttattttctttttatccagcttgccactctgtcttttaagtgggttgtttagcctgtttacattcatggttagtattgatatgtgtgattttgaaaccgtcaccatgtggtcagcaggttgttatgtagatttgattgtgaatttgctttatagtacttatgggccataagtttaagtgtgttttgtggtagcaggtgtcaatcttttagttccaagtttagctctcccttaataacctcttgtaaggccgatttgtttaaaaaaattccctcaaaatttgcttgagaaggatttttttccacttaagaagcttagttcagtggaatatgaaattcttggttggaattttttccttctgggtgctgaaaatatgcccccaatatcttctggcttctaaggtttctgctgagatgtctgctggtagcctaatggcatcccctctgtctgtgacttcacccttcaatctagctgcctttaagatacttttcttttgtattgacattgtgaatttgatgactatgtgccttcagtctggtcattgtgtatagtatctcattgggattccctatatttattagattgtgtgtcaacctctctagtgagattagggaaattttcttggactatgtcctcaaatatgttttctaagttgtttattctctctcctcctctcgaagatgccaaggagttgtagattttgtctctttacataatcccacatttcttgaaggatttgttcaatttttaaaattcttttttctgtatttttgtctgactgagttgatttgatgatctggtctttgagttcagagattatttcctcagtttggtccattctgctgttagtacttctgattgtattataaaatactgtagtgaaatttttagctccagaagttcagtccagttatttctcaaaatgactatttcatctttcagctcatttattgtcttactctatttgttggattccttggattaggtttcaactttcttgtgaatcttgatgagttttcttgccatccagattctgaattctatgtttgtccagtcatttctgactggtgaagaactattgcgggggagctagtggactagtttggaggtaagagagaactctggctgcttgaattgccagagttcttgcaccagttttttctcatctgggaggacggatgttcttttaactgtggggtaagtttagtcacttggcttcatttctgaaaactttcaatgggacacacagggaagacagtttggctgtctctccacagggtggctgcgatgtattggaggcatgaacaaagaagcaaagcaatcagggtatttgttccttctccagcccaggaacagcaagggtgggtaccacagtaggcagtcatagaggggctctcagttgcctctgggagaatcacagatccactaccaatcagagtaatcatccagggctagggtgtctgcactgcaggcccaagccagagggctatgcctggcaaaaccagaagggtcagagactatcggggaagatgagctgtcctctttgtaggatggccactggcactttaattgcctgaaattagtcagactctttgtatcctccatatcctagggggagaagggactggaatcactgtggaggcaatggcagagagcctgatggttgcctctgggagttccactttagagcaatacaggacggccattgccattgaataaagtgatcaggcaggggaaaggcagctgcattgggccccaggccaggagatcctgcccagtaagatgtagcagggtcgagaagccatgtggacaatggcctggccacttttccatatggcagtgcagcacgctggaggccaatgacagttcttgggctattcactccatccccagcctgacggcagcagtggcagggagcatgacagcagcattcacagcaagcctgtcagttacatctgggagctccattacagagaaataaagagctacaaccagctgtagtgctcaggcaggaatggagtggctacatcatggtaacaggccaattggctttgcttggagagatgcagcagaggcaaggcctgaagtccatctgctcctcagcactgtggatgtggccaataacatgagggtatttaagactgcctgacaactcttgttgggaggcctatgggatctgttgctgaggtcctcaacaacagaggaccttgcattccttgaggaatgcaagacctatgggactacacatgggcctgagaagcctctctacccagatagcaggcagatcttcatgttggtctgaaggctaggggagagaaagcagttagaggggatctcccatgcccaggaatgaaagttctgttgcagaagtgttggtcccctgggattcttgctcactcaccctttctccatggtagaaaggtccccttggctctgtacctatcccaggccaggagagagagaatattgaaatcagtaagaaatgacataatcgaatacaggggaaactacataatactatcagcaaacattttaacaaaaattttgcaagacaaaagacagtgggctgatatattcaaagtgctgaaaaagaaaaaaatcttcaaaccaaaatactaaacctggaaaaactgttcttcaggaatgaaaggaaaataaagacatttccagataaacaaaagctgagggagttcaccaccactagacttgccttacaagaaatgctcaagagaatttccacagttgcaatgaaataacgctaattaataacattaaaaacaaaaataaaaaaactcacttgtaaaggtaaatatgtagtcaaattcagaatactctaatactgtaatagtcgtgtaaatcatttatattactagtataaacttaaaagacaaaactatcaaaaagacttatacctacaataatttgttaaaggatacacaacatttaaaaatgtaaattgtgcatcaaaaacattaaatgagggaaaaagtgtagagttgtgatatgcaatcaaactggagttgttattagtttaaaataaattggcataactgcaagattttctatgttagcttcattttaatcacaaatcaaaaacctatagcagatacacaaaagaaaaagagaaagaaatcaaaacatactgatatggtttggctctgtgtccctacccaaatctcatctcaaattgtaatccccataatccctacatgtggagggcaggacctggtgggaggtgattggatcataagggcagttgctcccacgctgttctcatgatagtgagtgagttttcacttgagatctgatggttttataaggggctcctcccccttcacttccttcacgtgttctctcccttgtcaccatgtaagacatgcctgcttacccttctgctgtaattgtaagtttcctgaggcctccccagccatgcagaactgtgagtcaatgaaacctctttattttataaattacccagtctcaggtagtatttttatagcagtgtgagaatggattaatatatataccattacagaaaataataaaatcacaaaagtataaaaaaagagaaaaagaaaggaacaaaagatctccaaaaaaccacaaacaataaaatggtagtagcaaatttttttctatcaatgattaccttgaatcaagaaagaatgaactattcaatcaaaagacatagattggctgaatggaaaaacaagacacccagctatatggtgcctacaagagacccatttcagcttaagtacaaatgtagactgaaagggaaggaataaagaaagataattcatgcaaatagaaaccaagagacagcaggaatagctatacttctatcagacaaaataaactataactcaaaaactgtaatatatacacttagcaagagatcacctaaatatataggccaaatattaataggtctgatgaggaagatagatagcaatacattaatagtagaggatttcgatatgtcaattcaataacagattactcagacagaaattcaataatacacaggacttgaaatgaactttaaaccaaataagtctatcagacatatacagaacatttcatcccaaagcagaagaataaacattcttatgaagcgcacataagtcattctccaggatagattacatgtcaggccacaaaaaagtcttcaaaaattttaaaaagattgaaatcatactaagcattttttctgaccacaaaggtatgagatgaaaaaccattaacagggtgagattttaaaaatcccgaaatatgcagaaagtaaacaacatgctcctgaataaccaatggatcagagaagaaatcaagaaggaaataaaaaagatcttgagactgacaaatgaaaatggaaatagtaaaacttatggtatgcagaaaaaacagttctaggagaaaatttatagcaataaacacctacataaaaaagaagaaagatctgaaataaagaattcaattttacaactcaaggaactagatgaagaacaacaaagcataaattttgtagaagaaagaaaataataaagaacaaattagaaatcaacgaaataacctataaaacaatagaaaagttaatgagcttaagagttagttttttgagaagataaatgaaattgacaaacatttagttagactaagaataaagggagaataatcaagtaaataaaatcagacatgaaagaggcagcattataacttacattgtataaatgtacagtgccataaaagactattgtgaacaattatacatcaaatagttggataacttggaagaaactgatatagtccttgaaacatacaatctattaagaataaatcactaagaaatagaaaatatcaactgatcaataattagtaagggcattgaaaaagtaatcaagatttctcaaggactgcagggcttgacagctttataacaaacatttaaataatagctgataccattggcctacatacctactttttttttttttttaactagtaccatgttgtttgggtaactatagcctggtagtatagtttgaagtaaggtaatgtgatgctctagatgtagtttttatttatttatttatttatttttattatactttaagttctagggtacatgtgcacaacgtgcaggtttgttacgtacatatacatgtgccatgttggtgtgctgcacctgttaactcgtcattaacaggtatataacattaagtatatatcgatatatcgatataacattaagtatatctcctaatgctatccctcccccatccccccaccccacaataggccccaatgtgtgatgttcctcatcctgtttccaagtattcccattgttcaatccccagctatgagtgagaacatgcggtgtttggtttcctgtcctttcgatagtttgctgagaataatggtttgcagcttcatccatgtccctacaaaggtcatgaactcatcctttttaatggctgcatagtattccatggtgtatatgtgccacattttcttaattcagtctgtcattgatggatatttgggttggttccaagtctttgctattgtgaatagtgccacaataaacatacgtgtgtgtgtgtctttacagcagcatgatttataatcctttcggtatatgcccagtaatgggatggctgggtcaaacggtatttctagttctagatccctgaggaatcaccacactgttttccacaatgattgaactagtttacactcccaccaacagtgtaaaagtgttcctatttctccacatcctctccggcacctgttgtttcctgactttttaatgatcatcattctaactggtgtgagatggtatctcattgtggttttgatttgcatttctctgatggccagtgatagtgagcattttttcatctgtctgttggctgcataaatgtcttcttttgagaagtgtctgttcatatcctttgcccactttttgatggggttgtttgattttttcttgtaaatttgtttgagttctttgtagattctggatattagccctttgtcagatgggtagattgtaaaaaatttctcccattctgtaggttgcctgttcactctgatggtagtttcttttcctgtgcagaagctctttggtttaattagatcccatttgtcaattttggcttttgttgccattgcttttggtgttttagtcatgaagtccttgcccatgcctatggcctgaatggtattgcctaggttttcttctagggtttttatggtttgaggtctaacatttaagtctttaatccatcttgaattaatgtttgtataaggtgtaaggaagggatccagtttcagctttctacatatggctagccacttttcccagcaccatttattaaatagggaatcctttcgccatttcttctttttgtcaggtttgtcaaagatcagatggttgtagatgtgtggtattatttccgagggctctattctgttccattggtctatatctctgttttgataccagtaccatgctgttttggttactgtagccttgtagtatagtttgaagtcaggtagtgtgatgcctccagctttgttcttttggcttaggattgtctcggcaatgtggactcttttttggttccatatgaactttaaagcagtttttttccaattatgtgaagaaagtcattggtagcttgatgggaatggcattgaatctgtaaattaccttgggtagtatggccattttcacaatattgattcttcctatccatcaacatggaatgttcttctatttctttgtgtcctcttttattttgttgagcagtggtttgtagttctccttaaagaggtccttcaaatcccttgtaagtaagattcctaagtattttattctctttgaagcaattgtgaatggagttcactcatgatttggctcctgtttgtctgttattggtgaataggaatgtttatgatttttgcacattgattttgtatcctgagactttgttgaagttgcttatcagcttaaggagattttgggctgagatgatggggttttgtaaatatacaatcatgtcatctgcaaacagggacaatttgacttcctcttttcctaattgattaccctttatttccttctcctgactaattgccctggccagaacttccaacactatgttgcataggagtggtgagagagggcatccttgtcttatgccagttttcaaagggaatgcttccagcttttgcccattcggtatgatattggctgtgggtttgtcataaatagctcttattattttgagatatgccccatcaatacctagtttattgagagcttttagcatgaaaggttgttgaattttgttgaaggccttttctgcatctattgagataatcatgtggtttttgtctttggttctgtttatatgatggattatgtttattgatttccatatgttgaaccagccttgcatcccagggatgaagccaacttgatcgtagtggataagctttttgatgtactgctggattcagtttcccagtattttattgaggatttttgcatcgatgttcatcagcgatactgatctaaaattccttttattgtgtctgtgccaggctttggtatcaggatgatgttggcctcataaaatgaattagggaggatttcctctttttctattgattggaatagtttcagaaggaatggtaccagctcctccttttacctctggtagaatttagctgtgaatccgtctggtcctggactttttttggttggtaggctattaattattgcctcaatttcagaacctgttattggcctattcagggatacaacttcttcctggtttagtcttgggagggtgtatgtgtccaggaatttatcgattttttctagattttttagtttatttgcgtagaggtgtttacagtgttctctgatggtagtttgtatttctgtgggatcggtggtgagatcccctttatttatttattcatttatttattttgcatctatttgattcttctctcttttcttctttattagtcttgctagcgatctatcaattttgttgatcttttcaaaaaaccagctcctggattcattgattttttgaagggttttttttggctctatctccttcagttctgctctgatcttagttatttcttgccttctgctagcttttgaatgtgtttgctcttgttttttagttcttttttttgagatggagtcttgctctgttccccaggctggagtgcagtggcgtgatctcggctcactgcaacctccacctcctgggttcacgccattctcctgcctcagcctcccgagtacctgggactacaggcacccaccacgtctggctaattttttatgttttcagtagagacaggatttcactgtgttagccaggaaggtcctgatctcctgacctcgtgatccacctgccttggcctcccaaagtgctgggattacagatgtgagccaccgtgcccagcgaattttctagttcttttagtggtgatgttagggtgtcaattttagatctttcctgctttctctcgtgggcatttagtgctacaaatttccctctacacactgctttaaatgtcccagagattcttgtacattgtgtctttgttctcattggcttcaaagaacatctttatttctgccttcatttcgttatgtactcagtagtcattcaggagcaggttgttcagtttccatgtagttgagcggttttgagtgagtttcttaatccttcgttctagtttgattgcactgtggtctgagagacagtttgttataatttctgttcttttacatttgctgaggagtgcttcacttccaactatgtggtcaattttggaataagtgtgatgtggtgctgagaggaatgtatattctgttgatttgaggtggagagttctgtagatgtctattaggtccgcttggtgcagagctgagttcaattcctggatatccttgttaacttcctgtctcattgatctgtctaatgttgacaatggggtgttaaagtctcccttattattgtgtgggcgtctaagtctctttgtaggtctctaaggacttgctttatgaatctgggtgctcctgtattgggtgcatatatatttaggatagttagctcttcttcttgaattgatccctttaccattatgtaatggccttctttgtctcttttgatctttgttggtttaaagtctgttttatcagagactaggattgcaacccctgcatttttttgttttccatttgcttggtagatcttcctccatccctttattttaagcctatgtgtgtctccgcacgtgagatgagtctcctgaatacagcacagtgatgggtcttgactcttcatccaatctgccagtctgtgtcttttaattggagcatttagcccatttacatttaaagataatattgttatgtgtgaatttgatgctgtcattatgatgttagctggttattttgctcgttagttgatgcagtttcttcctagcattgatggtctttacaatttggcatgtttttgcagtggctggtaccagttgttcctttccatgtttagtgcttccttcaggagctcttttagggcaggcctggtcgtgacaaaatgtctcagcatttgtttgtctgtaaagtattttatttctccttcacttatgaagcttagtttggctggatatgaaattctgggttgaaaattcttttctttgagaatgttgaatattggcccccactctcttctggcttgtagagtttctgccgagagatctgctgttagtctgatgggcttccctttgtgggtaacccgacctttctctctggctgcccttaacattttttccttcatttcaactttggtgaatctgacaattatatgtcttggggttgctcttctcaaggagtatctttgtggtattctgtgtatttcctgaatttgaatgttggcctgcctcactaggttggggaagttctcctagataatatcctgaagagtgttttccaacttggttccattctccccatcactttcaggtacaccaatcagatgtagatttagtcttttcacatagtcccatatttcttggaggctttgtttgtttctttttactcttttttctctaaacttcttttctcgcttcatttcattcatttgatcttcaatcactgatatcctttcttccacttgatcaaatcggctactgaagcttgtgcatgcatcacatagttctcgtgccatggttttcagctccatcaggtcatttaaggacttctctacactgttgattctagttagccattcgtctaatttttttcaacgtttttagcttctttgtgatgggttcgaacatcctcctttagcttagagaagtttgttattactgatcttctgaaggcttcttctctcaactcgtcaaattcattctccatccagctttgttccattgctagtgaggagctgtgttcctttggaggagaagaggcactctgatttttagaatttttggcttttctgctctggtttcttcgcatctttgtggtttttacctacctttggtctttgatgatggtgatgtacagatggggttttggtgtggatgtcctttttgtttgttagttttccttctaacagtcaggaccctcagctgcaggtctgttggagtttgctggaggtccaccccagaccctgtttgcctgggtatcaccagcagaggctgcagaacagcaaatattgcagaacggcagatgttgctgcctgatacttcctctggaagcttcgtctcagaggggcacctggctgtatgaggtgtcagttggcccctattgggacgtgtctcccagttaggctactcgggttcagggacccacttgaggaggcagtctgtccgttctcagatctcaaactccgtgctgggagaaccactactctcttcaaagctgtcagatagggatgtttacatctgcagaagtttctgctgccttttgttcagctacaccctgcccccagaggtgcagtctacagaggcaggcaggcctccttgagctgtggtgggctccacccagtttgagcttcccagccactttgtttacctactcaagcctcagcaatagtggacgcccctcccccagcctcactgccaccttgcagtttgatctcagactgctgtgttagcagtgagtgaggctccatggcatgggaccctccgagccaggcgcaggatataatctcctggtgtgccacttgctaaggccattggaaaggcacagtattagggtgggagcgccccaattttccaggtactgtctgtcacagcttccctttgctaggaaagggaattccagaccccttgcgcttcccgtgtgaggtgatgccccaccctgctctgtgggctgcacccattgtctgataagccccagtgagatgaacccggtacctcagttggaaatgcagaaatcacccgtcttctgcactgctcatgcttggagctacagaatggagctgttcctatttggccatcttggaacctcctttatttttatttttattttttgcttagtcttgctttggctatgtgggctctgttttggattcaagaatttggtgtcaatgtggtgaaaagggagcacttttacactcctaatgggactataaacttgtacaaccactatggaaaacagtatggagattccttaaagaactataagtagaagtgccatttgatccagcaatcccactactgggtatctacccagaagaaaagaagtcattacatgaaaaagacacttctacatgcatagaactagcctaaatgcccatcaaccaaggagttgataaagaaaatgtggtatatatatatattatacgcacacacacacacacacacacacacatacacacacaccctggaatactactcgctcataataagaaaaaaaataatagcattcgcagcaacttggatggagctggagaccattattctaagtgaagtaactcagaaatggaaaatcacttatgttttcacttataagtgggagctaagctatgaggacacaaaggcatatgaatgatataatggactttgcggattcaggggaagggtaggaggggggcaaggaataaaagaatacatactgtgtacagtgtacactgcttgagtgatgggtgcaccaaaatctccgaaatcaccactaaataacttatccatataaccaaaaaccacctgttctcccgaaactattgaaatataattaaatttaatctaatttaaaaagaagaactaatactaatccttcacaaactcttctaaaaattcaaagaggagggaatactttctaactcattttatgagtccagcattaccctgatactaaagcaaaacaagcacactacaaaaagaaaataacaggaaataacaggacaatatccctaatgaacatagatgcaaaaatcttcaacataatagtaccaaattgaatttaacagcatgttaaaaggatcatttaccattattaagtgggatgtattactggaatgcaagtgtagttcaacctatgcaaatcaataaacataatacaccattttaatggaataaatgacaaaaaactatatggtcatctcaatagatgcagaaagacatttgacaaaatttaacatctttttaaaataaaaactatcaacaattaagtatatataaaatacatctttacataattaaagggcatatatgacaagcccacagctaacatcatactccattgtgaaaaattaaaagatatttctaatttcaggatcaaaacaaggatattcactctcaccatttttagtcaacatagtactgaaagttctagccatagcaattaggctaaaaaaaattaaaggtacccaaattggaaagaaaaaggttaaattggctctgcagacaacttgattttagatacagaaaaccataaagtcttaaccaaaaaactgttacaaataatcaattaattcagtaaatttacaggataccaaaacaacatacaaaaattaataatgtttcaatgcactaatagtaagccatttgaaaaaaaattgagaaaacaatctcactttacaaaagcattaaaaaatgcttaggaatatagttgaccaaaaaagtaaaagatctgtacactgaaaactatgtaacaatgatgaaaaaaattgaagaagacaaaaataaatagaaagatatcctgttttcatgaactggaataatcaatattattaaaatgttcgtaacacccaacacaacctactaattcaatgtaatcttcatcagtatcccagtggcatttttactgaaatagagaaaaatagtcttaaaattcatataaaatcacagaagacctcaaatagccgacatcttcagcagaaaggacaaagctgaaaatatcactattttagttcaaatttgctacaaaggtgaataatccaaacagcttggtattggcacaatagagatatgtagaccaactgaacagaatggagatcctagaagtaaatccacacatttatggtcaacttgctttcaacaagtgccaagaaaacacaatagacaaaagacaatcttttcaataaatagtgtaaaggaaactagatattcacaagcataaaaaagaaatgggacccttttcttatcctttataaaaaatcaacacaaaataaacaactaaatgtaagacatgaagctgtaaaactactaaaggaaaacacaatgaaaaatcttcttgacattgatctgggcaaagacattttgacattacctcaaaacaaaagcaagagggtggctggcaagatggccaaataggaacagctcctgtctgcagctcccagcaagatcaacacagaaggtgggcgattcctgcatttccaactgaggtagccagttcatctcattgggactggttagacagtgagtgaatcccacaaagagcgagctgaagcagggtggggtgatgcctcacctgggaagtggaaggggtcggaaaactcactcccttagccaagggaagctgtgagggactgtgccatgaggaatgatgcactccagcccatatactaggcttttcccatggtcttcacaacttgcagaccaggagattctctcaggtgcctacaccaccagagccctgggtttcaagcacaaaactgggtggccatttgggcgggcaccgagctagccgcaggagtttttttcacaccccagtggtgccttgaacacctgcaagacagaaccattcactcccctggaaaggcggctgaagccagggagccaagtggtctagctcagtggatcccacccccacggagcccagcaagctaagattcactggcttgaaattctcactgccagcacagcagtctgaagttgacctgtgatgcttgagtggggaggggcatctgccattattgaggcttgagtaggtggttttccccttacagtgtaaacaaagccaccaggaagttcgaactgggtggagcccaccacagctcagcaaagcccctgtagccagactgcctctctagattccgcctgtctgggcagggcatctctgaaagaaaggcagcagccccagtcaggggcttatagataaaactcccatctccctgggacagagcacctgggggaagggtggctatgggtgcagcttcagcagacttaaatgttcctgcctggcagctccaaagagagcagcagatttcccagcacagcgctcgagctctgataagagacagactgcctcctcaagtgcgtccctgacccccatgccgcctgactgggagacatctcccagcaggggtgacaaacacttcatacaggagagctcctgctggcatctagcgggtgcccttctggggcgaagcttccataggaaggaacaggtagcaatctttgctgttctgcaacctccactggtgatacccaggcaaacagggtctagagtggaccttcagcaaactgcagcagacctgcagcagaggggccagactgttagaagaaaaactaacaaacaggaatagcatcaacatcaacaaaaaggatgtccacaccaaaaccccaaaggtcaccaaaaatccaaaggtcaccaacatcaacgaccaaatgtagataaatccatgaagatgaggaaaaactggtgcaaaaaggctgaaaactctaaaaaccagaatgcctcttcacctccaaaggatcacaactcctcgccagcaagggaacaaaataagggagaatgagtttgacgaattgacagaataggcttcagaaggtgggtaataacaaacttctctgagctaaaggagcatgttctaacccaatgcaagaatgctaagaaccttgaaaaaaggttagaggaatagctaactagaataactagtttagaaaggaacataaatgacctgatggaggtgaaaaacaccccaagagaatttcgtgaagcatatacgagtagcaatagccaaatcgatcaagtggaagaaaggatatcagagattgaagataaacttaatgaactaaattgtgaagacaaaattagagaaaaaagaatgaaaaggaacaaacaaaccctccaagaaatacgggactatgtgaaaagaccaaacctccatttcattggtgtacctgaaagtgatggggagaatggaaccaagttggaaaacactcttcaggatattatccaggagaacttcccgaatctagcaagacaggccaacattcaaattcaggacatacagagactaccacaaagatactcctcaagaagagcaatcccaagacacataatcatcagattcaccaaggttgaaattaaggaaaaaatgttaagcacagccagagagaaaggtcgggttacccacaaagggaatcccatcagaccaacagcagatctctctgcagagaccctacaagccagaagagagtgggggccaatactaaaccttcttaaagaaaagaattttcaacccagaatttcatatccagccaaactaggtttcataagtgaaggagaaaaataatcctttacagacaagcaaatgctgagagattttgtcaccactaggcctgcctcacaagagcttctgaaggaagcactacgtatggaaaggaaaatctagtaccaaccatgcaaaaacacacaaaaatataaagaccaatgacactatgaagaaactgcatcagctaatgtgcaaaataatcaggtagcatcataatgacaggattaaattcacacataacaatattaaccttaaatgtaaatgggctaaatgccccaattaaaaggcacagattggcaaatggataaagaggcaagacccattggtgtgttgtattcaggggacccatctcacatgcaaagacacacataggctcaaaataaaggggtggaggaagatttaccaagcaaatggaaagaaaaaaaaagggagggtttgcaatcctagtctctggtaaaactgactttaaaccaataaagatcaaaagagacaaaggccgttacataatggtaaagggatcaattcaacaagaagatctaactatcctaaatatatattcacccaacacacgagcacccagattcataaagcaagttcttagagacctacaaagagacttagactcccacacagtaatagtgggagactttaacaccccactcttaatattggacagatcaacgacacagaaaattaataaggatattcaggacttgaactcagctttggaccaagaagaccaaatagacatctacagaactttccaccccaaatcaacagaatatacattcttctcagcaccacatcacacttactctaaaattgactacataattggaagtaaaacactcctcagcaaattcaaaagaacagaaataataccaaacagtctctcagaccatagtgcaatcaaattagaactcaggattaagaaactcactcaaaattgcacaactacatggaaactgaacaaccttctgaatgactgctgggtaaataacaatattaaggcagaaataaataagttctttgaatccaatgagaaaaaagacacaacataacaaaatctctgggacacagctaaagcagtgtttagagggaaatttatggcactaaatacctacaggagaaagtgggaaagagctaaaattgacaccctaatatcacaatgaaaagaactagagaaacacaagtacacaaattaaaaagctagcagatgacatgaaataactaagatcagagcagaaccgaaggagataaagacaaaaaaaaccttcaaaaaataaatgaatccaggaggtggttttttgaaaagatgaacaaaaaacatagaccactagccagactaataaagaagaaaagagagaagagtcaaatagacacaataaaaaatgataatgggaatatcaccactgatcccacggaaatataaattatcatcagagaatactataaacacctctgtgcaaataaactagaaaatttagaagaaatggataaattcctggacacatacaccctcccaagactaaatcaggaagaagtcaaatccctgaatagaccaataaccagttgtgaaattgaggcagtaattaatagcatacctaccaaaaaaagcctaggaccagacggattcacacccaaattctaccagaggtacaaagaggagattgtagcattccttctgaaactattccaaacaatagaaaaagagaaactcctccctaactaattttatgaggccagcatcatcctgacactcaaatttggcaaagacaacaaaaaaaaagaaagtttcaggccaatatccctgatgaacatcgatgtgaatgtcctcaataaaatgctggcagaccaaatccagcagcacatcaaaaagtttatctaccacgatcaagtcagcttcatccctgagatgccaggctagttcaacatatgcaaatcaataaatgtaatccattacataaacagaaccaatgacaaaaacacatgagtatctcaatagatgcagaaaaggccttcaataaaattcaacacaccttaatgctaaaaactcactaaactgggtattgatggaatgtatctcaaaataataagaagtatttatgacaaacccacagccaatatcatactaaatgggcaaaagctggaagcattccctttgaaaactgacacaagacaaggatgccctctctcaccactcctgttcaacatagtattggaagttctggccagggaaatcaggcaagataaagaaataaagagtattcaaataggaagagagaaagtcaaactgtctctgtttgcagaagacatgattgtatatttagaaaaccccattgtctcagcccaaaatcttaagctaataaataacttcaggaaagtctcagcatacaaaaatcaatgtgcaaaaatcacaagcaatcttgtacaccaacaatagacagagagccaaattatgagtaagctcccattcacaattgctacaaaagagtaaaatacctaggaatacaacttacaagggatgcaaagggcctcttcaaggagaactacaaatcactgctcaaggaaacaagagaggacacaaacaaatggaaaaacattccatgctcatggacagcaagaatgaatatcgtgaaaatggccatactgcccaaagtaatttatagattcaatgctattcccatcaagttaccattgactttcttcacagaattagaaaaaattactttaaatttcatatggaaccaaaaaagagcctgtatagccaagacaatcctaagcaaaaagaacaaagttggagccatcatggtacctgacttcaaactatactaacaaggctacaggaaccaaaacaacatggaactggtaccaaaagagaaatatagatcagtgaaacagaacagaggcctcagagataacgccacacatctacaaccatcttatctttgacaaacccgtcaaaagcaagcgatagggaaaggattccctatttaataaacggtgttgggaaaactggctagccatatgcagaaaactgaaactggaccccttccttacaccttatacaaaaattaactcaagatggattaaagacttaaatgtaagacctaaaaccctagaagaaaacctaggcaataccattcaggacataggcatgggcaaatacttcacgactaagacaccaaaagcagtggtaacaaaagccaaaattagcaaatgggatctaattaaactaaagaccttctgcacagcaaaacaaactatcatcagagtaaacaggcaacctacacaatgggagaaaatttttgcaatctatccatctgacaaagagctaatattcagaatctacaaggaacttaaacaaatgtacaagaaaaaaaaacaagcaatcccatcaaaaagtgggcaaaggatatgaagagacacttctcaaaagaagacatttatgtggccaacaaacatatgaagaaaagctcatcatcactggtcattagagaaatacaaatcaaaaccacaatgagataccgtctcatgccagttggaatggcgatcattaaaaagtcaggaaacagcagatgctggagaggatgtggagaaataggaacgcttttatactgttggtgggagtgtaaattagttcaaccattgtggaagagagtgtggcgatttctcaaggatgtagaatcagaaatatcatttgacccagcaatccccttactgggtatatacccaaaggattataaatcattctgctataaagacacatgcacatgtatgtttatggcagcactgttgacaatagcaaagaattggaaccaacccaaatgctcaccaatgatagactggataaagaaaatgtggcacatatacaccatacaccatggaatactatgcagccataaaaaaggatgagctcatgtcctttgtagggacatggatgaagctggaaaccatcattctcagcaaagtaacacaggaacagaaaaccaaacactgcatgttctcactcattaagtgggagttcaacaatgagaacacatggacacagggaggcaaacatcacacactgagagctgtcggggagtggagggctaggggaaggatagcatttggagaaatacctaatgtagatgacgggttgatgggtgcagcaaatcagcagggcacatgtatacctatgtaataaatctgcaagttctgcacatgtatccccagaacttaaagtgtaataataaaaaaagcaagagacaaacaaaattacatcaaacgtaaaaagctactgcactgaaaaagaaaaaaaaaacaacagagtaaagaggcaatctaaaaaattagggaaaatattttcaaaccatatgtctgacaaaaggttaataatcaaaatatataaggaactaaacaactcaataaaaaatatattaaaaatggacaaagaacctgaaaatgtatttcttaaaagaagatatacaaatggccaacagatatataaaaacatgctcaacatcactaatcatcaggaaaatgcaaattacaaacaggataactaatcatttgacatctgttaggaaggctgttataaaaaaaacaaaagatgtcacatgttcattaggatatgaaaaaaagggaacccatgcacattcttagtggaaatgtaaattagtacagtagtaatgaacaacagtgtggagatttctcacaaaattaaaaaataaagctaccatatgatccaacaattcaactactggttatatttccaaagggaagcatattaatatatcaacaatctatctccttgtccacgtatattgcagcattatttaagatagccatgaaatgtaatcaaactaagcgtttatcagtggatccatagataaagaaaatgtggtatgtacaaacaaaggaatatgactcagccttaaaagagaaggaaactgtcatttgtgacaacataaatgaatctagaggacatccagctaagtgaaaaatgccagccatataaagacatatatcatatgatctaacatggatgtatattccaaaaacagttgaactcatagaaatagcgacaagaatagtattaagtctatagattactttgggccatatggccattttaacattattgattcttcctacccatgaacatggaatttctttttattagtttgtgtcatctatgacttctttagcagtgttttctatttctcttcatagatatttttcaccacctttgttagatgtattcctaggtatgttgtgtgtgtgtgtgtggctgttataaatgggattatgttcttgatttggctctcagcttgaatattatcggtatatagaaatgctactgatttttgtatatttactttgtttcctgaaaattgattaaagccacttatcagtgcaagggttcttttggagcagtctttagggatttctgggtatcaaatcacataatctgcaaagagaggtagcttgacttcttcttttcttatttggatgtgttttatttatttctcttccctgattgctctggctaggaattccagtcctatgttgaataggagtgatgagagtgggcatccttgtctttttctagttttcaagggaaatgcttctagttattgcctattcagtatgatattgcctgtggtttgtcatagatagctcttctcattttgagatatgttccttcagtgcctagtttgttgtgagtttttatcaagaagccatgttagatttcatcaaaaaatttttctgcatctgttgagatgatgatattttttttgtttttgattgtttatgtggtaaatcacatgtatggatttgcatatgttgagtcaaacttgcattccaagaataaagcccacatgattgtggtgaattgttttttttgaggtactgctgaattcagtttgctagtattttcttgaggatttctgtatctatgttcatgagggatattggcctgcagatttctttttctgatgtgtctttgtctcgtttggtaccagggtaatattggcctcatagaatgagttgaagcttattacttcctcctctattttttcagaatagtgtgagtaggattggtattagttctttaaatatttggtaaaatttatcagtgaagccatcaggtctcaggctattctttgctggaagactttttattgcagctttgatttcattatttgttattggtctattcaggttttgaatttctttatggttcaatcttgggaggttatatgtgtttatgagtttatccaactttaagttttcaaattcattggcatatagctgctcagagcagtctctaatgattctttaaatttctgcagtgtcagttgtattgtctccttgttcatctctgatttttttattttggtcttctttctttttttcgtagtctggctaaaagtttgtcaattttgtttatctttttgaaaaacaaactttttgattaatcttttgtattttttaaaatttcaatttcacttattgcaagtctgatttttattatttctttccttctaattttgggtttggtttgctttcacttttctacttcaagatccattgttgggttgtttatttgaagtttttctacatttttcatgaagttgcttattactctaaactttcctcttagcactacttttgttgtatcccataagttttgttattgtatatttccattttcatttgtttcaaaataattttgtattcccttcttaatttcttcattgacttactggtcattccggagcatattgcttaatttttatgtatttgtatagtttccaaagttcctcttgttgtcaatttctagtttattccactgtagtcagaaaacatacttgctatgagttcaatttttttgaattttttaaagtcctgttttgtggtctaacatttgaaagaaacaaatataatctattccta

SEQ ID NO: 1820 - DNA, 17387 bp, Homo sapiens
aagtaaaacagaaacttttctctcctttgagaaggattttgcagccccagaccagacctcgtctctcgcctggaacagtgggaggagccgtgggttgaagaccgggagagacctgagttccaggcagtgcagaggggaccccggccaggtgagtgctgggctgtctgggctcggcgggccccgtccctgtggcccacagctcctgggtagtgctcagcacgctgcagtgaccaagggtgtgtccttcccatgggagagcagacacacagctgctctctaaattagacaggcattagagacgtaggggcagccacgctcctgccctgatggacactggccgggggtggggctcgaaaggcatagtgctgcaggatgacatacagctgcagctcggaggggcctgaggctggagtgacacttgaagcctgcacctagccacccaggtgctgtccggcggaggccattggtgtgggtgtctgacctccctgtgatggccatgtggggtcccaggcctggtactgactgcacgtgagggtctccaggtatgtggctctgggtaggagtttgctccacgtccttgtttgcaaaactgggacagtggccatgcttccctccattaggtgagggttgctcttggggcagttgtcagcagggttttgctttttacttacattttcagagtgggatggagcagctatgtgaacacgagccctgggaggtccccgggtatgtggagtccccgactgtggagtgtcaggttcctaggtgtgtggagcccccgactgtggagtgtcaggtccctgggtgtgtggagcccctgactctggagtgtcaggtccccgggtgtgtggagcccccggctggggaggtgtcggatccccgggtgtgtggagcccccggctggggaggtgtcggatccccgggtgtgtggagcccccggctggggaggtgtcggatccccgggtgtgtggagcccccggctggggaggtgttgcatccccgggtgtgtggagcccccggctggggaggtgtcggatccccgggtgtgtggagcccccggctggggaggtgtcggatccccgggtgtgtggagcccccggctggggaggtgtcgcatccccgggtgtgtggagcccccggctggggaggtgtcggatccccgggtgtgtggagcccccggctggggaggtgtcgcatccccgggtgtgtggagcccccggctggggaggtgtcgcatccccgggtgtgtggagcccccggctggggaggtgtcgcatccccgggtgtgtggagcccccggctggggaggtgtcgcatccccgggtgtgtggagcccccggctgaagggagccatggctctgaggctgagtggttgagaatcaggtggagctacccgtcttctagacgacatcctagcaccacctccacccgcatgagtggggcctgctggcgtggacagggtgaaaggacattctcttggcccagttgcttctgttggttggcaggcatgtgtcggctctccctcacgtcagcagtgccgggtggcctgcgtaccaccggggctggggaagcatctgagctcatcttggcttccgctgttgatacctgtggctcatctgtgtttctttgaacgagttttcctgatcactcgtaaccatgtggaatgagctgagtcaatggaagccagtccacgcacacagcaggagggtcctctgggctttttttttttttttgagacggagtctcgctctgtcgcccaggctggactgcggactgcagtggcgcaatctcggctcactgcaagctccgcttcccgggttcacgccattctcctgcctcagcctcccgagtagctgggaccacaggcgcccgccactgcgcccggctaattttttgtatttttttttttttagtagagacggggtttcaccttgttagccaggatggtctcgatctcctgacctcatgatccacccgcctcggcctcccaaagtgctgggattacaggcgtgagccaccgcgcccggcctcctctgggctttgctggaggcactgcctggctgtgggccactggctctgtgtaagggtgtctgttccttccacaggggcaaggaagtctgcagaccccaagagaccttgtgatcatccagcttgggctcacaagaaaacccacgtgcggcgagaaagagccagggaaggaagcagctttaggaagggcttcaggctggacacggatgacgggcagcttcccagagctgctccagaaaggacagacgccaagcccacggctttcccgtgtcaggtgctcacgcagcgttgtgggcggcggccgggccgcagagagcgccggaagcagcgcgcagtagagctgtcattcatctgcggcacgtgcgggaaggcgctcagctgccacagccggctgctcgctcaccagacggtgcacacgggaaccaaggccttcgagtgccccgagtgcggccagaccttccggtgggcttcaaacctgcagcgccaccagaagaaccacacgcgcgagaagcccttctgctgcgaggcctgcgggcaggcgttcagcctgaaggaccgcctggctcagcaccgcaaggtccacaccgagcacaggccctactcgtgtggcgactgtgggaaagccttcaagcagaagtccaaccttctcagacaccagctggtgcacaccggggagcggccgttctactgcgcggactgcggcaaagccttccggaccaaggagaacctcagccaccaccagagggtccacagcggggagaagccctacacctgtgccgagtgcggcaagtccttccggtggcccaagggcttcagcatccaccggaggctgcacctgacgaagaggttctacgagtgcggccactgtgggaaaggcttccgtcacctggggttcttcacgcggcatcagaggactcacaggcacggggaggtgtaggggcgcccgaagagtggggtgctgcgcctctgcgggagtactgggtcctgagggagagctgcagtgagaagttgctcttcagcctggaaaatcaacctgaattcagagaagccttcttagtcctcagagctccccagtcccccgagaagtttactgggaaaactgccaggtgggagaagcagagccatgggtacgccggagatggcgggggctctggagatggcgggggctgcgccccggcgccgggcatcctggggatgtgctgagagtgtgcgcgaccccggagccacgtgccaggccgggctcagaggcggagaagcctgcctggtgcccacagccgtctggctcagggactccaccctggccccgagtcgccgtctgctgggcctttccttcctggctctgcaccccatgctggctgcccggtctggcttcccttcttgtctctgtcttgggcgaggcagctgtgagcattgcacagaggcaaagaccctcctgcagcctctgcgctgggccgtagaaacaagagcctttgtaatactgaacctcattcaaggattaggagtggtggttaggtcagggccacccccagtgctgcaggaacggcctccacccagctctgttggtcagagcctgggtcatgcacctggagttgggagatcaagttgggtctcagggcagtgaggtggccatatccaccacatcgcatttcgtgggggaagaggtgacctctttgttttaaacttaaggtgtctgcttatccagccagaaataaaaatctgccagtggtgttcccaagggaagacccccgtgggaatgggtcgggacactgccgtgtttcaggttagccaattatttttgcttttgcctgtttttctttaagaattgcagccaggccaggcgtggtggctcacgcctgaaatcccagctactcgggaggctgaggcaggagaatcgtttgaatccgggaggtggaggttgtggtgagccaaggttgcgccattgcactccagcctgggcagtaagagtgaaactccgtctcaaaaaaaaaattccagccaacagatgcatatgtaatgttggaatcagaaacgagtttacaagaaatagggggatgaggagaaggttgaacacaccgagaggaagccctgagccagatccggctggagatgccaccagacggcgacgtttctgtgggaagacgggcacgcagaaaggccgagggggctgtgtgtgaccctggtaggagcaaaccgagtgcgaagtcacttttgagacaatcatggaaatgtgggcacgggccgtgagtcgggtgggtaggccgtgagtcgggtggatggactgagtcgggtgggtgggccgtgagtcgggtggatggactgagtcgggtgggtgggccgtgagtcgggtggatggactgagtcgggtgggtgggccgtgagtcgggtggatggactgagtcgggtgggtgggccgtgagtcgggtggatggactgagtcgggtgggtgggccgtgagtcgggtggatggactgagtcgggtgggtgggccgtgagtcgggtggatggactgagtcgggtgggtgggccgtgagtcgggtggatggactgagtcgtgtgggtggccgtgagtcgggtgggtgggctgtgagtcgggtgggtggccgtgagttgcgtggtgggccgtgagttgcgtgggtgggccgtgagtcgggtgggtgggccgtgagtcgggtgggggtgcggaattggctgctagcggtgatggtgacacagggttacggaggaatcctcactcagatgcatttggacgtctttgtggggaaatgacgtggcgcctgggatgtactttacgattctaataaagaggagaaagacacaacagtattggctgaatgttgacagctgttgaagccgggaggttggtgtgcttaaaagttccccaaatcttttatttgcagcatgagtatgagtttcttcgtgctcacggaagattgtagagagcagctgtcggtcatggagtcacagggctgccttaccaggacaccaccggcagccccacagacaacacaggtttattctctccagctctgcaggctggaagtccgaggtagaggtgccaacagggtccgtttccggcgagcgcctcctggttcagaggcatcctcatgtcaggaggggctttggtgtcaccttttccttgtgagggcccggatcccatgacccctatcaccccatcgaagccaaatcacctcccagagacctcctcataccatcacgtcgggcctagggcttccacatgggaatttcagagtgaccattcagcccgtagcagaagctcctctgggtctgtcctggcccacagaccctgtgtaggaaaagcacttgcccctgcggggcaggccctggcagagcccggtgaggcagtgagggccctgcaggataagtggaaatctccccaggggggatatgggggtgcctttctcttacagagtccaggctggtaaaagcgcatgtgtgtttcgtgtctggtttgtcccctgcccagcgggcgccgttggaagggccttcaggtgcttgagcacaggtggggacggagcagctggtgtctcggcagtagatgcggcggatcataaggacttgggttttgagcgccctgcaggaagccactggccgcgtccagggtcacctgtgcctggtcgttagtccctcacaatgctgtcactttgtgacgctcttgtgcaggattaaatgtgaacagcagagacgtgggtgatgcgctgcctcgtcagatgatggtcagttgtccaagcgggctgccttgctcttggtggcctcatcatccagggctcacacactggatggttgggccacagtcgcggtaccccccgggctgcaggctttccaccctgcttagcagggctccagggctccgggtagagcagggggtccctcccttggcacttccccagggaggagcacgaccgtgctcagctgcggtcaggctgctgctcttagttgtctttccttctaacactcaggcttcccttcctgcctcctgggtcgctgaagaaggtcaggtccacagaaaaggcctggggagagaatggtggtgaggagcccatgggggtgtgaggggccgggaggctctgcatcttgccctgttggcctcctcaccacccaggcgggggtggggtgacagaaggggctcacagcaggtgtcccgtaaggagcatcttccttcctggggccagcagccgtcactccctgtgagcctgtagagccgagttttctctgcatttatcttgggcagagaatgcatgaagctacttcgcggccagaatgggtgcacagcagggtccgttgacagccatgcctgtgacctagccttccacccctctgtctccaggggacacttgcctggcctttgtgttagcgctcagcacacatgtgtccagtgtaaagtccaccaagattagcagggcatggtagctgccgcctgtaatcccagcttctcaggagtctgaggcaggagaattgcttgaacctgggaggcggaggttgtagtgagccaagatcgtgccactgcactccagcctgggcgacagagtgagactccatctcaaaaaaaaaaaagtccgtcgagagagcaggtggcggatgcagctgagagctccaggaatgggagggccacgtggtagccactggcagccttgactgaaagatgaaggagtccatggtgctaggaggaggagttgcatcccagcaggctcagctcctggagctgcctctctgcactctgaagggaggcccagtggctgcaatattcttctttgggaagtacaatgccaagtaaataaagatatttggggtcattctagttacaacgtatcataaactctactcactgttgttctgggtgttcatggggtccgccgtgcgtaccagtcttacaggtcctcaaacccattgggacccttcaaacgaagagtgtgcgtgtggagttggcagaacctgacccgggccagggtggagggacagctgcgtcactgagtgcatgtccagccctaatagctcgcttcgttgtgtttgtatctgtgacctcttgggagctaaatcacaggcccaccaaacgaaacgttttggggaatgtgaaatgggtgggttttgagctggtccccagtgtgagcttaatgttggagccatattggattttaaaacttcagaggctccttttcccggggccaaccatcctatgtaaaattcgagggccgatggtggaagcctggagtccggttacagtggtaactccatgaggggagaccagctgtcatgcacctgagcacccagaatcactcacactccccactcctcccctccccacacgtgcacacttaggaagtgtggcagcctgactgcaggagagccatgataccacacacaatccaaacaaaggcagagcagccccgccttaggacaggtgagcctgtggcctgcacacccattgccacagctggagggctgtgtcctttccacagaggggtcggccagcctcgtcttctgatcacactacttcaaaggtgctcagtccactcaccccacctccagctgcagtgtctccaccggggaccacgaccaccatgtccatgttcaagcaattctctgcctcagcctcccaagtagctgggattacaggcacccgccaccacgcccagctgatttttgtgttttcagtagagacggggtttcaccatcttggccaggctggtcttgaactcctgacctcgtgatccacccgtctcggcctcccaaagtgctggaattacagggatgagccactgtgcccagccacctcagggcctttttgcaactccggatgtgggagatgacaaaaccaccatgcaaagaggggaaagggcggaaacaatttatttgaaaaggaataaggaaagtgagtgactagttaaaatttcagtatttggacactgctgaacagatgtcgggtggatccagcagccggggagctgtggtgggctgtacggcggccgccgagcagtaggacacggtctccatcgcccatcaccttccttggggtttactcagcaactcggctggccgcggccctggagccgcatgcctgagcatctaaggatttcctaaaggggcctgaggtctgtcacctggacacgtggcgagagacagggagtgaccctctcagatgacttacaggttgggagaggagagatgtctgaagggaaatacaccaagtcttttgtggcaactcaacgaaactgatggcttctgccttgttcttcagggcaggtcctcctggccaaatctgttcagcgtgcagatgcagacctagtcctactctcttcctgattccatctctccctttaatcccatagataaaatccagccctaggctgggcgcggtggctcacgcctgtaatcccagcactttgggaggctgaggcaagcggatcacttgaggtcaggagcttgagaccagcctagcaaacatggtaaaaccccatctctactaaaaatacaaaagttagccaggggtggtggtggacgcctgttgtcccagctactcgggaggctgaaaatgcacttctccaatcccccttcggctgcccttcctggtaggtgctgagtgttgctggccacagccctcaggggccgccacctttgctttgaccttcgctgacgcagatgtctgttccaaggttatgccccttcctggggccacatccaggaactagtagatggaggggtgctaacgcctggccccgtggctcctctctcaaggaccatccagctgcagacccccacacaagccctgccacgcctgcatggaactcgcctctctctgcacaagctccccacagcaaaccccctgctgagtggcccggggttggccctgggtgtctggccccacagcacagcggatcagaccttccacttggggcccagaacacccaggctcacgtcctcttccttgctcgagtactgccctgtcctgtccatacacagccaaatcccctcgccgtggatccccggggttctgattggtctgatgtgaagagagatgttctcttgccagaaggggtggaatgcagttggggttcccttggccaatacatcaggcaacttttgtctacaaaagagagctaagtgcacgttattttagtgaagtttattccgagttacaattcacacaggccttctgctctccaggaaatacagcacaaagggtaaagcccccttactgcccctactcctgtggaatgagctttcctgatggtggagtgtgtccactgtgaaagctgccgctaccaacatggagtcggggtagccctgaagtcctcagatacagaggcctgtgacaggacgcagcccaagacactcctgcacggagacggttccaggacccacagggcgccctcagggttgcctaccccagacggacgcttgcccagcagtgactgtctcagcccacgcactaattccagctcctgtaacagactcctgtaaaagacccttggctttgaaaacagcttatgtgggcttcttttttgttcttgtttttgttgttgttgtttttgagatggagtctcgctctgtctcccaggctggagtgcagtggtgcaatctcggctcactgcaacttccgcctcctgagttcaagcgattctcttgccccagcctcccaagtacctgggattacgggcgcaagccaccacacccagctaatttttgtatttttagtagtgactgggtttctccatgttggccaggctggtcttgaactcctgacctcaggtgatccacccgcctcggcctcccaaagtgctaggattacaggcgtgagccactgcgcctggccctttttgtttttaagattccccttttccccaactcccctggatacacctatagcctgccaaataccccgaattgcaattctctgcaattctcaaatcaactcgcttatttggagagcttgtctcttgagtttctttttaggttgacacaacaaatacttgtccaacacctgtgtaggcacaaacctgcgtgtgtgtgctcctcatcgtgtggagtcgtcctgtgcgccccgcatgtgcttcttcattccgtctgtgtgcgctctttccagcaaccgcatgctgtcccatgaatgtgtcctgtggaaggacacagcctgcaatcccagcgttttggtgctgtgaattccgccgcagtgaatgtctttgctcttacatctgtgtgcacacgtgcctgtatccccgctcttgcgtctgtgtgcacctgggccttgccaggttcctgcagctgctgtaacaggacaccccagaccaggtggcttcagacaacagaaatgaattctctcagttctgggggcctgatgtccacaatccaggcatcagcagggctgtgctccctctgaaacctgtaggggaaggatcctcccttgcttcttccagttttgagtgttgccagcagttcctggcagttcttggcatgtagaaaatcactccaatctctgcctctgttggcacacgcgttctccctgtgtctctgtcttcatgtgaccagcttctcataaggacaccagttacattggattagggcctacccgcatgaccccagctaatgacatctgcaacaacctcatctccaaatacagtcatgttctgaggtactgggggttagggcttgaacgtaaatttttcaggggactctgcaacccacaacaaaggtacacaatggattcctagaggtcgatctgctgagtcaaagagcagggctgttttagatttaatagcagcagccagccaacaaaatcaggagcgttccacactcccaggctctgcaatgacacaggtgccctccacagccccttactctgggtcttcctcatcctggcactggcttgacttgcccctccccgtttcctgggcagcatggctgtcttcagacacgcatcggcatttgtacttctttggtgttcgagtcgtttcctgtgtcttctggttggttgttgggtctttggtgttcaagtcgttcgcctgtgtcttctggttggttgttgggtctttggtgttcaagtcgttcgcctgtgtcttctggttggttgttgggtctttggtgttcaagtcgttcgcctgtgtcttctggttggttgttgggtctttggtgttcgagttgtttgcctgtgttttctggttggttgttggggacatgcatcggcatttgtacttctttagtgttcaagtcattgcctgtgttttctggttggttgttgggtctttggtgttcgagtcatttcttgtgttttctggttggttgttgggtctttggtgttcgagtcgtttcctgtgttttctggttggttgttgggtctttggtgttcgagtcatttcttgtgttttctggttggttgttgggtctttggtgttcaagtcgtttcctgtgttttctggttggttggtgggtctttggtgttcaagtcgtttcctgtgttttctggttggttggtgggtctttggtgttcgagtcatttgcctgtgttttctggttagctgttgggtctttggtgttcgagttgtttcctgtgttttctggttggttgttgggtctttggtgtttgagtcatttcctgtgttttctggttggttgttgggtcttttcttatagctccatatagagttgtccttcgtctgttttatttgttgtaaatatttttgccaagattgtcatttgtcttccaatttatggtgtagtttactgtaagtttttcacactgatttcctgtcttcacagaaaatcttttatgcccctgagttttcttttcttttctattttttaattttattttattttgagacagagtctcactctgtctcccaggctggagtacagtggtgcgatcttggctcactgcaagctccacctcctgggttcaagtgattctcctgtctcagcctcccaattacagctgggattacaggcatgtgccaccacgcccagctaacatttttgtttttttttaaatagagatggggttttgccatgtttgccaggctggtcttgaactcctggcctcaagtaatccaccctccttggcctcccaaagtgctgggattacaggcgtgagccaccacgcctggccttgggttttcttttttaaaaaatgctttccacgtcttcaaattatttccaaatttacttccaatacttaatgtttttacttttaaaaaaagttaacagactatatctttagggcagttttaggtttactgaaaaattgatcatagagtacagagatcccataataccccttcacaggcactttccattattattatttattattattattattattattattattattttgagacgtagtctcactctgttacccaggctggagggcagtggtgcgatcttggctcattgcaacctccacctccagcttcaagcagttctcctgcctctgcctcccgagtacctgaaattacaggtgcccaccaccacgccaggctaatttttgtatttttaatagagatggggtttcaccatgttggccagactagtcttgaactcctgacctcaggtgatccgcccacctcggcctcccgaagtgctgggattacaggcgtgagccaccgcacccggccactttcccctattattaacatcttgccttagtgtggctcgtcttctgtgactgacaggcaatattgatatgtgacttttaactaacacccatggttcacattagggcttcactcttggtgttgtagatcccatggtttggaaaaaccatgtttgcacaattgtagtattgtatggggtagttccactgccctaaaaatactccttcttcaccttttcgccccatcctcccccaacccctggcaaccactggtccttattattgtcccccccccccgttttgccttttccagaatgttgcagttggaatcatacagcgtgctgccttttcagaccagcttctttcacttagcaatgtgcacttaaattttctctgtgtctttttatggcttgacagctggtttcttttcagtaccgaataatattccattgtctggatggaccagagttcatccattcacctattgaaggacatcctggccgcttgagttttggccattattaataaagcttctataaacatccatgtgtgggatatttgtttgtttgtttggagatagagtcttgctctgttgcccaggctggagtgtagtggcagatgtcagctcactgcaacctccgcttcccggattcaagcaattcttgtgcctcagcctccctagtagctgggattacaggtgtgcaccaccacacccagctaactccatatgtgggtttttatatggacacaaatgttcaactcctttcggcgaatgccaaggagcactgttgtggatggtacagtgagagtacgtttagaacctgccaaactgtcttccccagtggctgtgccattttgccttcccaccagcaatgaatgggagctcctgttgctcatacttagaggcttttggtgtcgtcagtgtcctagatttatccacttacaggtgtgtttttaacgtttggatctttattcacaaagaaccaaccttccagactggctgagtgagtgggctccctatactttttctagggcccagctgtccccctccccaacacagttcttgccccagggccagacacccttgctccaaaaagctacacacacagcgacaacccagctacacagaccctgtgtgtagggaggtgcacggggccctgcaagccggagaagctgcccgcctcgcagcagctgcacccacctccctgcccgcccgcctcgggcgcagagccccagcgttggcagctcctcgtgaggggacagagatggctcaggtgggcccaccctggtccctgggggtcctcaagctcctgggaggagcaccagggccaggccccgggaggtgctgggggggactgggggcacccacttgagaccccaacaagggaactcagggccccggggagagggaagcccgggctgagcgccacagacctgctcagagggaggagccggcccgcgggacaaggggcaaaggaggccaccaccaacccgcagagccgcagccgcctccacgcacccccggaatccacgcctcccgaaccggaagcgcggcgccgctctagccctgggcactcgctggtcgcgtcgcggccacgaggaaggttgagcgcgagctgggcgggcgtcccgcgcagcccggagagctgaccctccacggaggggcattttaataaccgcctgtacacatccagacgcgacaactaaatgcaacacgtgaccctggaagatggggacagccacagaaacacttgggacgggtgacaaagttgtgatgtgagcgacgatggggataatattcctccacagtaaatgtcctggttctgatcactgcactaaagcatcgtaggagaacatccctctgttcaggaaatacacacgaaagtacttcggggctccggggccagcgtctccaaccgcatctcaaacggttccgaagcaacgctcgtgcacagcgatacacacggaccaaattcacgggcagcgtcagcggccgggcatccggataaagggtccatggcggtccctgtgctatttttgcaactttctctaagttggaaagtatatcaaagttttaaaattactgaaaaactcccagtaggttgaacataagacatccccttggcgcggagaacaaagtctacgcttttcccccgggcctcaccgtagcggcccagctgccagctgccgcttcgtcgcacgtccgcgcccgccagtgcccgggcttgctctgagcctgccggctcgcggtagggccccactgagggcagggatgcggggtcccaaagggcattcagggaaagcaggcgctgagctctcttgcagcttggaaattggacgcacgaatgagtggccggccggaaatgctagagcatgcacgcgggtgtcagagccgcctgggggccacgcctttattaaccattgcattatccccgtaagcgccctgcgcgcctgactcgcccacactagggcctcctgggcctcactctctgcaggttcaggctctacccggggaggcttctgccgcagcttcagcgttcacgctgtcctccgactgtggggggagaagagccggatcccgatcccgggacaggccagagagaagcttggggccagacttcgtggagcggagagtgtcctgtgaggacaccctcggtgaggaccccgaagagatcccagagccctcgagtgactgcaccagcgacagggcccgggagcctgcgcgcgaagcggtcagggatggcatccgggatcccacctttgaagtggccagcgatgggaccctggagtccatgctcgatagcaccaacgaggggacccgggaagcctcgcgcgacgggaccacggacgaggcccggggggccgcgcgcgacggtaccacagacggggtctgggaggccgcgcgcgacgggcttatgggggcggctaatgacccggggcgcgaggtgggctgggagaaggccggccgctcccagagcggcgggcctccggggcccctgcgcagccagccgtgcacacgcgccaggtcccgcgtgtcctcgtgctcgcggtgcagttgctcgcgctgttccagcagctggcgccgcgtgtggtgcagcagctgggtccggcggagcagcagcagcagctcctgccgcaggcgtccgttgtccgctttgatggcctgcgtgtgcgccacaagcgcgcgcaccgcctcccgctccgcgcgccgcgccagtgactgcacgcgctgacgcgcctcgcgctcgaaggccgccttgtcctccaggaagcgccgcttcacgcggtggagcagctgcgtgtgctccacgcgcatatgcagcagctcgcgctccagcgcccggatccgggccagctgctccagctgcagcacctgcggcgggggcgccgtcagctcacccccaccccgcccccggcccggccaccagccccgccccgcctcaccccggccgcgggcgggctcactggccttgtagggctgcagctcttgcacctgctgtgccatctgtgccgcgcgcgcctccatctccaacagctgcgcgcgcaccccgtcctcgcgcccgtggtagagcgaggccagttccgcccgctgccagtggatctgcgctaggtccacgcggttctgctcgtccagccggacgatggctttggcgcagcgctgggcgcgcgcgctcacgtagctggcgtagagccggttctcctcgcgcaggcgcagcgcctcgcggtccaggaaggcgttctctcgcagcacctggtcaacgctctcctcgcaggtgtccagctgctccgagagcagcgcgtgttcgcgttgcaggtactgcgcgcgctccgatagcggctgctcggcacccgcggccgccgcaccacctggctggctccctgcgctcggcccgcgctttttcttgggcgccatgggttggtgcctggaccaccaggactggtgagggcagcgaccccggccccttccccaatttagcccttcctcttacctggcctaaatattctaggcgccaggcccagaggtgggacgcgcctcggggtcacgaggcttttggggaggcagatcggggctttgggtcgcgggtcagggcagctttgccaaccttcactcgtgggctcccgctggaccttcgctgtccgtctgggtgcgcctaacattagtaatgttgctgctcggcgggcacggtctctatggagacagaacttactcgtcctctcccacccccaccccgttactctggcgatggccgactccttcattccgcacaactctctcatcttgagtcgcccgtgactgcttgtgaatgtgcccccagagatagggcctgagctgacaaaactgggcttcagacggactccggacgtgcttctgaatctcacagaccccagaagcgcccttcgccttcggttcagcaacgggccttctcccgggttgtcccccacttgaagaggagcttcaccacgttcccccccgtttcccgagtgaaatctctgtgttgtcaggagggagcgcttccctggagcattcgcctcttcagggacccttgctttccctgagcatttcgtgattccttcggtgaggcccccgtgggaattggggttcctgaagtatggagtccactgggcgcctagagagcgtttctctctgaaggtcctaagcgcgcgcgtgcggcacccgctcagctcatccgcggctctgcagctgggtagcttcccttccccgtgtgcccggatggctggaggacatagggatcca

SEQ ID NO: 1821 - DNA, 16425 bp, Homo sapiens
ccacttaaatttcattataattagaaatccttctatagaaaaatccattgagaactttgatttttaaattacagtcatcattagtaaaatttctgaattctatagtaggtaccatgttttttttttttttttttttttttttttttttttttggtaaaccagctgtgtttgaagctgggagttaggggactttagaaaggtatttaaatagtacagtatccctccttaaaaagtttttcagctccagtaagagaaacaaattaatatataaataaggtttccacagataacctgcctttaaaacaaaccaaaccaaagaggcaatatgcagttctcataaaaaaaaatctccagtctctttgatatagaagttaaaaagaaatcacttagggagatagcaagggtttgggaatcctcagtcacactttttacctcatgaaaagcagccccaaatcatttactaacaaagagcagcctggaaagttgagctgcagaggtagacaagtgagctgagagcttgcacaggtgaatgttggcaggaactgaggactagacattttcaagatggcagctccattcttcccttctctgccagccatgtatactgtaaagagcagacgagatggtgccgatcaactggaaagcctatttgcataataagattaaggtggggtgaccagccttctctgcactctatgtaaacatcatacctgatcaaaccaatctatgagccctgtataaatcagacactgcctcctcaaactggactatatattttggtgcatttgcagccagccagtcctttccactcagagacctgtatctctatagagaaagctgtttctctttctcttctcttcggcctattaaacctttgctcgtaaacttctcatatgtgtctgtgtcctaaattttcctggtgcgtgatgacaaaccctgggtttacaccccagacatagctgctttataatgggggctcgtccgggataacaacatacaacattcatcgagatggtgagtagaggagcagactccaactctgtccttttattctgaggcccttggcttccattttagaaccagatcaaaccaaatacggggcccctttcagccatttaaaaataattagcatggctgccagccttacaagacttgggggacaggattgctagggagaacatggagcatcccccagtacccatgggtcactgggcatactggccctgtttgaaccagcttcctttcactgaggacttagctgtcatgtggggctggaagaagtcctggtgtacctgaggatttccggccagggttaccaccattgttatccaaaggtatttggacggaccccagcctctgactaccctgatgagatgtcggcaacagaatctccaactttttatcataatttcctcctttcctgtctgcgatcatcatatctatttcatcctctctgtgtatgcaatgtatgggaaattttatagttcagggaggtaatcttgtttggcaagatcagggaatgtcatagtaaccagcgatatagctcaagggaaggcatctttgtgattttcgaggaacagagggtcaccctcaccacagggagcatctctctctgcccttggtctgaaaagcacatgacatttcaaggccaacagccccacctagtggaatagggatcttttccatgaggcacatcgttggtcctttacccaaacactctagctaaccaattctctccctttttgcatccctctactagacaccatgctttatgctgcttctgttaacaggaaaactctagcttcaacaattaggattaaaatgtcttctggaaccaaatgttagttcttgatactgtcccatcagcaggaaaattgccatttagtccatacatttttaagacacctattctgcctccaattagaatggtacttaattagtaaggggattttaagtctggaagttaaccagaaccattctctaagggaaaacgctttagtacagcccataatatcaggtatagatttcagtctagcccctccattaaagagggcttgcccaactattatgtagttttttttttgagatctatttttcagggagccagacaggtcacacaagtctaggaagtcaaagggaaatcacaggcagaggacagaggactagagccacttgggtgagtgtgacaaaccccaatctctaagtgcctctgtttccatagctggcagtcatgcctgcaactatgggtggcatgttcaacaaggtgccgggacccaggaaccatggaaggaatatagcaaggggaatgcccccactgtcttcctctccactctgtcacacgaaaaggaaggagactaaagggatacttttttgtcatttctctttctagatgggtaccatattcagcctgcactcccctggagtgcattctgaagcacagggactcctcttaaccagagactttaaagaaaaagcagctcattttcttttgcacaagggcatggcctttttactagatccttgcaagcactgcaaaatgaatccagctcttttagcaatcatatcaggcaggccaaaagagaataattccccaaaatgagaaaagcaacttccaggggaaccacccgaggcagctattgtgtgtaccagcccttccagtctgccttaaccggggccacctccaaccatgccaccagttcttctacctccaccatctctaaaattttccattccatcaccttctcacttacccctacagaaaatacataattgaggtgatgccaccaggattcaagtacccttctcattgcaggacctcaggcaattaaagggagacttaggccaattttctaatgaccctgataggcatatagaagttttccagaatttaactcaggtatttgacctctcatggagggatgttatgttgctcctaagccaaaccctaactgcagctaaaacagacagctctgcaagcagcagagaatttctgaggtgagcaataggtctcctatagtaggccaaatgggaaaagagaagatagagaaagtgaagaaacaggggaaacaccattcccagcaggaagagaggcaatacctcttgaaaccctaatgggaagccccagactcttctatggtgtttttccttttttcactgttttcaatggcccttttatgatgttcattcaacctgggagaagttaatttacccaaaccttaaaatgcttggcttacagttgagctgggggagaaagaaaacccagaagcatgacatgccggcaaaaaggtaaaagtttttttttactagttgggtttttggcttctctatccctgtgcaaaccggtaaaagaaataataaggatcactatttatattttctgaaaagttttaattaatgagaaaggatttgtgaggttggccttaagttgtagacaatctggtgtgctttgtgtgtctttctgtatggttctgtccaaagaaaagttactttaggttaggatgcagacccaggaccccctaagcctgctgttcaagccagcccaacaaaatgatcagtaacaaacttggctaaaggcctccatcttgcttcttgtccttgggaacatgacctgtaaccatgtggcgaataatttgttttagtctccaccattttacaatgtttgctgacttcttatgctaagtcagtttctgggtaatggccacaaaatcagataagccagtttgtcaataagggagctgccagctgattgatcaagggcagggtttacaaaatatcttaagcactaatcttgagggctaagttaagagatggtcaaaatcttgtagcctccagctgtgtgactcctaagccatggattttaatcttgtggctagtttcttggtctagtacccaggcaagaggaaagtatattttaagaaagggctgatatcatctttgttttagagtctaaactgtaaaccaggtgcctcccaaagttggttcagcctacacccagggatggacaaggacagctcgcaggcttgaaaaaaaatagagttctttgggtcagatctctttcactgtctcagtcacaattttgcaatgacagtttcaaaagctgcttatcacccctttaaaaacaccttgtacactcactgttacatcgtaacataattaaggcttgttggtttcacctgtgaggttactttttgtaaagttcagaagctgaaaatcttaactgcttggcatagctaaagttgagtaacagtggatttaaagggattttgttaaagagtgctcagcttaattaaaactgggtattcaagtaataaatatatttaaaaggcctttatatttttctcttcttggatcttgttttctggaaaaaaatttttatttttctcagttgactaaatcatctttctccattttatttcttgacactcttaatgcatgtgtgagaggccctaagataacttctggtagtccttgggaaaaacagaggaggtgccacagaccccattgtggggaaaaaagcaaacaaacaaacaaaaaaaaccctttcttttcctcatgaaaccccaggaattaagagcagatagtgccctctctaaattaaaggttctgttcagttttgctttgtgtgttctgaccattttgagttttgggtgtatcaaaatacttcacattaggagagagctttgatgtgtaataagtaggcaggaaatacactttaagggatggcaaatagtagttataaatcagagaagcatgctcttggccacctgaaagatatggaaacatccccacatccccacatccccacccccgactgagagatgatactcccatgggggataaagctgattagctttgggttgccttacaatgaaatacatggtagaagcaatgcactgttttctcccatagtatctccctcctttaggggaccaaaaatctagtataaaatggcacacttaattttagggatctgcctttgccttcagctgtgcctacttattaggccctaaaaatgcatgctacctggcccagttccaccaaaggctccaccctgaagccagtaatccaattaagaaactgacaaatgaaaactcttacaagtgctgaatattctgtttgtgttgctatatatgtgttgtgtgtaatgtctacaataagagctctaattaattggcttaaaaaatagtgcttaaatcaaatatgttttagttcatgtgactttaatttttaagaaataaaaataatcttaaggattattggtaaaatgcaagggtcatcaaaatccaaataggtggtctaaatcgtaaaacagatactaggtttgctaaatgttcaaaggttgtatactgcctgattttcagataagtaaggcctgggacacatggagttagatgctagaaagagtcagatcttatatgcatttctgcctgggtcctaggctccacgcctggtacataattaaaattgcttactaaccaggtttctcaacaaatgtaaaacttgctaagagttaacagtgcagcatgtatttgagatcactgaacagttttaaaggcaaggtgtataaaaacagtaaaatgtgttttttagtaaaggattataagaaaccatagaaatataaatattgcccagggatgaggaattatcttaaatttgataagataaagctacaggtttaagcatgttgtggaaagatggtcttttcataaactgagcattgaaataaaagcactgtaaggctgtcttaagccactaatctgccctttagcaaaatgggttataaaaaaggtttgtaaggatttcatctcatggtcaaattggttaagattagatggaattgtctttagggtggcatttaatcaaattggggttaacattaataaattaacgcaaaggtaaaatttggctttgagcaggatttttatgtaatagtaaaggcttatgaaaggtttttgccttttgagtcatcattttggcaaaataagtaatttatgactatctggaattctatttcataacatcaactgttttaaacctctaacatttaacagacataccaaaatcaaacttcaagtttcgaaattgtctttcctgatgcgtggctttctagattgttcagggggcccctgaaacattcagaaaataggtgaacaggattatttgacatgtttaatcacattgggattgccaaaatgatgtccagtcttaacttatatttttgtgaataataccaatatatgttccaaaattgtatgggatttctaaaattctaatgtctcataattaattttaaaattattgtaaaccacggagataactaaacttctttgtcagtcatgtttttaactgtaactaccctgaaaattttgtcacttacagacaattgttatcttgctatgttccttctcaaaagatgggatataatcaagctataagactttaacagctgttctcaaatgcagatttccaatagctttgaagattgtaacattggaaaaaatgtacaggactcatgaagaactgaaatgtttatgaatatcaagtgaaacaagagttgtcttaaatggattgtgctcagaaagctaaagcaatctttttgacttttgcttagaatattgctgatccttattttgtttttcagagtcaaggaaacttattttgaactatgtgcagcctttaataattaagtaagttatactcttgtgaacaaaattcggagcaggtttgtttctctgtacctggttcctctagaatttggaaaccatctgtgagtaaccttaacttacggcaatatagttgtttgcatcagtgccacaagaagtcttttttttttttttttttcaataagacacaattagaaaaactggttattttatcaaagctttgacaggaagtgtatgcttccccctttaaagagtcaatctcagcttgcagagctgataaaagcaccttggggaagactggcctcataccttgtctacacagtccctggacaggtttcttaatctgtagtcagtaaagaatgtcactttttaacatgtccaggacctccaagtttatcttgggaccttaagtgtaaagtatttggggataaaaacccattgctgaacttggcttgaagaggtattatctgagattccttatggaacagagttccatcaaagccaacccaaaaggcctatgtagggataattattcttgctgcactttatgcaaatattcacgccaagtataaggctaaagtttattctacaaagaacacagtcctatcataatttgtttttaccaaaaatgagcaatggagagagaaattgtgctccaaagcttatcatacatttgtcattaaatcctagtcacaataattgtttttaagctttttacctacattttagactaaccctgcttatttctgtgaatcaagtggtgatctcctgcagcttggaagaaacaaagagagatgggtaatgtgaaaatctggataaatatgctagttctgggcaattattctgcaaattctgccaggtaatgaaagtgagtagggtgcccataacccagaggtttatttgtttgggaaaataaagccaagaaacttcatagactccccaaagggaaattctgtatcttggcaggtaaaactttagatgaaaattatctactacaccacacttgcagaaattgctatactccctctactattcacagtagggctatacacagtagcaccttctaactggaatatcagacagagagtttccactgctgtagtattttgcttaattattatccttacaggagggataatagtcaccaaaaaaaaaaaaagaaaagaaaaaagaagtatgaaagttttactatcactgaatctgctagaacttcttattgggtttggtaatgtcacaccctggctatatacaaaggatataaaggaaaaaatattttacataagaaaggatcttgtatgataaatacttctcctaaagagaacagttggttgtttaaaagagggatgtttaggagaagtcagaagatttgagcatgttatagatggttgtggaagtcatgaaaagattacaaggatggtaaatacctgtcctaaaaagaatagttggtcgtttaaaaagaaggatgttaggacaagtttaagcacgtcttagatggtctgttgaagtaatgagggaattaatacttacaggaaagatttagccaaggttaacactaaagttactctagctacccaaatccaataccacttattcaaaaaagaatgttacttgtatattaatatttcagcagcacctggtggaggaaaaccagtatcacaacccattggaatgactgacagcaattaaactccaaatggagctttagactgaacaacacatggatgcatctttcttccaggaacccttagatcgaaccaagaggagccctagctgctgttccccacatgacgtcccttttcagcaggaagtagccagaaagagtcatcatccaacaccccttaacagcagttagggttaccactccagagaggggaatgatagaggagttaagaagaaatcacttaggcagatagcaagggtgtaacagtctttggtaatgcttttctttttaatgaaacacagccccaaatcatttactaacaaagagtagcctgtaaagttgacctgcagacatagacaagcaagctgggagtttgcatcggtgaatgctggcagaaactaagcactagacattttcaagatggtggctccatcttctcttctctgttagctatgtgtactctaaggagcagacaagatggtgctgatcaactggacagcccatttgcataataacattagggtggggagaccagacttccctgtgcattatgtaaacatcatacatgatcgaaccaatctataagccctgtgtaaatcagacaccgccacctcaaactggactacaaaatttggtgcatttgctgtcagccagtcccttctgctcagaaacccctttctctataaagaaagctgtttatctttctcttctcttctgcctattaaacctcagctcctgtactgcttgtgtttgtccgtgtcctaaattttcctggcgattgacaacaaaccctgggtttataccacagacaatgtagctgcttcatcttgaggtctgcctatggcactaaggtactttctctttggtcccaccactgcaattttctaacctgtgttctagtgcctcccaggcactaatcttcagaatttcagaacttttttctggctgtgtgcttgaacttggaacttaatggcagaatcggttttatcttcactgcttgtttgttcctattcctgtttgtgttctcctcaaaaaatcatatgttaaaatcctatccccaaagtgagagtattaagaaacggggatttggggacaatattaggtaatgaagacagaatccttatgaatgaattagtaccctcataaaaacagaaatgaaagaacacattttttgtctctctgctctccccaacatgagaatacaatgtgaagattgtcatcaacaaaccaggaagtgaagcctttccaaacaacagatttgctgccaccttgatcttggacttcccagcctccagcctgtgagaaaaaataatatctgtttttgaagccacctggtgctatttttgttatagtagcctgaactgactaagagagtagacaacagtggtaactctggattaaaatatacatattactggaattaagttagtgtaaatttgaagcagactgataaattgagatatatattgtaagccctattgaaacaattaagaaaataactaaaaaagtaaactaattaaaaaaagactgagctgatttttcattgtagaattcaattgttttggatgggggaaagtgatttgtaacacataattaaataattacaatctttttgaaatagtttcctcatcagtaaagtggaggtaaccctacatcctagttaggctataaagaatgatgaatataagtttggcagtagacaagttggaatttttaacctcaacttgtagctttgtgacttcaagtgcatcactaaaccttaggctgtctctttaactgtaaagagggaacaataaccatgatcatatcttaaaccattataattgaataatatagtaaaaattttgcacaatcaacgatgagtattaactatcataattggattgtgaaaatatttataaactctgaagaatttattactattggtattcattatttttccccacaagctaatctgattatttgtaaaggcaaaaatggaaaaaaacaagtccaccatataattatcacttggtttcttaacatctatgctacttttaaacaataatgtcaatatgtgaactattttaaattggtttttctatgaaaacatttgctgcttattgacatacactgtgcaataatatgcctctcacatctattatagaattaaggtctgtgtgatcaaatgtaattcaacaaatgtttattgcaccttctaagtgttagtcactatgttatgtgcttgtgatgtagaagtttaaaaacgtatgtttactagtaaaaaacattagtttttataatattttagaagaaacagcactagaattgagaaaagtaacattaggatgaaattagaattttgaaggaggttctccaggcaaagaaatggacaaggcatttcaaattgtattattaactgcctattagagagaaggtaatatgtattgaaagttttgcaacaaacatatcacttacacaataactactccatttcatagatgaatttaatgaatttgatgaggtaactacatctagtagagggtaggccaaggctcaaatctaagtttgcctgtttccaacacttgtgcatctaatcactgacatacataaataaggcaattgtcagagaagcatttcaaactttcctgaacattccaaaagggaaaggcatcgtatcataaataagaagataacaacaaagatttccaaaggaagatatgtagaaagggatacgaaaaaaaggaggaaataaaacaatagcaagtatcaaaaacaagagttgagatggggcagagtgggaaatgagagtattttagggttcaacagagaatcagaagcaataggagaatctattatctatctatctgtctatctattaatatagagaggtttatttattgtaaggcatttgcttacacaattatggaagcaaaaaaatcccataatctgcaagcttgagactgaagaagaccagtggtgcagttctgaggaccagagggccaatgatgtgagtcctagtctgagaaaatagaaagaatggtgtcccaaatcaaacagagagagtgaatcctcccttcctatcttttgttctattggacatcataaaagattagatgatggccacatacattgggaaagtcagtctgcttttcttagactactgattcaactgtttctggagattagcctgattcttagactaatctccagaaacaacctcagagatataaccaaaaacaatattcagccaaatgtctgagcaccctgcaatccagtcaagttgacacataaaattaaccatcataaagtgcaaaatttgttaaatgtctgagcttgcagatccttttagggcaacatcacagaccctgaactccaggacaaaataccctaatcaaacgaactgcccaactagtgttctgaaacacaggatgaatcatcagttcaatcatggatggctaaacctaaaaaattattccttaataataaccgtatgtctggaagaaatcaaccttctaaaaaagacaaagttgaggaactgcaaaaggaaattcaaactcctctgaaactcttaacaggcaagaaaaaatatgcagttggataaactgacattcaccaaacttaaaattttgatataaatattcatagggttcatcccttttcttctgtctagcactactagctagaagtcagaatttataaaggacagcccaatatttcccctcctgggcccacagcagacacaaaaaattcataatgaaacgttttttctttaatctgcaaaaagtctattattccttcttaataccatgttttgggcaactactcttaatcaggtaagatgcatgaaataaatttgcttgcaatactgttgctgggtgaacatcagcaagttactgatggtagtcgttctctgcaggatcatttttgcctcctgagggacatttggtaattggggacattttttactgtcttagctgaaagaggtgctgctgacatctagtaggttgaggtcagagatgatgtcaaacattctacaatgcataggaaagaccacctgaaaatatatgtatattcagttcaaactgtcaatactgctaaggttgagggcctttagagttagcctgaactcacaaaattttccgataaaaggcactttcctttcccttccaccttataagctttaattcatccttaaaaggttttggtgaagataattttctttgtaaaggagaaaacatgtaagctttggaaccaggaaaggatgattgtgcatcactacttactagccccatgtttgaccaactttgtttccttgggcgctataacaaaatacaataaaacaggtgccttagaacaacagaaatactgtctcacagttctggaggctagaagaacaaattgcaggaccatgctccctctaaaacttgtagggaaattcttccttgcctctttccagcttctgagggtttgacagcaatctttggtgttccttggcctatggatgcatcactccaatcctccatcttcacatgaccttctctctgtgtatgtctgtctctgtatccaaatttccctcttttgtaaggaaaccagttatattgaataagggcccacactagtaatgtttaactcgattaataataataattaataataatgtttaactcagaatatgtttaacttgattgactctgtaaaggccctattaaaaataaggtcacattctgtagtaatgggcatttggactttcacatcccttttttggaggcgggaacataattcaaccaaaacaccagtttgcttaatttcccaaaacttcagtttccttatatgaaaaatgcaaataatactgactgtctgtagcattaattgaaagattaaaataaatggactaagaaataaactatggaaaaccaactagtatagcagctgctgtatcacaggtgctcaaatatatatacggtcaccctgttatccagtcatatgtgtcatatatacacacacacacacacataaacacacagatttgtgtatgtgtatgtataaaactttcccttttctcccaggtatttatgtctctttggtgttcacacaaaacatgatgtatttttctttccattcgttacattatatttgaactatatatctatttatctatctggcttgctactactttgatattagaaactgttgcagtaatttttagattgatacctaactttgtttactaattaataatttacttatcaagtaaaggactaaatggaaaaatggatggatgaacatgactacagcttaccaaaaatgccctttatacctgaatttctcttagtgggtcagagtttaggtggtattcgaacgaatcaaagggatatacgtattttgcttttggtatgtgtttgtgtacattctcattattgttacttgtcagtttcctaggtttccgattgtgatctttagatttttttgactagcctacaaacttagatttttaaaatcctaatgacatctacagcagtttcccaggagctttctttcagaatatctgccaaaataatttattgctgtcttaggttatttcatcttgagcaacatgaacattccatcaagcagagggtatagggagaagtctcatcagtaaataagctggctaaaatttagacgtccatcaatctctgttaaattttatctcatataccctgagataggagagtaatataaccattttaaaataaaacttatttcttgcccatttactgtatttggaagaaaaaaatagtggataattaggaagtggataattctggaagaaaataattagtagacttactaattatttatgagggaaagaactgagaacagtaattttaaaatatatccatgttcttgaatatttccacccttaagtaactacagaggaaatggactgatttaccaccaaagattactttataataataacctacagtttgaaatttaagctccatttaggagccagaaccaattatttataatactagaatggcctgaaataatcttgtattatcctgaaaaaaaaatctgaagtgggaataagcccacacctcatttatgtgtgtaaaacaatctcagctttacatcttttaagaaaagtctgaataactgccttatttccacatttctttgcataaataaggcagtgcaaaagctttgtcagctgattaaatttatatgcaattttggtaagacattgttttctagttccacaatatatttttgtccagtccaccgaaatttgagtttgattcactcacaaagctgatcctcccaacttcatttaataaaatgtaagaagactttaaaagatatattaggaataactagttagatatggagaccgtctcatattaattatttattttatgagtgtctgctaaatatataaacaactctgctggtaattatttatgggtacccaggtggcataaaaaatgaagcagagacagaaaattagatgtagcttctaccgtagattgataaaaaccataaatgcagaactacacagactagagtggatagtattaaaaactatatgtatagtgatgtactggtaaatgtataacaacctggtttctgaggaagaaaaaatctctgctttctaacattagttgatttccatggcacaagcactcctatcatgaccagtttcaagccacaaatgtgaaatcactgaacacagatttgggaagagatggacacaactcttgaaagtcagtgtgacaaactgaaacacagcactgcttacatatagatatataaagtggatgactattttaacagatacaaaagcaaagaatctatgtgaatttttaactaaaactgaaaatattatatacctaaaagcatgttggttaaaatgatcattttgaatatctaaatctacacagtcataattatactgatgctattaaaacatggtataatggccttctgtatggaactcatattaattgtaataaatattcaattatataaaattttagagatcatctactgtatattagacattgtgctatgaacaggagttacacagatggctaggacttagtttctatttttaaattataaaaagggccaccaaatggataattccagtagataaaataataaatactaagatagaggtaagcatctgtcccgcagtacagagaagagccatttagcccagtcttgtttgggatggttttctgggaaaatgatgttgtcaaaaccaccttatgaaatgcaggctctgtcactttacagttattcctagtattgccaactacaacttcgatcccatatttgaagtgatctctgtaaattttgttaaaggtaaagcaggtccatgattttgtggggatagtaaacagaggcttaaaataagacagaacttttaggccagttatcagatctttaatggaacttaaacatattacctgacgtggacaggtagggagagccctagaggaatgctgatggattgggtaacttgtgagatccgtgtgtgagcttagtcaagtcattttctggtatgtcggtttccttatcaatggaaaaataatggtttggggtggataataataataaaatcatagctaatatctattgattgactttgatgttgttatatcccttgacatatattaattcacttagttctcacaacaatcctataaagttgatatccttctttctctttttatattagataaatctgagataattgtaagctatatacaatttcaatgttaggaaagacctgaggtagaattccaacctagttctttctgactctaatctcttagacattccctgaagtcgtttccagccttcatgttctttgaccccagaagtatcttggaatgtttccctaattgctgtgatggcaacacagcagagctagggaaatcaaagacctaggctatgccccttcatgtttgtgcattatggtgaatgagctctgaaagtgccagggaattttgccaccaagtcttcacattaacttttcagcaatattcctcagtttaggagggaggcctatccactccttgtcctttgaaaagtgatcatttgcttgattgctctcaacagaagtcttcc

SEQ ID NO: 1822 - DNA, 37021 bp, Homo sapiens
ccaccatataattatcacttggtttcttaacatctatgctacttttaaacaataatgtcaatatgtgaactattttaaattggtttttctatgaaaacatttgctgcttattgacatacactgtgcaataatatgcctctcacatctattatagaattaaggtctgtgtgatcaaatgtaattcaacaaatgtttattgcaccttctaagtgttagtcactatgttatgtgcttgtgatgtagaagtttaaaaacgtatgtttactagtaaaaaacattagtttttataatattttagaagaaacagcactagaattgagaaaagtaacattaggatgaaattagaattttgaaggaggttctccaggcaaagaaatggacaaggcatttcaaattgtattattaactgcctattagagagaaggtaatatgtattgaaagttttgcaacaaacatatcacttacacaataactactccatttcatagatgaatttaatgaatttgatgaggtaactacatctagtagagggtaggccaaggctcaaatctaagtttgcctgtttccaacacttgtgcatctaatcactgacatacataaataaggcaattgtcagagaagcatttcaaactttcctgaacattccaaaagggaaaggcatcgtatcataaataagaagataacaacaaagatttccaaaggaagatatgtagaaagggatacgaaaaaaaggaggaaataaaacaatagcaagtatcaaaaacaagagttgagatggggcagagtgggaaatgagagtattttagggttcaacagagaatcagaagcaataggagaatctattatctatctatctgtctatctattaatatagagaggtttatttattgtaaggcatttgcttacacaattatggaagcaaaaaaatcccataatctgcaagcttgagactgaagaagaccagtggtgcagttctgaggaccagagggccaatgatgtgagtcctagtctgagaaaatagaaagaatggtgtcccaaatcaaacagagagagtgaatcctcccttcctatcttttgttctattggacatcataaaagattagatgatggccacatacattgggaaagtcagtctgcttttcttagactactgattcaactgtttctggagattagcctgattcttagactaatctccagaaacaacctcagagatataaccaaaaacaatattcagccaaatgtctgagcaccctgcaatccagtcaagttgacacataaaattaaccatcataaagtgcaaaatttgttaaatgtctgagcttgcagatccttttagggcaacatcacagaccctgaactccaggacaaaataccctaatcaaacgaactgcccaactagtgttctgaaacacaggatgaatcatcagttcaatcatggatggctaaacctaaaaaattattccttaataataaccgtatgtctggaagaaatcaaccttctaaaaaagacaaagttgaggaactgcaaaaggaaattcaaactcctctgaaactcttaacaggcaagaaaaaatatgcagttggataaactgacattcaccaaacttaaaattttgatataaatattcatagggttcatcccttttcttctgtctagcactactagctagaagtcagaatttataaaggacagcccaatatttcccctcctgggcccacagcagacacaaaaaattcataatgaaacgttttttctttaatctgcaaaaagtctattattccttcttaataccatgttttgggcaactactcttaatcaggtaagatgcatgaaataaatttgcttgcaatactgttgctgggtgaacatcagcaagttactgatggtagtcgttctctgcaggatcatttttgcctcctgagggacatttggtaattggggacattttttactgtcttagctgaaagaggtgctgctgacatctagtaggttgaggtcagagatgatgtcaaacattctacaatgcataggaaagaccacctgaaaatatatgtatattcagttcaaactgtcaatactgctaaggttgagggcctttagagttagcctgaactcacaaaattttccgataaaaggcactttcctttcccttccaccttataagctttaattcatccttaaaaggttttggtgaagataattttctttgtaaaggagaaaacatgtaagctttggaaccaggaaaggatgattgtgcatcactacttactagccccatgtttgaccaactttgtttccttgggcgctataacaaaatacaataaaacaggtgccttagaacaacagaaatactgtctcacagttctggaggctagaagaacaaattgcaggaccatgctccctctaaaacttgtagggaaattcttccttgcctctttccagcttctgagggtttgacagcaatctttggtgttccttggcctatggatgcatcactccaatcctccatcttcacatgaccttctctctgtgtatgtctgtctctgtatccaaatttccctcttttgtaaggaaaccagttatattgaataagggcccacactagtaatgtttaactcgattaataataataattaataataatgtttaactcagaatatgtttaacttgattgactctgtaaaggccctattaaaaataaggtcacattctgtagtaatgggcatttggactttcacatcccttttttggaggcgggaacataattcaaccaaaacaccagtttgcttaatttcccaaaacttcagtttccttatatgaaaaatgcaaataatactgactgtctgtagcattaattgaaagattaaaataaatggactaagaaataaactatggaaaaccaactagtatagcagctgctgtatcacaggtgctcaaatatatatacggtcaccctgttatccagtcatatgtgtcatatatacacacacacacacacataaacacacagatttgtgtatgtgtatgtataaaactttcccttttctcccaggtatttatgtctctttggtgttcacacaaaacatgatgtatttttctttccattcgttacattatatttgaactatatatctatttatctatctggcttgctactactttgatattagaaactgttgcagtaatttttagattgatacctaactttgtttactaattaataatttacttatcaagtaaaggactaaatggaaaaatggatggatgaacatgactacagcttaccaaaaatgccctttatacctgaatttctcttagtgggtcagagtttaggtggtattcgaacgaatcaaagggatatacgtattttgcttttggtatgtgtttgtgtacattctcattattgttacttgtcagtttcctaggtttccgattgtgatctttagatttttttgactagcctacaaacttagatttttaaaatcctaatgacatctacagcagtttcccaggagctttctttcagaatatctgccaaaataatttattgctgtcttaggttatttcatcttgagcaacatgaacattccatcaagcagagggtatagggagaagtctcatcagtaaataagctggctaaaatttagacgtccatcaatctctgttaaattttatctcatataccctgagataggagagtaatataaccattttaaaataaaacttatttcttgcccatttactgtatttggaagaaaaaaatagtggataattaggaagtggataattctggaagaaaataattagtagacttactaattatttatgagggaaagaactgagaacagtaattttaaaatatatccatgttcttgaatatttccacccttaagtaactacagaggaaatggactgatttaccaccaaagattactttataataataacctacagtttgaaatttaagctccatttaggagccagaaccaattatttataatactagaatggcctgaaataatcttgtattatcctgaaaaaaaaatctgaagtgggaataagcccacacctcatttatgtgtgtaaaacaatctcagctttacatcttttaagaaaagtctgaataactgccttatttccacatttctttgcataaataaggcagtgcaaaagctttgtcagctgattaaatttatatgcaattttggtaagacattgttttctagttccacaatatatttttgtccagtccaccgaaatttgagtttgattcactcacaaagctgatcctcccaacttcatttaataaaatgtaagaagactttaaaagatatattaggaataactagttagatatggagaccgtctcatattaattatttattttatgagtgtctgctaaatatataaacaactctgctggtaattatttatgggtacccaggtggcataaaaaatgaagcagagacagaaaattagatgtagcttctaccgtagattgataaaaaccataaatgcagaactacacagactagagtggatagtattaaaaactatatgtatagtgatgtactggtaaatgtataacaacctggtttctgaggaagaaaaaatctctgctttctaacattagttgatttccatggcacaagcactcctatcatgaccagtttcaagccacaaatgtgaaatcactgaacacagatttgggaagagatggacacaactcttgaaagtcagtgtgacaaactgaaacacagcactgcttacatatagatatataaagtggatgactattttaacagatacaaaagcaaagaatctatgtgaatttttaactaaaactgaaaatattatatacctaaaagcatgttggttaaaatgatcattttgaatatctaaatctacacagtcataattatactgatgctattaaaacatggtataatggccttctgtatggaactcatattaattgtaataaatattcaattatataaaattttagagatcatctactgtatattagacattgtgctatgaacaggagttacacagatggctaggacttagtttctatttttaaattataaaaagggccaccaaatggataattccagtagataaaataataaatactaagatagaggtaagcatctgtcccgcagtacagagaagagccatttagcccagtcttgtttgggatggttttctgggaaaatgatgttgtcaaaaccaccttatgaaatgcaggctctgtcactttacagttattcctagtattgccaactacaacttcgatcccatatttgaagtgatctctgtaaattttgttaaaggtaaagcaggtccatgattttgtggggatagtaaacagaggcttaaaataagacagaacttttaggccagttatcagatctttaatggaacttaaacatattacctgacgtggacaggtagggagagccctagaggaatgctgatggattgggtaacttgtgagatccgtgtgtgagcttagtcaagtcattttctggtatgtcggtttccttatcaatggaaaaataatggtttggggtggataataataataaaatcatagctaatatctattgattgactttgatgttgttatatcccttgacatatattaattcacttagttctcacaacaatcctataaagttgatatccttctttctctttttatattagataaatctgagataattgtaagctatatacaatttcaatgttaggaaagacctgaggtagaattccaacctagttctttctgactctaatctcttagacattccctgaagtcgtttccagccttcatgttctttgaccccagaagtatcttggaatgtttccctaattgctgtgatggcaacacagcagagctagggaaatcaaagacctaggctatgccccttcatgtttgtgcattatggtgaatgagctctgaaagtgccagggaattttgccaccaagtcttcacattaacttttcagcaatattcctcagtttaggagggaggcctatccactccttgtcctttgaaaagtgatcatttgcttgattgctctcaacagaagtcttcccatagcctctgatattttcttttcatttcttctgagttgtttatttttaattacttaacatttttgacgataccttttccgaatgcatctcaaacttagggctaaaaagccaaatgcttcaactttgttttcccatctcttaggcaaacagccaaaataagttccatagttgagcgaggtttttccataactctggaattatacaagtagttcccatttcagggcgtggttgccatccttttctacatttcttagcatggctaaattctctttattctttatggtttagacgatcccctgagaaggtcccaaaatgccgtgtgttaactttatatgctgcttttctctttctggcttaggctgcagactgcctaagggcagagaaaagtttttttgttttttttttgtttgtttgtttttttaatgagtttatcttttgaacctgatgcaatgccagtataacttagggtggaagaacttgggatctgtagttaggatgtctaggtttaaatcttacctttgctacttaatagtcatgtggacttgggaacatttaaaaatttcccccagactcacattctatctgggaagagaagatccaacaacttacttcaaaaggcttttgtgaggattaagtggtccatgtaaagcacttggcatggtatctagcacatactgagtattcaaaaaccattatattgttattaggtactcaaatgttaaatgaagagtaagaaaatgaatgtacttattcattcagaaaatatttattggtgctagacccatttctaagacctggaagggtagcagagagcacatccaagttgctccctggtttttctagagcttacattctctcaaagggagaaagacaccaaacagaaaaataaatatgtgtgaaaataaagcagagaggccgggtgcagtagttcacgcctgtaatctcagcactttgggaggccgaagcaggcggatcatgaggtctggatttccaggccagcctggccaatgtgaaaccctgtctctactaaaaatacaaaaattagccaggcatggtggtatgcgcctgtggtaccagctactagggaggttgaggcagaagaatcgcttgaatccaggaggcggaggttgcagttagccgagatcgtgccactgcactccagcctgggcgacagaccaagactccatctcaaaaaaaaaaaaaaaaaaaaaaaaaaaaagcaaagaaaaggaaagaaaagaaagcagagtaagaggacaagcaacagcaggggaaatgttactttagataaggtagccagagatagactcctgtttatgataatatttatttgtgcacctgagtgaaaagagggatagatctgtaattctgtgggttggggcaggggcgaagcaaatgcgaaggccctgaggctagagggtttctgtcatcatcaaagaaaagcaagagaaaggactgatttggtagaagaggagatatgagaggatgtttaagagggagaatgttaggagaagagggtgagcatcaaagtgtgacacatttttaaactagtacaactgctatggaaaacagtatggagatttctcaaagaactaaaaatagaattaccatttgattcagcaatcccactactggctatctgcccaagggaaaagaattcattataccacaaagatgcctgctcgcatatgtttatcacagcattattcacaatagaaacaatatggaatcaacctaagtgtctatcaagagatgattggataaagaaaatgtggcatatatacacaatggaatactattcagccattaaaaagaacaaatcatgtcttttgcagcaatgaggatggaacaggaggccattatcttaagtaaaacaaatcagacacagaaatacaaattcaacattctcacttacaagtaggaactaaaataacatgtttgcatgaatgtagaatgtgtaatgatggataatagagattaggaagattgagtagtggagaggagcacagattatgagcaattacttaataggtacaacgtacattatttgggtgatgaacaccctaaaagatctgactttaccgctgtgcaatttagggatataacaaaattatacttgcattccatatatttattaaaaaagatgtgacagatttttagggattgttggccaagtaaaaactatagatttcatgctgagtgagatggaaggaatttcagggtttggaatagcattatgaaacgaattgaagatgctctcattgagaatgaaataaatgattaaagggtctcgagatagattcagataagtaagggtatagtagccaactgatgaagaggatgcattaaaaagataacattcggggaagggcagagagttgacaaatgaggtgttaagaagtaaaactagactgacctcacaaaagagaaaattaagacaaaggcattgtgatttatgcataattgtcaatttgtatgtgtacatatatgggtccacttgtcaagctttcattgcctacagctcttttgactatttattttccttcaggagcccatactttaaaaacattttctcaaccaaagataatttatttataattaattcatgccatcatattttttcaaagccataagtaacctcaatctcaacttccaatgggtgacagcaaaccaatgtcatcctctcctggagtcaccattctagccaagagcaaatgaacctatgatttccatcaacctgtactgccttattgcaattaatatattctatcccttagtttcttttaaacactggaaatagctttagcttgtatactcccttttctttttcggtggaatcccaggagtctctgaaccataagtgtggtattcaaattactcatgtaaacctacagatacaatgtgtatcttacataaccattatatacatattccatcctatatgtgcatgtattacacacaatgcattttatctctagaatatatgtatatattgtgtatatagtgctttcaaataaggtcatattcacaggtttacacagttagaatgtgtacttatcattgtagggaataccattcaattcaccgcagaggtatttattggaaaaatgtgtattggaaaggagaactatcaggctgcattatttgttaaccatctaagattattatgttaatataaaagatctcataaacagaagctcttattacctagtcaatagttgttttatttcttattgatatatgattatgctgccgaattgtgaatttaatttggggcatgaatgtgtcatacatcttcatccaatcagaagattcagttcagatgtgtctatataatatatgtgtttatctttcagaaactttgtaagtaaagaatattacccttacagataagtcactctcactggagagaagatcgtgaggtagggaagaatgtggaaattaacatctctgagtacatgttcccaacgatagggccatattgatgaggggtcggaaagcaggagcctgccaaagagcaaaagataggcccgtgtggacaagaggttactttattatttatttattcattaattcattcatttattcatttacttattttgagacggagtcttgctctgtcacccagactggagtgcagtggtgcaatttcagctcactgcagcctctgcctcccgggttcaagtgattctcgtgtcagcctcccgagtagctggaattatgggtgcccatcattacacctggctaatttttgtatttttagtagagacggggtttcgccaggtttgtcaggctggtctggaattcctgacctcaagtaatctgtctgcctcggcctcccaaagtgttgggattacatgcatgagccaccatgcctggacaaggttactttattaaacggggtaggacctcttattagattggttcacctggaggatggtcttagtgatacctgactttgagtctctttcagtctctctgcaaagctcattttgaaagacatttctgagtctcctactaaatgccagacactgagatgagcaaatgaacaaaataaaagtctctgactctagagaacatcaaccccggagtgtggcaaggcaggaggcagtggtgggggacaaggaagagaaacatatgcattctctacattcaaatcttattatactttaatattttagagaataaaacaggaggggaagtcagaacaaataaaggacaagatctgaaaactgttaaggactttaaaattatattcaaatttatttaagtacccttaaatttacttagtgtataacagaagagaaagctgagttatattggttaccttctgttttgtaaacgcaaattaattttacagtgtctctcttagccagataaaaccattgatatttattgacaagtaaatcaaaagcatttatggttactggcttcttaatttcatctactcttgtttctgtcactggggagttttcagcacttatattggtctattttgatgaaagactcacaacagagggcaactaaaacaagagtgttcctcaagtgatttttctaggatgtaagacatagattattactttattagccctccccaaattttgaggacattcgtacataaatctgagagttattttcatgagattatctcaccagatggcttacttaaatatttgtaccattgtagaagtaattacttcatctgggagaaaaaaaaaagttcaaaagccctggattatttttgtctgttttcatttgtttcatttctattttactttctagacaggagtaaacttacatttctatgataaatagatgttggtaaggttttggaaaatacatatatgtcaaaatataggaaattctctgtgtcagaaataaccacaattatggtgtaatgaatgcaatactcaacagagagttggaaaataaggcataaattttgagttttagtaaatatgagctatgtaaccttgtgcaagtcacttaatcttactaacatcatattcatctgctaaaaattgagtaaataatggaaactccattgagccattatatgaattaaaacataatgccacatttgaaagtgctaaggaatccacgccagaaaaggctaattaaggagttaatcaattaccattatcaattttttaaatactaaataattactagtttgaacatctagtactgctagtaacaggttatattttgcctagctatttgaagcagttaaaaagagttcctttgaggatttgaggcagtttggctaacagggaaagaatcctggcctggaagcagatacccaagttcaatttctcggtgttctatttgcctgaagtgacaccttgggtagattatttgacttttcagggccacatgtcctcatctatataatgaggatggttatgaaaaataaattactacttgtaaagtacttagaggcttgtctggaatgttatgtcagccctgtggatgttagctagtagcgatcatcactgagttttcctgaaagccttccaacagctgggaggccacagctggccacactctagtgtcccacagagggaccacaggagtctcctcctcttgccttccatgcccccactctgtccaaaactgctagtagtgccacacaaggacatagaaactgagagcaagactgagagaataagactaagagagagagaattctgaaaatagaacaaaatgctattttatcaaaacagagcagagtttggaaggcttctagtgctctatcttctcactaaatatttgtatgactttaaaatgtcacaatttctctgcagcagtatttactcatgcgaatattagaaattattataattacatggaacatttgtttagggttttaccatttacaaggtgggagagcagaataacttaatcgtgaacaccagagctttggaatcaagcaggattagatcccaggtttgttgtttactagctggtcaagtcatttaacttctctatgcctcagtgttttaatttgaaaactagtaattcagaaatgttcctcagaattattaaagatttaaataaaattgtttattctcatatatatatttatagaatctcatagcagaaaatttggcagtggtgatgcacataaatggtagctttaaaaacaattttttctgtctgttgtatgtaatttatataatttgcgtgtaatcccaccatgattagaaaaaatattatctgaggagactaaatgcagcataagtcaattttggagaaagtggttataaaacaattccacagaaaacatgggaatatgccctaaaatattgactatggttattaaaatgagggaaaatatgaggcaatatttcttatctatacttatccatattttagcattccatacaaacatcatgttttccatatttgagaaaattatatgtgccatgaaaatacttgtcaactttgtccatcttgcaaacctactctcccctgtcttctacctaggaactgtaataggaggtattgctcctaaaaatctatgatcgcatgatatattttgaaaataatggtcataattcaccatattttcttacatgatggaaaaaatttgttagtctcttttctagtaatatgaataaaaatgatcatcttgggtttggtaagtagtgactgcatgcttactaccatccctgctaggagtttctttcctctgcaccacctctttcacatatagcccccagaatatatctttctaaacccagattcggtaactatctttccacaagcttaaaaatgactgctcaaagcataaaaataagaggctattttttgcctgttttaaaaagtagtatggccttaagttctattttcagcttcttatcctattataccttattttaacaaagtatctcattttctaggtatattggaatacagtcttcaagtttggggtcattttctctctctgactgacatgaattatgatttcctcattattcgactgtgaaaatccttttaatatctcagttcaacctaaaacttcaccaaaagcagatattaaactgtttgttcagatttcagaatgcccagtgaatgagtcacatttacaaagtgtgagtttacctatatgcatatggtggtcccttctctccatactgcaaggaaacctgttattctagcattcttagttgccttatattagtactctgatggtcagaaaccctaatcactttgaacttggcagcctgttagtggtaagacttggactttgaggccgaagtcctttcttggagacgttgagtccaaatttatatattgtacttgaatccagatttttcaaaacgtttaattggcagttacaggcaatgccccaactaaaattaaagtggaacttacatttctcatttgtccttgttccttgagtatattattgccttggaaaccttgtgggaaatagatgatttataaagcatggttctattaatcttgggtttctctagccaaacaacatttaacagcaatctaaaacttatcgtacatgtagtatattagcaaaattgccatcctgttcttactcatatacttcctcgctcaaagtggctggtgtctaaggtaaaaagtgtctccagactcgttcatattattcttttctactttccactgccaaggtaaatcaatggccagactacactgccatcccttttttttctgaatttttgtctacttttttttttttcactctgaatctcatgcttctttttaataaagcaggatgttcccaaactcttcatcctcaccagtacacacacacacacacacacacacacattttctattttcatctctagcttgtttccgtgatggcacttataacttaaatttgcttatttctatgtttgcttgttgtttcttggccatcctcactggtatctccaagatgcagagggtgtgcctttcttactcatctctataaccccagttaccatagcagtgtctagcacaaatgagaaacacaataataacaaattcattctcatctaatattaatgcccaaagctctggaacatgaagcccacctactgcaataatagtcattttggggacaaatacgatttttcctgctacttgtgtttttcctctagagattatgagtatatacttttttaaattatggtaaaatacatataatcaacttttccatctgaaccattttaagggtaaaattcagtggcatcatacatattcacagtgctaagtaactatcagcactatttccaaaatcacttcacctcagatggaaactccatccccactaagcaatcactccccagttcccacttccccagtccctggtagtctttactctactttctacctccatcaacgtatctattccagatatttcatataattgaaatcatacaatatttgtcttcttgtatctagtttattttttcagtctagtgttttcagggtttatccgtgttgtggcatgtatcagacttcattccttcttaaggctaaatatgccattgtatgaatatacaggacaacattttgttcatctatttatctactgatgaacaccaagtttatttggctatcataagtaatgtttttatgaacattgatatgcaaatatttgtttgagtttctgttctcaatacttctttgagaacctaggagttctcaaatacctaggagtggaatttttgtttcatatgtaaactctacatttaactgtttgtggaaccaccaaatggtttccacagcagttacatcattttacattgtgatgggtatagttttgattggctttctttctttagctgaggctgtgaagagggagtgaattagacaaaaacctgaacaattctcaaacatatatgtttagactatatatgtctaagattgtcaaatggttagacaaagaggaatatcctatatggtttgaatcagcagcacttttaagcaagaacatgataaaccatacatttaaaatgtatttcaagcaagaatccagtaggtgaaatgtctattcacgtcaatatatagccatagaaatgggctcaatacttaaaaacacacaatgtagaacgtattttttttttgtttcagataaagtcctaaaatatgcaacccaaaatccaagaaatattttaaaattgctggtctctatcccttttcagtagctagagaatgggaacaaaaacaaatccaaagttctcctgaattttaaggtttaaatcttttattgaaatgctctaaaataacaagcgaatgcgtccagtcatgtttggaaaaaaaatgttgctttgtaaataagaatatattttttcctagtcacttcttgatttttccatgcaagtcacgtgttcccaaaagatgaaaaagattaaatatttaccatagaacatctaaaaacaataaaaaaagggactagtccccactgtatataaagctctgctccaggcagaaggataactagttggagtctctgggcactcataagagaacagattcatttttaacaagtccttcgcctacacagaactgtaattgcatagcttgtgtggtgtctgtatctttatcattttctatttattcatctatcctgtgtttcctgttcatttcctgtgaaaaatgaataattaaataagctaacaaattaaacaaatttaacaaattaaaacaaacaaatgagaaagcatatagattttttgtactcaacagtgacactttccctcactgttggaatactctaaacacctttctatccatatgatgggtagtatatttaattcgtgtaccacccaggtagcatagtgtatagaaaacagcattagggttcacagactttgtttttatcctggctctacttctaataagctgtttgactttgaatatgtcactaaacctctttaggctatgtttccttattcgtaaattgagcaagttgaaccagatcactggtttacacattgtgttgcctcagaagctaaaattggagatgagggggaagtaaattagtagggctctgtgctcactgtgcttactttaaatacagtggttttactttcatttgccttatgcatttggcatctgtgcacagttttatttgggaagaagaaaaagtccctcttttggaaatggtggtggggaacctagaaatatgaactagtcagtaacaattctttgctacccaagtacgaaattttttattgtcttaatatacaaccagtaaaaataacagcatctaaccagttggggtgttgatgagaagtcacaaataagtattgtacaatactgtaagtattggcgaagttcagaggaacgtgtatctgtataacttcctaaaatgaccaaatgaagagtattagagcattcaaaaattgagattgtgaagcaggagtattgcttcaaaaataacattgttatttttcaataggtattccgcatcaagataatacatttttaaaaatgtacatactttggtataactaaaataatgataatgcaacatttttcaatttactgccatcaaacaaattgatgtttgttactttcttaaaggggctgacttatcctaaggaactttattctctcatatttcatggaaataacattagactagaaaacaaggctctcatctggtcttggcttcctaaagtgcacaggtaaaggcttgcatttgccctctatgcatttgatttgctctctctttctctgcattgtcacacttttgccatggagatcattatatactgtgtatgtatatgcatgcatgtgtatgtgttggtgggaggggggagggctcaggctaacctgtccataatgaagaataatatctcagttcataagtttttaaaaaatgtcagatttctccatcttcagagttgaaagcatccataatagtcattttgtccaacatccttgttaatgttcaatctttctatagtatctcttaaagattttccagtaatagaaactatattccattatgaaacagctgaacttattttaaaacaaacaaacaaaagcacttgataaaattccattccttggatgtgagttttactctcttaagacacagactattctttacctattgacctgttgtcctcatgccagtcccttaaatgcctgatggaggctgacatgttcccaggtctacatacatgagcatggaacttgggattgcaaatttgagtagcaatatgcttgattcaatcctccctgttgctattttaatattcttaataacttttgaacaaatgctccctgatttttattttgcagtgggccttgcaaattatgtagccagttatgcataatccttaaatcatctatcctcaagcttaataaccccagttcctacagtatctgttcatgatcattggtattaaataggtttgtttgtcaatgaccatgttagaaggtaatggccagaattgagcacagtgctctaggtgtggtctgatcagtgagaaaatcagaggcatgattatatcccatggtgatatctcctgtgcctctctattctcacccgctcaagatccagtctctcgacaattctctgccctgctctgagcccaagaaggcaaactcatgcagagggtagcagttgagatcccttcctgtctggcatccagctgggttaatggaaggcaataggggatggcaatgtagaagagagaattcagggtatttccttcccctcccctgtctcagagctgcatccctctctgtggtaaaaactgcatccctctctgatgagaattcctactggttggtccctcttttacagttccatatcttctttttttttccttctctctctctcttttttttttttttttttaggtggagtcgtgctttgtcacccaggctggagtgcagtggcacagtctcggctcactccaacctctgcctcccaggttcaagcaatcctcctgcctcagcttcccaaatacatgagattaccagcatgtgctcccatgccaggctaatttttgtatttttagtagatatgggatatcaccatgttggccaggctggtctcgaactcctgacttcaagtgttttacatacctcggcctcccaaagtgctagaattacaggtgtgagccatgtggcctacagttccatatctcactggtcacacaatactgttttctctccttgttccttcagccctagtgggtattaatggtttcctgctgcttctgctcctttaatcctgatcacataccatatgcattcctttcgtagaaccatcttcatttgaatcatatggggtaaattctgtaccttgccaatgctctgataaatcactcagcatgttggtgtcatatgtctcttaatgtctccagttagcatacattttggacatttctctagaaggatgaagttgacattctttgcttcactgagtcactgatctagggtctccttccacacttccaatcaccttctgaagagtgacagagggtgctcaaatttctatctttgagacatcatgcttccagaatataattaattcaaaaatatgaagaaatagttcctacacatcaagcattctctctcccaagaactggagatatagtagtgaccaatcacatcaagttctctatcctaatggagtttagtgagattcttgtgagagatcaaagatataaaccagaggcctctaagaagctaaataacatgactggcctaatttagaagttttactctggttgctgtattcagaatacactgccagaatccaggagaggcagcaagaacagttagaataatacaagtgaggagacatggcagcttggactaaggcagtggcagcaggtggtaaggttattctgtgactcagcacacatccttgctgccctgtttctctgttccattgaatcccaaggtaggatccatatcttatcctgtactttaccagcttactacaaacaatttgtgaataactgcatagtgaattaaaggtcaacaatatccactttactttcaaggaaaataattttcctttttcttagcaatcataataggtatttttcttcttttctcaaacgtaaagaaaaatgttgtaatattcctggggactatgaaagaaattaaaagtcaaatgaaagtgctcattgaattattcatagaaaattatctaaaatgaaatgaaaaaggggattatcatcttcaatttgcctcaatattcaggtatgggtaagaaaatactcagaaaattaaggtttccttaacaagatttttaatggttttgttagtaacttttacaaaaacaaaaaggtcacattttccagaagatggaataatcaataactatactattttgagcactaggtttgactacttctgcctactctttgtagaataaaaaaaaatctaatttttagttatactgagagcaagagaaattcagtgaaggaggaggacagagaggaggaggaggagaaaagaaaacatcaataaatatactatgaagtagtaccccagaaataaagctgcccgatagagctttcctaatgtaacaagattggtggtttataaaacaaaatgcaaccatcttttgttgttgaattgtaagactttttttaatgtgcggcataagtttgattcaaaaaccagtgatatcgaggtcatattagaataaattagtggagagctgaaatgtaattaattgaaaataaggggaaggggataagttcttgctcccttgccccattatggagagtatctgtttctattacagctgttgtagctatccaagactaaattcaattttcttgcaaaggtcatatattctctcattatctaatcaaaaatatattattaatatataatgcattaattaatttaaaattccattaatacttatgtgacaggcttttggacctggatcttcaacagttatttgacaatccatttcttcagttcttaggaaataatctgacaatatgtatgggctgcaaacaggtttctttggaggatcttcaaagcaccactaccaacatcttctaacttcatatctgccagtcaggaagaggcttgataactagaggttttgttgtgcagacattatgttccttaagaacagttttttagtctcatggttgtctacaaaactgaaggccgaatagtcttttatcttctgaagaaaatgaagtttttacttaagtaaagaaaacaaaaactaccacagaatagtcaaacaatcctgaaaggctatggtcacaataaatttcttataagataagataataataagataaatttgagaattaggtaaataatggctgtgccatttattcttcttaattattcatttggtaggaggagaaacaagatggctgaagagaagcatccagcaattgttccccttgcaggaacaccaaattgaacaactgtctacataagaaagcatcttcataaccaaaaatcaagctagcaattacagtgtatgcctttaacctcatatcaaggaaatagatatgaaagaaggtaggaaagacagtctttacttgcgtacaccacccctcccccatcccccagttcatcacaaggcagtaggacagagaatctgtatgcttggtagaaggagagtgcattgattttgagacttcacattataactcagttctgacttgtcacaggggaaagtaatgcaaggcagaattcagccagcctccaaggaggaaggatttagaccagctctagtcaaagggaaatagcacatctgaggagtaagaacctgagccatggctagcaccaccaccatgagttaaattgccctgagatcctaaataaactagaaaggctgcctagaccacaaggactgtaattcctgggcagtcttggtgctttgctgggcttggagccagtggacttggggtgcatgtaactcagtaagaaaccagctggagcagcaaagggagtgtcatccctcccccaactctggcaacacagctcacaattctgggagaattcctccagcttgaggaaaagagagagaaaagagaactttgtcttgcaacttcggtaacagctcagccgtagtacaataaagcacaaatctaatccataaagaccccaatactaggacatagctcccagatgacatttctagactcaccctgggccagaagggaacctgcagccctgaaatgaaagacctaggcgtggcaggattcagcacctctgactaaagagcccttgagcattgaatatacagcagccatagccagacactagtcaccataggccttgggcaagacccagtactgtgctagcctcagctgtgaccaagaagagtcccagcaatggtagtcacaggagggcttgtgacaccccttctccaacttcaggcagctcagtacgaagagacatagagacactgcttgggagaaagtaagtaaagagaacaagactttacctgctaatactgggaattctcttgtatcttactgaagatcaccaaggtggcacctgtatgagtcagcaagacttaaagtgttactgggcttggggtgccccctaatgcacacagtgaccaaagatttagaacaacattcaattccctttaaatacctggaaagccctatcaagaattataggtataaataagctcagactgcaatgattagaataaactagtttttcaatgtccagacattgacaaacatccaaaagtattaagaccatctaggaaaacatgactttgccaaactaaataaggcaccaatgagcaatcccagagtgacagagatatgtgacctttcagataactcaaaatagctgttttgaagaaacgcaatgaaattcaggacattacagagaagaaattcagaattccatcagataattttaacaaagagattaaaataatcttaaaaactcaagcagaaattctggaacagccctattaactgacaaacagaaaaatgcatcagagtctctcaagagcagaatggatgaaggagaagaaaggatttgtgtgcttgaacaggctatttgaaaacacacagacagaggaaagcaataacaaaaaaaatgaagcatgcctacaagatttataaaatagcatgaaaagggaaaatctaagagttattggccttaaataggagacagaaagagagattggggtagaaagcatattgaaaaaaataacagagaactttccaaacctatagaaatatatcaatatttaagtacaacaaggttatagaacacaagcagacttaacccaaataagactaactcaggagatttaataagcaaactcccaaacatcaaaaataaagaaaggatcataaaggcagcaagaaaaaaagaaacaacatacaaaggagcaccaatacatctggcagcagacttaaagtcttgaccttacacaccaggagagagtggcatgacctatctaaaatgctgaaggaaaaaaaaaaaacaaaaacaaaccaaacaaacaaacaaaaaaatcttttatccaagaatagtatatccagtgaaaatatcctgcagacatgaaggagaaataaaaaaattcccctggcaaagaaatatacctaatgctagatgacaagttagtgggtgcagcgcaccagcatggcacatgtatacatatgtaactaacctgcacattgtgcacatgtaccctaaaacttaaagtataataataataaataaattaatttaaaaaaaaacctgagggatttcatccataccagatctttcctaaagaaagtttttaatctgaaagaaaaggacattaaggagcaataagaaatcatttgaaagtacaaaactgactggaaataagtacacagacaaatataaaatactgtaactgtaattgtggtgtgtaaactactcatatcttgagtaggaagactaaaagacaaatttatctgaaataataactccaacaacttttaaagacatacatagtataagaagatataaatagaaacaacaaaaagttaaagagcaagaagtatgaagttaaatgtagagtttttattagtttttctttgtttttgcaatcagagttaagtagtcatcaatttaaagtaatgagttatgttatttgcaagcctcatggtaacctcaaatcaaaaaacctaaaaaatataaaaacacacacacacaaaataaaaatcaaaaaattaaaacataccaccagagaaaaacactttcacaaaaagtaagacaggaaggacagaaggaagagaagactccaagacaaccagagaacaaataacaaagtggtagtagtaagtccttatttatcaataataacattaaatataataggctaaacactccaataaaaaaaatagagtggctgaatgcattaaaactaaactcaacaatatgctgccttcaagaaacacacctcacctataaagacatacactgaaaaaaaaaaagatggaaaaagatatcccacaccaatggcattcgaagaacagcaggagtagctatatatatatatatatatcggataaaatagattttaagacaataactacaaaaagaggcaaagaaagtcattatatattgataaaggggtcaattcagcaagtggatataacaattttaaatatatatgcgcctaacactagagaacacagatatataaaacaaacgttataagagctaaagagagtgatagatcccaatataataatagttggaggcttcaccatcccacttgcaggattggacagattatccagacaggaaatcaataaagaaatatcagacttaataggcactatagatcaaatggatctaatagatatttacagaatattttatttaacaactgcagaatatacattcttttcctcagcacatacatcatgctcaaggatagactatatgttaggccacaaaacaagactcacaaaattaaaagaaaatgagatcatatcaagtgttttctcagagaacaacagaataatattaaatagcaataacaagaggtactttggaaactataaaaacacgtggaaattaaacaaaatgttcctgaatgaccagtgggcccatgaataaattaaaacaaaagttttaaaaattcatgaagccaatgaaaatgaaaatgcaaaatcccaaaatctatgggatacagagaaagcaatgttaagaggaaagtttataccaataagtgcctacattaaaaaggcatataaattttagataaaaaacctaataacacatcttaaataactagaaaaataagggcaaggcacactcaaacttggtagaaaaaaagaaataatccacatcagagcagaagtaaatgaaattgaaacaggggaaaatacaaaacatcaatgaaatgaaaagatggttttctgaaaggataaaaaaatcaacaaacctttagccagactaaaaacaaaagagagaagatcaaaattttaaaatcagatgaaaaaggtgatattacaactgataccacagaaatccaaaggatcattgtagactactatgagcaactatatgccaataaattggaaaacctagaggaaacaggtaaattcctagacacatacaaattaccagtatcaaatgatgaagaaatctaaaacctaaatagaccaataacaagtaagaagattaaagtcataagaaaaattctcccagccaaaaaaaaaaaaaaaccaaaaaaaaaaaaacctcagggcccactggatttattgctaaattctaccaaacacttatgaggaactaatacaaatactactcaaagtgttccaatatatagaggaggagggaatatttccaaactcattggaagtactactaattctatgaggccagtaatatcctgataccaaaacaggacgaagacacatcaaaaaaacaaaaatgcaggacaatatctctgataaacatagaggcaaaaatcctcaacaaaatactagcaaaccaaattcaccaatgcattaaaaacatcattcattttactttaagttctgggatacatgtgccatgccagtttgttacacagatatacatgtgccatggtggtttgctgcacctatcaacccttgttctctgagagcccagtgacaatacctgcctcacctcacattacccaatggaaaataggaacaaatctactttgacaggaaaagtgctacataagtgtatggcattcttattttttaaaaacatatatgtgcaggttataatggctttcaaagctggcctccttataagtgaatgagatatcagcaaattaatagaatctattgtaccctcagtcctgaaaatatcttaatattccacacttaaaagaccactgcgtttttttttaataaagtgaaatctcactgtgttaaaaatagtgtgattaaaaacaatattgttaaaaaaaatcattcaccatgaccaagtggaatttatcccagggatacaaggatggttcaacatacacaaatcaatcaatgtgatacatcatatcaacagaatgaaggataaaacaatatgatcatcttaatcaatgctgaaaaggcatttgataaaattcagcattcttttatggtaaaaatcttcaaaatactgggcttaggccaggcgcagtggctcatgcctgtaatcctagcactttgggaggccgaggcggacagatcacaaggttaggagattgagaccatcctggctaacacggtgaaaccccgtctctagtaaaaaacaacaacaaaaaaaattagctgggcatggtggcgggcacctgtagtcccagctactctggaggctatggcaggagaatggtgggaacccgggaggctgagcttgcagtgagctgagatcatgccactgcactccagcctgggagacagagtgagactccatttaaaaaaaaaaatactgggcttagaaggaacataacaacaactgaaagccttggatctaagatttggaacaagataaggatgcctactgtccctactgttattcagcataattctggaagtcctagtaagagccatcaatagaaagaagtaaatggcttctaaattgtaaaagaaaaaatcaaattatctgcatttgtagatgataacttatatttagaaactcctaatgatgccatcaaaaaccttttagaataaattcagtaaagtttcagaataccaaataaaaatacaaaaaaaaccgtatttctatatgccaacagtgaaaaatatgaaaaagaaatcaagaaagtaatcccatttacattagctacaaataaaataaaatcccaaggaaaaaaccaaaaaagtgaaagatctctacaatgaaaactaaaaagcattgatgcaagatattgaagatgatacaaaaaaggtgaaaatattttatatttatggattggaagatttaacattgttaaaatgcccataacacccaaagcaatctgcgattcaaagaaatttctatcaaaataccatttaccttctcacataagtagaaaaagtattctaaaatttatgtggaaccacaaaagactcagaacagccaacgctatcctgagcaaaaggaacaaaactggaggaatgacattacctccagttatactacagagctataataaacaaaacagcatggtgatggcacaaaaacagacacatagaccaatgtaacaaaatagataacacagaaataaatccatatatcaacagtgaactcatttttgactaaagagtcaagaaaatacattagggaaaggacagtctctacaattaatggtgtttggaaaactgggtatccatatgcagaagaataaaactatactcttttcttgccgtatacaaaaatcaaatcaaaatggattcaagactgaaatctgagaccttaagctacaaaactactaaaagaaaacatctgggaaaggctctaaggcatgagtttgggcaaatatttattgagtaacacccaacaactacaagcaaccaaagcaaacatggacaaaggggatcatatcaagttaaaaatctccttcacagcaaaggaaatgatcaacaaagtgaagagacaacccatagaatgggaaaaatgttagcaaactctacatctgacaagggattaataaccagaatatataagaagctcaagcaactcaatggtaaaaaatctgataatccagtttaaaatgggcaaaatatctgaatacacattcctcaaaagaagttatacaaatggcaaatgagtaaatgaaaggtttctcaatatcattgatcatcagagaaatgtgaatcaaaactacaatatgatttcatctcacccatttaaaatggctcttatccaaaagacaggaaataacaaatgctggcaagtatataaaagactgggaatataaattactaccaccactatggagaacagtgtggagggtcctcagaaaactacaagtaaaaccaccatatgattcagaaattttactggtatgtacccaaaaggaaggaaaacagtacattgaagagatacctagactcccatgtttactgcaacattattgaaaataaccaagatttgtaagcaaaccgaagtgttcatcagtagatgaatggataaggcaaatgtagcgcatatacacaagatagcactattcaggcataaaaaaatgagaccctgtcatgttcaacagcgtggatggaactggaagacattatgttaagtgaaataagccaagcacagaaagacaaactcatgttctcactcatttgcaggggcaaaaaattgaaataattgaattcatagagtagacagtagaatgatggttaccagaagctgggaagtgtagtggggagtagaggaaaaggggggtggttaataagtccaaaaatatagttagatagaatgaataatatctagtatttgatagcatagcagggtgactacactcaacaatttattgtacatttttaaataacaaaaagagtatagttggaatgcccataacaccaagaaaggataaatgcctgaggtgatgaatatctcatttactctgatttgattattatgcattgtatccatgtatcaaaatatctcatgtaccccatgaatatatatattcgtatacctgaatatatatattcatatatattcgtatttatgtgagtatacatatgaatatatattcacatacatattaatatatatacctactatatacccataaaaattaaaataaaaaaattaaagggaaaaataaataaatactaaaaatgggcaaaaggtctgaatagacgtttttctaaggaagacatacaaattgtcaacagacacatgacaagatgtttaatgtcactaatcatcagggaaatgaaaatcaaagccacagtgagatatcacctcacacctgttagtatagctataatcaaaaaaaaaaaataagaaataatcattgttagccagggtgtggagaataggtaactcatgtacactgtttctgagaatgtaaattggtacaaccattttggaaaatagtttggagcttccttaaaattttaaaatataactactataaaaccagcaatacctctgctaggtatctatgtaaaggaaatgaagtcagcaccttgtagaaagatctacattcccatgtttattgcagcatcatgcacagtaacaaaggtatgaaaacaactcaagtgtccatcagtggataaataaattgttattttatatatacatacaaatgaatactattcagccttgaaaaagaaggcaatcctgccatttgcaacaatataatgaatctgaaagacattatactaagtcaaataagccagacacaggaaaatagatactgcatgatctcacttacatgtcgattgtaagaaatagtcaaatatatggaaacagaaagtagaacactagttaccagggacacagaggaagagaaaatggggagatgtaagtcaaaaatgtacaaacttgcagctacgtaaaatgaataagtttagatatctaatattataatgtacagcattataatattattaactacagttaataatattgtattatataattaaatttgctaagaaagtagattttaggaactctcaccacacataagtcacctatggaaagtgatgggtatactaatttgcttatctatagtaagcatttcactatgtatatgtttatcaaaatatcattttgtatatattaactatacacaataaaaataaatttaaaaaaatcattttgggggagggaagctgtaaatatctcacagatgttttacttcagctaggaaaaaacctgaagagttataaggatcatgtgtttttattaaaattatgtagttatatataactacacgtgttgttgaaacatagatagataccaaagcaaagaaatgatcgattggcctcaagatagacaggaaggatttaattagctcaacagtgtcatgatttaaataaaaataataatgataaaataactgacacttataaaatggccactgtgtctctatgtgattttagtgcccaagaaaagagctattactctttcagagttgaggaaaagatcagagatactgactactttttgctgctttatttttttccttttccttagaaactagcttcatctcccaaagtcccacctcatcctctgcctttactttgtactatgcttggccccattagcaacttaattgctgacccgtcatgtatttctctctgatatttgacatatcacatccttacaacataaccttattcaccatcaggggttcctaatccaaatttcaaggcatagataatagtttactgagtcaattgtaatgtattacacgggtttaaacacttacctaaaaatcaaaaagcacctcaagagtgttctaagatgtggcactggccgggtgctggggtggctcatgcccataatcccagcaatttggaaggctgaagcaagcagatcacttgaggccaagagttgaagaccagcctggccaagatgacaaaaccacaactctactaaaaatacaaaaattacctgggtgtggtacatgcctgtaatcctagctcctctggaggctgaggcatgagaatagcttgaacctgaaaggcagaggttacagtgagccgagattgtgccactgcacgctagactgggtgacagagcaacactcagtctcaaaaaaaataaaaaagtgaggcacatttcttcttttcctgcccattaaaactttcccttttactatatctggaggcagctaggtacactcttaaaggagccaggattaaatcaagcacatgaaatccaaattctggtcctgtaaatacaaatgtccagccactgattgaccagctattatatgcacaacactatgttaggtgcctcctgcaccttttcccatttgattccctaaactctcaatgaatacattacttctgtgtcttacagataaggtcacaagcagcagtctgcagagcccatattcaaaaccaaatccttctaaaatcaaaaaccaggctgactcccctggatgctattctaaagtcaaatttcaaattatactttgttttctacagtgtgagttgtgaaaagtagtacaaattcactgtgattaccactagcatgttgaaagataacattttatgggtaaaataagtacttattgctttaaaatgatagccacagatatcatccaggcattaagtttatatctacagagagtgttcatacaaaacttacgtatatatctactgatggtgttcatataaaacttgacctttccatccattcagtctttatctcttcacatatacctttgtatttgcttaaagactactttgtctatttagcaactcaacttttggttcattggagctagaattttcacctgtatctctacaaatctatattaattttatttcaaaatgactgtttttgatttgttttcccagatcttacagtatgctccattggaactagacttctaaatcatagagaaatctatttcttaaatgacatcaatctaagatccaccaaaatgttaaccctatgagggcagttctgtgttctgttcattgtttatcgcacacctagaatggctctttacatctatgggagctactcagcaaatacttgttcaatgattgagtgaatctagtccatctattttgactacataaattaattatttgataattatatttcaactatttaactaacagttaaatatttacatttcaactatttacatgtttgaactattcacaggaaaatgctatgaccaatttcttttcttgtagcctttcttttcaggagactaaaacttcaatgcatgcaatgctaatttgttgtcagcctcatgacatcttaaataaagaaaaccctctttatcctggggtggtttggatgaacttagcggaatgctcaaaaactaaaggtgaaccaaaaagaaggaagtcaatatagttcaggaagctccctcctcctgttggccttatttcgattcttctagggctatttacacgtagccaaataccccagaatttaaaattaaagcctttggaatgtctggcagaaagaatatattctagaagtaaaacctcagacttagattcttttgactgtttggcatcattattttgaatttgcaatgtgaatgagaaacaaacaaatgaaaaagataaagtaaaagaaaaccctcaatttcaaagttgcacatatttgtcattatttaaaaagaagagtacatgttaaaggcctaaatattttaaataaacattttctaccacaaaagatagcattttatcataaaattggcaatttttagaccattgaacttaatttgaatggactaaactttgtctcttggcaaccagaatccacacaaattggtaggcactttctctggaggaagatcatgcttctcaatacttatgaactccaagctaaaggctggctttactactgaaaacatcacaaagttaagccaccagtatagacaggaaggattttaagtttctattttctcttgtttgtgtgtgtgttcaattaattttaaagaaataacagtgagattcagatttcttaaaaatattttttaggacattattaatagctcaaataaagccattaatacatgcacgttatgatgatcaagtgatcctggttaaaattaagggaaaggtacactttaaaaatatgatttaaaaagcccccccagtcacttaacttcagaagcagggcccggtagcccaccctgtccttggtttttaacatagaaattaaggtggtagcttcggcaggtgttattaccaggggctcatgagtagaccctaaaaggtttgtgaaccctcttaggattatgtgcagcgtttcacatggatgggcacatatgcatttccctggggtaaaaggcatctgattctcaaaggagatatcaacaaaattgatgagaaattttggtgtagggaaaagtacgtaagaccaacatttaggaattctgggttttaattgtaataaggtgcttaccagttatataattgtaggcgaatcatttctctgggccccagttacttcatctgtggttactgtgggccccagttacttcactgtggttccacacttgtgggttgcgataactgcaactccaaagagtagttgtgggtctgtgaatccataagtgtaccaagtttcatctatggattgacaatctatcatatgtgtgtgtgtgtgtgtgtatatatatatatatatatgtatatatgtatatatatatatgtactattaattcataatgagtggtgatgttactgtgatttacaagaacacaaaagcattttaaaatatccttaaatttattgtagtttttggtcactacatgttttctgaatcaatcactgataaaatgacaattataagttttgccaaaacacattggaaggactagttcaaacaattctaagctgtgtccagctcaataagtgtaatgtttagatattttattaaatattccaaacgtgggtctgtgattttatgttttaatttataagtttctgtgtaacatataccaacatatttttaaaatgtacactgtttgttatcagtgcagtaaatggatagtaagaaatatggatgaaatttttttcccttattggtttgtacctatgtgtatgtgtatatacacacacacacacacacacacacacacacacacacactcaagagtttatttctttggtactttggctgctgaatatgagatttagttttagacaattttaagttgataacattgctctttctctcaccaaaaaagtggtcaagtaaattgacatatctaaattcaaattcatcatgtgaaattggaataataataaccaaatcatggcactactgttgctcaaaaattagagcctacaatctacctctgataggtccttggttctggcttattggtcagcctgcactcccatggataggtgtacccaactaagactaaagaaagttcttcaattatcatttaaagaaaattatttattaaactattaaactagttaaatattaataagcccaataataaaaatatgctttgtaaagcaagatttaaacaattaacaacatacaatttacttttcatctttattattaaacatgaatgaaatacataaattaaaaatacatttaatatgtttaattgggaaatttagtttttcatatttaaactatcctatatatatccaaaagcaagataaaaactctaaggcaattctaatttatcatgaaaagcttttgttcagtctaatggcctatttaatactaacgaaaagtccggcaacagaatttgggtttcttaatgttcctttacatgactaagcattttgtgttattattcaaaggtattttattatcttgtaaacttaagtttatgtttgtcaatgagacccccaaattcttcatttttaaaataggtaacaatatgaaattaaatgcatttattacttattagtgaagctctatatgtggcttctaattacatatgaatagtttggtcaagagaggcctcaaaaaaatgagaacaagttttcccagttcatctggactgaatcactatatgcataagtgatacatgttttattctcaaacacttgggttttgtttaagcacaccaaggattctagtttggctgtttcccaagtttgctttaaagtaagattattggatcagactggtgtttcaaagaaataaatcaaaatgtacacagtcaaatttgttaggcagaaaaaaactgtcatctctccaaacgttttttggtgcctatgtttctcaagctcaaagaaaataagacatgccaaaaaaggagcatctgtcttaatgtaagtaaagaaaagtgataaaaaataatttgtgctgggtgcagtgacctgtaataccaatgacttgggaggcggaagagaaaggattgcttgaggacaggagattgagaccaacctgagcagcatagtgagacccagtgttcaccaaaattaaaaaaaaaaaattagtttggcatagtgaagaatgcctgtagtcccagctactcaggaggctgaggcaggacaattgcttgagctcaggagctggaggctgcaatgagctgtgtttgtaccactgtattccagcccgggcaacagaagtaacatcccatctctaataaatacataaataagtaagtaaattatctgatgcattattcaaggaaaaaaggaaagcaacttttatcatgtggccctcaaatacaactttacctcatattgccaacttctttgtttttttgagatgggagtttcgctcttgttgcctaggctggagtgcaatggtgagatcactgcaacctcactgcaacctctggttgctcactgcaacctctgcctcctgggttcaagcaattctcctgcctcagcttcctgagtagctgggattacaggcatccgccaccacgcccagctaattttttgtatttttagtagagatggggtttcactatgttggccaggctggtctcaaattcctgacctcaggcaatccacccaccttggcctccaacagtgctgggattacaggcatgaatgagtcaccacactcggcctcatattgccaactccttaatggtagagaacaaaagtaaatagatttatgaaccatttcaattctagatgaagggaagtgtagtaggtctttctttaaaaaaaaatgggagattgtagttgctgattttattatttctagaggtggaaagtatacaaagcatgctttatacaattatattttatatacaggtatataaaaatggaggacattcttttaatgagagtttttttaaatgctattatatgtgctataggtaaatacatgactattttcaaatgaaaagcttaaaacttctcctgaaaataattcagtgtcatttttagtgattctccaatgagtttcaaatactatatgctatctgaaaagcattacaaataaaacacttcatcttacttattcaacaaatattttatgtactttgccagtcactgtaatattgagttctgattatgctacataattgagtaaaatatataccactttaaggaatatgcataaaaatgagagaaatgactttattaacacctaaccatgcaaaattaaaatgaacacaaagatagagaaagcatattgaaagaaccaaagtaaaaaaaaaaaatcatcctaattagagagattaaggaaggtgcaaacagacactagcctttgatctgggtcccattgataagtacaatgtaaacaggcaaagaagaaaccaaaagcagggctggaaaaccatgttgaggaactagcatgagcaaagacagagacttgtgaatttctagccccacacagggctctaaaagagataaaatacagttgttattgttgttgtttttcctttgtaccggctctatatcataaactgagaattattttattgtggatgatgtcacatctcaccttatttcttatttatattgccatttgttatttctgtatatgaagaaagtgggctgaaatatttttgaggctttttcatggttcacctttgaactaaaatgatagtattatttatatcttcgctactgtctctgatatataaacacattatatatgtcatgaaaacacactgcatggttcatcaattaagatatcctaatatttgatctcatctattaggagaaagagtagcaattgagtgcatccataaataaaataaacctgactgtttttaagattgacccgtctcatcaaagactaaaacacataaaaccagagtcagcaaggatgtagggaaggaagtctcacaaagttttattgggtgtatagaccagcatgggattactgagtttatagttcaacaatccatttcaaaaacctccctgttttctattttttatcttttgatacaacagctaaataatgaaatttcaaaggaacatgtaaatgttttggtttgagtattatacttctgacaatttatcctgacataataaatttggatgcacaaattaaaaagaatcttatgttagtatatataaacacaaatatttggaaattacataaatgcctaacaacagtttattggctaaaaaagttataatcatataataacacactatgcagctatcaaaacttacagtgtatatgcacatagttagctagtgatatggaaattttcataatatgtgtaagtgatgcttagcctagttcctcatatatagtgagcacttaatccagtttagttattatatctgctgttgtgtctgttattaataagatgttatataaatatataaaaaataagcaggttttatatctgtaaatacagaatggtcacagagagataaatagctatatatgtaacaacttattaagagttgtcatatttag

SEQ ID NO: 1823 - DNA, 208434 bp, Homo sapiens
tatatttactaggctcaaaacggataggaacagtatgaatgccagtcatatagcacctctgaggtataggcaataaagcaacagatgcagctatccctcagttctagcaattgttgaactatcccagaaaggctatgggtctttgactccttactttatttttttgagatgaagtctcgctatcccgcccaagctggagtgcagtggcatgatagcagctcaccgtagcctccacctccctggttcaagcgattctcctgctttggcctcctgagtagctgggattacaggcacacactaccatgctcatgtaatttttgtatttttagtagagatggggtttcaccatgttggccaggctgttcttgaacttctgacctcaactgatctgccctcctcggcctcccaaaatgctgggattataggcgtgtgagccaccacacctaacctgtctccttacacttgaactgactctggggcacgctgaagttctctttcctataaaagctttcaaggtaaatattcctataaatgcttcctacaaatgctttcaaggtaaatattttgaggctgaaattctacttttcaatactgatttcttttgtctttatacccccaaggataaaacaccaaaggactgaacctgaaagtagtcctagacaagcatcaaaaagaacagactgaggctgggtgtggtggctcatgcctgtaatcccagcactttgggaggctgaagcaggcagatcacctgaggtcaggagttcgagaccaacctagccaacatggtaaaatcccatttctactaaaaatacaaaattagttgggcatggtggcgcctgtctgtaatcccagctcctccgggaggctgaggcacaagaatcacttgaacccaggaagtggaggttgcagtgagccaaatcacgccactgcactgcagcctgggaaagagagagagagagactgtctccaaaacaaaacaaaacaaaaaacaaacaaaaacaaaaaacagattgggaagataatctaaaagttttaatacaaattatcctaaaatacagatcaaactatatacacagacaagtcatataagtatgctacaatgagtgaacaccgagaaaaggctgtcttttttgttggatatcctgtacatctactaagatatcacaaacatcttgaacaattgtcaatgctatcaaaaattacagtaaatctggcatagacacattgccttaagctctatgcagatttcccttggaaagaaacacggtattaagcagcaagagctataaggatattcctatcttctgacaaaatattctaaccaatttttaaaaatctaccctaaaggagtaactcaacaaacacagccccaaaaatcttattcacaaaggtggtcactgcaatgatatctatcaataatctaaatgttgtaagcattataactatagttatcagttgtggtacaccaaatcaaaatattaaaaagaatcataaaggatatttcttctcttatggaagaagagatttcaagagaaaaaaataatagtttaatatagttgtagtgactaaaaatatacatacacagataacaacaagacaaagagtgttacagttgtaaaactattctgaaattttctttacattttaggtaatagttttatattaaaaagaaacccccataaaaccaaataccctcctgaatgctagtaaggatttactacacaggggaaacctcaaaaaggctaaacaaatatggtatgacaaagaacaagaaaaatcaaaagaatttaagattcaggttggtattaactaacagatgtataacttcaggcatgttataggtattctagatttcagaagttctggtttagatgaaaaagtttcctttcaatagaaaaatgctgtttaaaaatgctgtttgtttttatttcggcattaaattatggcagtgatttgatttatatatggtatatataatttatatggtatatttgatttatatatggtatatataatttatatggtagtgccttcacgtgttctagaaggtactacgtttaagtaacgggttgactgactctccatttgattaagtttttctggtagggattatgagatttaactgcaagaacacttgtcaagataaaatgttgccattctctaacaaagtctcatttcaaaacatttatctttcttatacaaagtctaaagaagaatatgtcaagtaaaatcaccagtaatgtcacgatccatatagctaactactactgctataacagcctgtcttgtttctcatgtctgcaggtgtatatatttaaatgctattcagctttaacatgaatgttattgattttcttatagaaacctgaatcttcctggagtaattcagcccccaaatcaaaattgaagtcaacaggcaacacattattaacatggaaatgttgtcaagaacatagaggtatacagaggtcaagagcataaacatcagaaagggactgtggctggcctgcattcccagccacaaaaaagaaagcactggatactcaggaaggatctacttcagatcttgggaaattctgtaatcaagctagtatccaacagcaggcatttggacatgtcctgcaacccatcatcaatgcaaagagcttaaaatattaatcccaatcacagtgttccatttggaaaaagaaaaacataacacacaaacacatgtaatttcacctagctccttaaatgcaggcactctcccttgagaaaaaatgaacatttcctatcctgcagtctaaaaggctgcaaatgcagaggataaacattaacaaacacttaagaaatattaaatccgcatactaatttcagcttattactactgcagtggtttacatcattagtgtttttagaaaactaaagcatgactgagatatctgctatccaataggcaactgcaaaaaggatgaaagaacttaagactctcctacctagaaaataaggattatcactgaagcttccatttgaattttatttgatgttgagatgaactcagggtttatgcatcccacagccagaaagaaagagtagaaaagctaaagtggtagacagagtgcctctgtaatcccctcctctccaaagcagggccctaggggattatcttttggagtaatcttacagttaaaggtagcaaggagggttgctgaattgctccccccacccctccccccgccccgattgaaagggccaggtgtacagcataaaattactaacatagcaatgagattcaaatttgttattcacataaagcaggcatctcattcattactccactctgggccagatcaagtaagcgtgacaaagaggccttgaatgaaaagctaaaactaaatagtttttacgggggtcgttttttctagggtctaagaaccaatgtctactagatttgtttcaccaaaaagtagagagggttaaggggtaaaaacagagagccacacacttaaaagcacacaataaaattaaactctacctgcaaatatgtatttttactttattcaattaatgccatgtcacacctgcttgcaatgtcattttttaaatgtatcacattcgtttggctagaaaagtcaacagttcagttttggttagttattccctttctgacaaacattaaaatggaaagaaaatgctaactgggtgacaggaatttaacttattcctgggttaaaatagtttttgactttgtatgattgatttcatgtctcaagcccaccccacccccatttcaatgatactgagcatagtttcgcttaaattcaccaaaatattgctggcctataaatagtatactagccatttccattagctagcaccatggccataaaattgtactaaacaagaagtggaatgttctgaaaattccattttcactaagttattgcctaggctttaatttctgcctatgtggggctatgtgcctcactttccggcttctgcaggttgaggataaaagaaaatctataaaattacattataacaattttgaactcatttttttaaagttttgattagcataatgctgttactaatccaatggttcctaagcctaagatttatgtttaccaacacttgaaaataactatctagaatttaaagaaatatagcaaatgcaaaaatgcatcttaaattcttattgttcaacttatttatccatagcccaatttattataaaagacctaacttgtcagtgttttctaacactgtgggtcaaatatttcttggccaatatctgtccctttaccttctatcccaaaacccttgtcaggccaatgaactactcactgtccctagagactgcaaaacttcaaagaaaggaagagtattcctacttacaccaatggaatgaagatgtatcttggactgtgtaaaaagaaacagcaatagcttacatttttagcatgcctttcttctgagaaagcattagctcttcacttaatagtacacttgtttttctcatcacttctgtaaagtaggatgagcaaggaaagggtaaaggagcaggatcattttacaaacagaaactaacacacaaataatgtgttacttgttaattgccatagaagcaatgtttttcgctaaacaaaaccctccttaacgtcaaatctagtattttaaaaaatatttatccaagaaggagattttaaaaaatatatacatgtgtctgctcatcggtgcaaaaaaatacaggaaagataagccaaaacgtactgaaattgctaacctacaggacgttgagtgagaaaaggatataaagaagaatgtatagcttttttagaaccacagtaatgtttcccatacaaaaataaaaattaacaatgcggggtggggaaaacagggaaggctagaattgaatactgtagtaacaaatgaacctaactgtattacaaaacaacataaccatactgaaagatttggtggaaggaaataactaacctacgtaacttcagaaaactgtattttgactgcataacagttaacatactgtacaaaaatattgtactctagttagcaaatgtgtttttcacaggggtactagatgacaactgtgagactatacgggtactaggattaaacgagtatcaataaggaagggggaaggctgctgtgttgaactggtatgaacttacggttttttatatatatatacaggttaagtagatacagaaatatagatgtgtgtgtatgcacctgtgagcatagatacatatgtttccttgctttgccttttgagacatcctagaagcagtgacacttacgaagtaacaatgagcacaactagtactcagattttagttcctaataaaaggaacctgagctgaagtaggcaaaatacaagaggaacctggaacatctagtattagaaagtatttcaaaatataagcggtacatgctaaaaggacacaggagccaatctgaaagagcgcccaatacccaaagttgagataactggagcaactgtataaacagtaataggttataatccattaaataaaataaatatccatgggaccatcctgatattcacaactgagtcaatgaatgagtaaataaatgaggggggaagacacctcttcctaacagaattccatttaatgcaggtaggaagtagaacaaccaccctttagtaaacaacacagcaataattgctgtaggaaaaagtcatcagtgaacaataaaattatgagtaaaaatataatgagcaacagaatatttacatagtgtctccctataagacagtcatttattccagccagggcaaaatggcaaaaccttgtcactacaaaaaacataaaaatgtgccaggcatggtggcacatgcctgtgatcccagctacttgggaggctgagagatgggaggatagctgagccagggaggtgaaggctggagtggtgattgcgacactgcactccagcctgggtgacaaagtgagaccctatctctaaataaataaataaataaataaataaataaataaataaatattgtcagttattacaaagggaaaaatgctaattttacagaggagaaagctgtcaggcaccaccttaaccaagggaacaaacctatcatcactattagaaagacaagtcaaaatcatgaaccccctgtggtgtagagaagggtacagtatcttctgtggcattcctgtaaaacaatgcgtaacctctaataatgagaaaacaccaatttgtggaacgctatacaaaataactgaccagaaatcttgtatccaagtaatgaaatacaaaaactgagaactctcacatattgaaggacatttagagatgcaaaaactaaaagcaatgatagattctggacaacagaaaggacattaataagaaaactaataatacagaaattcaaataaagtatgtctattactttgtataagttcaatgttaatttcaatgttaatttcgtggttctgataattaacgattattgtgacaagatgtgttaagattagagaaagctccgtacggagactctgtactactatttcaacacacacacactctctctttctttctgacacaatctcgctgttgaccaggctggaatgcagtggcacaatcttggctcattgcaacctctgcctcctgggttcaagtgattcttgtgcctcagcctcccgagtagctgggattacaggcgcacaccaccacacctggctaatttttgtatttttagtagagacggggtttcaccatgttggccaggctggtctcaaatttctgtcctcaggtgatctgcccacctctgcctcccaaagtgctgggattttaggtcaccgtgcccagcctaaaatcatattttaaaagaatgaagaaaaaatgtatctagcattaataaaacaaacttcattcatacataaatctgtacagtctacaggttcctatcagttacagtactcacttaagataaatatagaatccattctgaattggccaaaatatccaacactccatcacagaaaagtatttgcagttacctgataatgccaggctctttcaagcctatgctgcattacacattactccctacaccatgcttcagcaagtccataagactcagaaaaaagtccatccttccctaggaaactacctttactgactccctccagcactcccattttatgcttgttggaagaacaagaagcactcaagaaaagatagatacctggttctacttagtctttcagacacaaagtgcagtctggaacaatgacaattagcttttactaactttcattatctatcaaacattgttaaaagcaaattataaattttaaattaactttgtaagaaggctagaaatcaggtagtaggaggagagtgtgactcctccaatttggttcttgtttttaaaaattgttttggctactggccaggtgcagtggctcacgcctgtaatcccagcactttgggaggccgaggcaggcggatcacttgaggtcaggagttcaagactagcctggccaacatggtgaaacccccgtctccactaaaaatacaaaaactagctgggtgtggtggcacacgcctgtaatcccagctactcgggaggctgaggcagaagaatcacttgaacccaggaggtggaggttgcagtgagcccagatcacaccacagaactccagcccgagtgacagggagagacttcatctcaaaaaaaaaaaaaaaaaaaattgttttggctcttgaaaatacttaacatttccatacatacttgaaaatcaatgttcaattgttaccaaaaacaacacaacataaaccaaaaaatcttgctgggatttttcactgggtttgcattgaatcattgtgtctaacattgactcttctaacacataaatacagcatacatctccgttcacttatgtaatctttttcagaagttttatggtttcagcaataaagtcattaacgtcttttgttagatttattcctaagtattttatgtttcttgatactaccgcaaatggaactgtttctccgggttatttttcagttgtttgctctaataaataaaaatagaattgacttttatatattgaccccgtacctggagaccttggctaaatctctaattctcacaggtttagggaattccatggggtttctaagtatcatatcttcaaatacaagcagttttgccctaccttttccaatttccatgcctttaattgcttttttcttgcaatattgcattagccaagacagagtacaatgtttttgtttgtttgaggcagggtctcaccccgtcgcccaggctcaagtacagtagcatgatctcagctcagtgcaacctccaccacctgggctcaagcaattctcccacctcagcttccagagtagtgaggactacaggtgcacgcccccacaccaggctcatttttgtatttttttgtagagatggggtttcgtcaggttgctggagctggtcttgaactctgaggctcaagcgacccgcccaccttggcctcccagagtgctgggattacaggcatgagccactgtgcccagcttacaatatttttaggatatatttttttcctaattgtagaccaacaaaacaagcactttcaccaagtagtgtgatgttaggcgttaggtttttttcctaatttttaaacagcatcacagctcaggaataaggtcttcacctttgattttcacgatttttactacaatgttgtgattctcatggttattattcttgaagtttcatgatttttttattttatttttgagacggagtctcactctgttgcccaggctgcagtgcagtgccatgatctcggctcactgcaacctctgtctcctgagttcaagcgattctcctgcttcagcctcccgagtagctgggattacaggtgtctgccaccacgcttggataatttttgtatttttagtagagatagggtttcaccatgttggccagactggtctcaaacttctgacctcaggtgatccacccacctcggcctcccaaagtactgggattacaggcatgagccaccgtgctcggcctaaagtttcatacatttgtaaactgactgtttaaattcaaaaatccagtcattaagttcctcaatttttttccatctttttttttctttttcctcatgactaagaatcatattctcatgtttattcatatgtatggtaattttctattatatacagacaatgtatgcaatacattatagagactctgaatttagttagcttttcctaaagagtgttgatttttgttctagcaggcatactactactacctggttaccttcattttgtggagctagttttgtttttataaaagcatagtggagtctattttggttccctccttaatcctatggtgaatgccttcgtcctgggaaacattctttaactctttaagtgtgagcctttattggtttcaatcaaagccctcaggtttttgccaagtctagttggaattcgaactccaaattctgccttccctgcattaggcaatgatgatcttctctgctcagctctttcagccttccaattactgctttccactatgccctataaaatcttccctaaacatgtgcaggtcaggggtgagcacaaagatctgaaaggggctcaaatagattgtgggcctatgcccctccccatctcccatagctccctctttgccactattcccctccttcaatttctacctaacttggcagccctgaactccatcctctgataatatacaaacaagcccatgaagcagtgactattgaattctagaagctctggggcacatggactgagaatgctctcatctcttcctggcaatactttctgtctgaaattttgctgacattgttgagtaatttacctagtaatatgcacaggttccaagcttgcccttctttgctcattactttttcttaagcaggggaaagcaagcttctatttgaagagagagaatgagaaggtggggaagataagaggcatgtttcaatacactagagaacaactctcaaccgctttttacatgctctctttccaagggcacaccctctttgttcaaaaggagtcttaaatttcacagaagcatttatctgtacacacgacttatcggcagctaccaagctagaggcccgttaagttttctctccctcagctagccttacacctttaaaactgcctttgagtcagaagtcagaatgaagaggttaaaataaaaaaagaggcatttttctaggcattcctccttaggtcttccctttctctaacccactactctgtggtataaaaacagtacccacttccctaacccagaaaatattccttgatttgctccatgactcaaaaaaggttcacccatgaattcagtctccagttcttttgctcataggttgggtccttttagaacaacttagttcaataatatctgtactgtattcaagacccaagcagatatatactggttctgtcaataaacaatcatcctgtttggaaataaagcaaaaagactatgtatccttgcagtgtaccactgggacattacctaacaagcccacccaggaaacatctgactctccataaattatttaactttgttttacctactatctataattgattagggcccagaagtcttactggatgtttattttagaacgctgacaagttaaagttggtttgcatcttgttgaaaacaatgtccaaagttacagctttattgttctataggatattaataacttttgtatgctactgagtaatcatattcctgcattcttcctttttatctggtattaaaatactgttaacagtttggccaccatcatgattcccttgttattcagtaaatcactatatatttaggaattatgtctaggctggtgcagtggttcacacctgtaatcccagcagttttggaggccaaggccagcggattgcttgtgctgaggagtttgagaccagcctgggcaacttggtaaaaccccatctctacaaacaatacaaaaattagccagacatggtggcacatgcctgtagtcccagctacttgggaagctgaggtgggaggatcacttgaacctgagaggtagaggctgcagtgagccaaggtcgcaccactgcactccagcctgggtgacagaataagaccctgtctaaaaagatggaaagaaagagagaaaaagaagagagaggggagagagagacagagagagagagaaagaaaaagaaaagaattatatctaatgttttgaaactatattttgacaattctaaagacgctgatttttttgttaattccagctgagtttcagaaatgagaataaaaaaattaaacataacagaaaatacctctgacattattatttttaaactacaagtcttcaaatatatttttgggtaataaacaagcacagtccaggagtttgaggctgaagtgagctatgattgtgcgattacactccagcctgggtgacagagcaagagcctgtcttaaaaaaaaaaaaaaaaaaaaaaaaggaataaatacacctacctccatttggggaaaaaattaacaaaatggaaaacaggctggttacatgtgggtatgaaaacctacagttgccctctgtcccgggcaacctaatttttttttttaagcaaaactgagaaaagtcactttcctaaaatttaaaacaaaacaaaacaaaaaaacctggggaacaaacaagcaaagttaaatactgccttcttatacagaaaaactttgcctggcaattgacatacgcacagctttgcaaatatttggcattttaaaaatttaagtcaatagcttttaagaaacatatgctctgcgcccattctactaataataaacaatggaaatgtattgtccctgctccccccaccccaccccccaacccctgtcttctcttaatactttctgaacgcttttcagaaagcatggatatattcataaagggtagataattcacgaaaacagggaaggggtaatctctccttgacaaaatagtgacagtgtatacttagttgttttcattatttattttactcaatccaaaaagcattctattgcacaatgttgaaactagtatggccaacacaaagggaaagatggtcttgaccttcaagaatcttacaatttaatacacacacaggaatcttacaatttaacacacaagtaaatgaatgaagggtagggaaaggaccaagctcctaaagagtgtgtgtgtacaagtgaatctgtataaactgtctcacaatcactgtggattttttaagacaatgaggattagtaacacaatggaggactgttatgccctgtccttcagaagtgctgaggtaagagaaaacatgactacagggagattactcaaaaaagtttggaatccctaaattctatatacaaatatataagtatctacatagaacttactcccctatcacatatgcctcatgtttcatgtttcctgtacccataccaccaatgtatctatgtttcctttctcacttaacaatttttaccctgattagaccattcactaaaagtttcattaataacttaaaaaagatctgtaaacagcatgcaatgaacttatattatagacttaaatagtggcaaaacttggcattctgctctttaatttattcaaaactactttccagttaagaactatcaatcttctagtgtcttcacatttatctctagcaacagtggctggctttcaaaattaggtgagagatctttccaagatctaaacatctccaatatctgcctcagagaaaatttagtttccaccacatcatgcgttcctgctaacaatgattaaaataaataaaagaactataaggttggtttatttgcggatacaagaacagcttgcttaactcaccatttaaaaagccatcacttcacactagctttattatctgaagcataatcaaaataataaactacggttgtgggactttggaatttctaattaagttatggagacttaaatcaagaaatatgaatattcataaaacccagtaaccttttaggcaaagtaaaaaagtgaaaagaacaagtgctcttggaattcagaaagaaaattaactatggtattgagagaaaccaggaaagagaaggaatcacagtagagctaggatacagaaggaaacagaaaatgacagtttaatgctcattatagaataacagtgaatcacccacagagaccattttcagtgttcttgtgaatttaacctctagtctaaccttttaatgaaaaggctataatatattagagtggcccagaaaggtgaccttatgtctcaggtgtcagagccacacccaggtctcctgattcccaatgatactccctaaagccttacttgctctggctgtagtgttttgagaattggagctgcttttaatcctatggtcagctacacagctgcaggatgggccctagattccctattcaggaattcagatcttaaaacaccaaaagtgataaaagtagatacagttccccttcttcagccaatgcaaggatcctagttacagagaaaaaacggtgtgccaagacaacacccttaattctcacgcatttccccctttctatcttttatacttaccaatttatcagtcccatgatctgtcttcacctcagaactaagtggaagaaataagtctgttgtatgctctgggggaggtacctccccaagaactatcaacccctgcaggatagagaggagaaaaatagcataagtgagcagtataaacttcaaatttaatttaggagttaagtctcaaaaggactgttggtgtactagaggccccctcttcctcaccctatggttcagaaacaaactacagcagcagcagctttgttttcccaaagagctatttcaacaagcagcagacccaggctcccctctctgccacttgactgctctgacctacatggctcatcagccatttagcatctttattcatatctttcagatatgaaatctttaccagattatggcatttataccatattactagactccactagattaacagcagcaatgcagtttttgtagccaacaaatgcagtttatgacttactaagctgaaaatgctactattcttaatcatgtactccaccaactatacctgcacaaacaaaactgaatgaaacaaatgtggaacagtcccctacaatttatgagaaaccaagagcttcttaaaagctggcccaaaggaacctgcttttttcataagcataaatattacttcagattaagttcctgcttgacaatttcaaattcagacctttggaaattcattccaggaaacaatttacataaaaagaaattaaaaatgaacccacaagtcctccccattgtacatataatgagccaggatgggtaaaggcagaaggtatcttattattaaaaaaacaaaatactacatatgaatcccaccatgtataccagaagaggtgacaaaaataaggctatgacactatataaccgaaagactgggatgcaagtgatcagggttcccaatctctttctctggtctaaaaaatagagatctaactagattaagaagctcttaatggaaatttattatcagaatcacctggggaaccttatcaaactatactggcttaggtccaacatctactcagtacctctgggggtggggccaggtagtctacctttttatgggggaagggaggcaggacatggtgggtacatggaggtgggtgtctctctcctcccccaccccgccaaccccactatgttaccgaggctgatctcaaactcctgggctccagcaatcctcccacctcagcctctggagtagctgggatgacaggtgcctaccaccatgcccagaggtggatattctactattctttaaaagctcccctggtaagtcctaaacttgtaaagttgaaaaacactagacttgattagtttgggctcaaagaacatcctaaagtatagatttgggggactagggattgtgactattagtcttagctctctaggccatacgacagactcttatgagccactaaaccagatgatccatccctggggtccttgtaactaaaaaaccaatatgaaatacaagctgcagaaaaggggaaaacattaagaaagaaaaatggaattttatttcagtttttaaaaaagaagtatgtatctctttttctcttgaagcaaaagaagcactgcctccctattctggaatatgactacacttagcctgtatcaaaaatgaattggagggtcccggaatggcggctcacacctgtaatcccagcactttgggaagctgaggcgggtggatcacctgaggtcgtcaggagttcaagatcagcctggccaacatggtgaaaccccatctctactaaaaatacaaaaattgcccaggcgtcgtggcacatgcccatagtcccagctactcggaaggctgaagaaggagaatcgcttgaactcaggaggcagaggttgcaatgagccaagatcacaccattgcacaccagcctgggcgacagaccaaggctctatctccaacaacaacaacaacaacaacaaaaatgaattggaggctgggtgtggtagatcacacctgtaatcctagcacttggggaggttgaggttaggagtgcgagaccagcctggccgacacagtgaaacaacgtctccagtaaaaatacaaaaaatagctgggcgtggtggtgagcccctgtaatcccagctacttgggaggctgaggcaggagaatcgcttgaacctgggaggtgtaggttgcagtgagccaagactgtgccattgcactccagtctgggcaacgagagcgaaactccacctcaaaattttaaaaattaaaaaaaaaaaaaaaaaaaaaaaaaagaattggagtctcctcagaaacaagagaaaggccattaactagtaagcaagaaacattaaccctagcctttaaaatgaggtttctctggttaaagaacttctgcttcaaaatattttcttccctaaatcaaaagcataaaatataccttacaaactttatcacatccaaataaaaactatttgcaaaagacagttatcttgtacaccactgccttctcaaaacgttgtattcaacagatattccctacttaagggcccaaactgtcttcctgcttcctgtacaaagcatgccaaaaatcattttattattcaaattttcccataaccggttcctaagaacttttttaaagatcaatttccaactactttccccaaatatttgttagtgttataccaatctcatcatctcctagacaaatgtttcaatgaatgtgaagctgttgctgctgctggaggtaagggttattagtcagtagaaggttaaaaaaaactgaattaaaggttaacacatgagctgttcatctttatttatactcatttttatattttatcagtccaaattgccgttcgtccttccaaagagattttcaacaagtcccacctccttccaagaaaatgtcccgggttaatgagttcctacttgctttatccacactgccagacctcctaaagcacggtgattgtatcttactttctgtgtatttaaatctcatttccagagcattcataatcttatgccacattatttatttcacttattattgcctcagtttcttgtttgttgagacagggtcaagctctgtcacctgtgctggagtgcagtggtgtggtcacgaatcactgtaacctccccctcccgggctcaagtgatcctcccacctcaaccccataaatagctgggataacaggtgcatgccaccacatccagctaatttttgtatttttttggtagagatggggtttcaccaagttgctcaggctggtctcgaactcttggactcaagtaatgcacttgcctcaaactcccaaagtgctgggataacaggtgcaagccaccacacccagctaattgttctattttttggtagagatggactttcaccatgttgccaaggctcgtctcaaactcctagactcaagcaatccacctgcctcggcctctcaaagtgctgggattacatgtgcaagccgctgcacccagcctttaattgttaactaatgttagtttattgaagatgtggacaaaatacaaatatatttaaatgacccatgtcccttagcagagtcatacaccaagaaaataaatgcatagcaaatatttgttgagttgtataatttttttcctaacaggaaaatattaactttataataattatagccagaagataaataaatctaacaattagatataaaattactccttcaatttttctttttcagttatatgaaagtaaggacgcagtcagtattttccaaagggaagaatttttccttaaactacagaataatttctaaatacaaccctcagatagattatgaagacatctcctaagagagtataataaaacttggtagggaccatctattcatcgacataattttatagacccacagaggatgtaggtcaaagcttatgtctctacaggccaatacatggcagaactggggcaaaagtctgcatctaactaatatttcattcctcttttgttcagttaattcaatcatttatccgctcatcagcatttgttaggtactaaggatacaagaaaaaatgagagacctatccctctcccctaacccatccttcaaagtgcttattacgttctaatactgcggcaaagaaaaacaatgtaaataggtaaatgttatgtactacattagaaggtattaaatgctagagagaacaaaatataggatagtgaggggattaagaagtggaaatggtggggttggtcgtgacggctcatgcctgtaattccagcactttgggaagccaatggaggaggactgcttgaggccaggagttcaggaccagcctgggcgacgtggcaaaaccctgtctccacaaaaacaataataataaaaattagcctggtgtaatatcacacctgtagttccagatattcaggaggatcacttaagcccaggagagagagagagatacaagtgggagggggtactacaggcgcataccaccacgcctggctagttttttgtatttttagtagagaaggggtttcaccatgttgccaaggctggttgcaaactcttggggccaagagatctacccgccctggcctcccaaagtgccgggttgcaggcatgagccactgtgcccctgcttgaatgtttatttgaagacagaatcaaccagctatgccaatgtgcttacaagataggagggaaaagagtcagagacactgccaaggtttctagcttccacaaccagaagaatggaactcttcttcatttgttcagaggacatttgaatacacattagttttaattaaacctatttttgaaaatatgtgctcaagtgttacactgaagcaaccaacaatcatccatacactgtccattgcccccaagatatgtaagttcactatggcattcaaaaccaaacactggatcctctaatttaatactgtacctcacaccaaaaaggatgaaaacagctaaaaagaggctgagcaaataaaaagcatccaagtaggtaagagtcattcatgcaggtagcatctattgagtggctaccacgtgcaaggtagtgtgaaaacacagtaataaaataaaaacagattctaccataaggagcttatgttcatctagccttgaacagacaaagagacaaagtattatgacagtactataacagaagttgagagaaggtgatgtcagagcagaaaagagcctaactgaagagactgatgaaagtgaggctttacagaggaggtctacataattacttaacattccccaaaatatatttaatatattttgagctatacttattcattaactatacacttaatgactttgcccttttctgtatacaatgtttcatatgccacaataacacttatttcggataaagtttactcatgtttaataaccatgaaaagaaaggttagcattagctgagaaaacttcataatgttctactccacacctgtcatgctaccccaacatgggcttccctaacattccaggtttaaactgggtcagtgttgaatagctgtgccattagcctggtggcaataaacttagggctgctgtactatgaaatagcaaccggtagaagccgaagaaaaaggtcaagagtctccttttccttcgccatgtcccgagtcagagccaggatcatgcttaggctgcacaggcctagaaaactccaagagtgaagcaagcttctgctttacacaaggaccaaaggaactggaatgggtcacagttacatgcagccttaatacctcctaagtgactcctctgtggatgaaccctctctcaactgtatttgcaatacagctaacaggcaatttcacatacttccttacatcactctatcaggtcaatcttccctatgcatctcaagacaaaccagtgaccccactgcagaccagttccacaagaatcaccctgggctacctggaaaagataagttgtctaaagtgctttaaaaaaccctattaagatgagaacttcaacagctttatgaaaattttgaagagaaaggtgttataagcttctgcagttcccattcaactccttccctattcaaaagtttcaatgctcttccacctcccatcctcaataacatttccatcctcagctacagctgtgtaatctcaaagagtagtcagaagaggagattttaaaaaacaacgtaagagtcaagccagtgcttctgggaggccaaggcaaggaggatcacttgaggtcaagagtttgagaccagcctggacaacacagcgagaccccatcctttaaaataaaaaaaaccctttaacaattagctaagcatggtgggacttgcctatggtcccagctacttgtacttgcaaggctaaggtaggaggatagcttgagcccaggagtttcaggttacaaagaactatgatctggccattgcacctcagcctgggcaacagagcaagaccctgcctcttaaaaactgcttagtccctattctttcccctcatttaccaggtgtgaaatttcaacaaacatgtttcagtgaaatgatgaaaaggacacaacagcaaagtatgttagaaaaaaaatgctttggaatcagataaaaagtcctgagtttaaatttagctctgccttttacaagcctctgaagatttattctgatcattaaacgaacatacatgagtaaacctttaattagtatacactcaaggtacgtatattgttttcgtttctccttctaaagcatggaagagtttctttttaaaaaacaagctgacaaactatgaaaattaaaagagtacaacagcatgcagaagtagtacagaggagttcctagaagttatattctttctccagagagcaatattattcccaaaagggactctactcacttcacagcttggaaggtaatacctaccttctgacagaacagaaactggtgtctggatcctagaatcacctagcagtagtcacaaatactttttttttttttggtaatacgccacttaaataaaattaatgttaataagcaacaaagtaaatccttaaaaagaaaagccccaccatccctccaatctcccacccgaagacaaattataactcaacagcctatcaccaagattcagcctatcacctaggttcatctcaaaaaaaaaaaaaagacctgtgcaacccaggaagtgctgggaaatcttggtgcagcatggaaaatatgaacaccaacccacttaaccaaaacacataggaaaaactttcttccatttcagtaactaaaaaaaaaacccaagcacttaaagtgattactaacttgagcaatagctctgcactcacttggatgtgtaaccatgaacaaactacttgactgctctgatcttccattgtttatcttgaaaatcgtgaatgagagtaaaatgcttagcacagtgcctgacatatcacaagtgctcaaaaacttctattaattatagtgttacataaagactaaatgcatgtgaatatatcattgggggaaaattccatggcttgttagagcaagttgaatattgtctcttccaaatttatgttcacccagaacctgtgactatgaccttgtttagaaaaagggtctttgcagatgtaatcaagttatgaagagccatttagtgtgggctctaaattcaatatgactggtgtcctcctgacatggaaatctacacagatgcaaagagaaagatggtcatatgaagatggaggcagcaactgcagtgatgtagctacaggccaagaacaccaaggactagcacaatatcagaagctggaaaaagacaaggaaggattcttccctagagcctccatagagaccatggcccttttgacaccataatttcagacttctggcctccagaacggtgagagaacacatttctgattttttaagccatcccatttgtgatagtttgttatgacagtctaggaaactaatccatttgttgaaaaagaaatgtataaatacgacacgtaaagctgtgaattttcttgatgcattacttattggaactatcaacctagttttattcttcctatcggaactctgagaagtaaaagattatctatgatgttgtattttacagaccaagaatctgaagctcagaaatgttaagtgacttttcttctcaaggttcatgtaagcagctggtagcaaagccacgattagaaacaaaaatttaccaagtccaagtatggtgcttaatacaatacgctttgaatgatgaaactcttggataagcaacatacattcatgtgccaaatagcattatggtcaatgacagaccacatatacaatgatggtcttataagattttaatacagctgaagaatacctgttttagcacaaagcactactcctgtgtttgtggtgatgctggtgtaaagaaacctacagtgctgctattagaagtataccacatacaattatgtacactaagaatataatagctgataataaaagctatgttactgttacacttatttcttatgataataaaaagtgttatgtatttactatactatacttttaatcgttattttagagagtacttctactcattaaaagaagtgaactgtgaaacagcctccagcaggtccttctgttggcactgtcacaggcaatgaaagctccgtgtgtgttgttggccctgaaaacctaacagtgtaacaagatgtgaaggtggaagacagtaataccgacaaacctgaccccatgtgggcctacgttcatgtgtgtgtttgtgtcttagtttttagcaaaacagtttaaaaaataaaactttcattttaaaatggaaagttttaaagatagaaaaaagcttgtagaataaggtgtgaagaaaatatttttgtacaattacaatgtatttgtgttttaggctaagtgttattacaaaagagtcaaaaagttttaaaaacttaaaagtttataaagcaaaaagttatagtaagctaaggttaatttattattgaaaaaaatatttaaaataaatgtagtgtagcctcggtgtacagtatttataaagtttatagtagtgtacagtcatgtcccaggcttttcaatttcagttacccttcacccaccgactcacccagagcaacttccagtcctgcaagctccattcatggtaagtgccctatacaggtgtaccatttttatcttttctactacatttttactgtattttttctatgtttaggtatgtttaaatacataaatctttaccactaattgcctacagtattcagtatagtagcatgatgtactggtttataccctaggagcaataggctatataccatattgtctaagtgaatagcaggccataccacctcagcttgtatgtattaagtatgtatatatgtaagtatgtatgtatgtatgtatatgagacagagactcgctctgctttgcccaggctggagtgcagtgtcgcgatctcagctcactgcaccctgtctcccaggttcaagtgattctcctgtctcagcctcccgagtagctgggattacaggcacccgccaccacacctggctaatttttttgtatttttcatagagacaggggtttcaccatgttggccaggctagtctcgaactcctcacctcaggtgacccacccaccttggactcccatgcctcggcctcccaaagtgctgagattacaggcgtgagccactgcgcacggccctcagcttgaatttaagtgcactttatgatgttcacgcaccaatgaaatcacctaacaacacatttctcagtttcccttttgttaagcaatgtgtgatggtatatacaaaactccagattattttccagatatttagaaatacttttcagatattttgatattttgaaagtttctgaaaattgctctgtcattacttctgagtgatgagctgaagaataaagcatgaaccaaatgaggtgagtatcttcttatacacagctagtgagactataaactgacactgccaaaatacttctctgaagaatgcattaagaacataaaagagcattcatacctttgactgagataaagatatttatcatggcatatttaatttaaataacaaatgtaacttaaatagtcaacaaagaaagccaatagcatgcagccattaaaaatgttttccaaaaaccaactgggaaatattcagggcacatacgtaacatgactgtatttgaacaaattacttatgtgctaggaaaatgtaccataatgttggtagcgagataattttgagctgttgggttgttttttttttttttggggggggggggagggtgggtgtcttttatacttctatgtcatttcagtttcctgagaattgatacacagtatttcatcaattctaagaggtactctccccacatgtcaacaacttttaaatcaagatgcattttacaatttctgttatgccctggtttaactgaaataatttctttgtcgtacttaaaacaatggtacatcttacaatcaatagcatcttaagttctatgaaatgtagcagttttataacaaggaactaagatgatataacatatacacatatataaacccacatatatatttatgaatgtatataaaaagatgaagcagcacttatgactactattatactaatctcagttgttactaagagactctagttctcaaatatagaaaatcccacttaactactggctataaaaacctagaaacagacactgaagaggtgtctctgatagagaaagactgtgtttttctcctcagtacaggcatatccagtcacctcctagttattcttagtcatcattccagttcaagttctacaaatctcactttaaaatttcctttgtgaagacttgggaaagcaaaatatgcaccaaatctagaatgtttattagttttgttccagctaatttttaaataagtaaatcaggatttaatttgtatgctaccctaagggaacaaactagtaagaataaaaaagtgagccctctggactgtgtcctcaattaaagtatgctctattgaacttttagggggagggggaatatatatatatatatgtatctccaatctggaaagaagctataagtccgcagtgacatttttagaataaaagtttaaatgattagatagcccacagaactttcacttcaaaccctgatcattctgttcattttatcagttgatcaaccttcaacttttggcctactaatttaatggatactgttcacaggaaagccattttcttaaggctttgactagtactaaggtcaaaaaggcattttgacccttatttttagtagcaatagactttttctagacatgggtctacataaagatagagctcagccacaccaagctaatataaaaaatactttgcaagaatgtaagcttcatgaaggtaggatttttgagaacactgctgagacacagtaagcacttaaaataatggtacatcttaccatcagtagcatcttaagttctatgaaatgtggcagttttataacagggaactaacaaatataaatctaacaaatatgacagttaacatcaatggcttgcttgcattattcagtctgttttccttgtttcctgttagctcagatacccacacagttttgttctaaatacacgttcagttaaacattatattctaatagtgttttcctttttatgagacaggcctttcttagttgtccaggctggagtgtggtggcacaatcttggctcactgcaacctccacttcgtgggctcaagcgatactcccacttcagcctcctaagtagctgggactacaggcacatgctatcatgctcaactaatttttgtaatttttgtaaagacaaggtctcactatgttgcccaggctggtctcgaactcctgagctcaaatgatcctcctgccttggcctcccaaagtgctgggatcacaagagtgagccaccacgcgcagccacatcaggttcttaaattaaaccactatatcaggtcattaaaccatttactttgcaatagttaagaagagggttatgggggttacgaggtgggaggggatgtgagaaaagcgatattgatagttttcggcagcatttaaaaacatcagatacttatcccttaccttattagcacgtatctgtttgtaaatgtctgtttgctgacgaattcgatattccaagtcagaaacatgagcctgaagccagttccagcggctgacaatagctgcccggtctgcagcccatttccattctgacctgcgtctcctaaaaggaaataaactgagtgaaatccaagagtagcagtaatatctataccagattggggggtggggagtggaatttaacttttaaaggcccttgcagagactaactctagtgtcaagaaaaacccaagagagagacaagacacctcccgctcatcaggatgcacatggatataaacttccaaataggtatttcccaaattaagtggaactgcgttctagcatcctgatcctgtggcacacagtttctctgaaatccctttaatttctctgggacaataaaattattgtccatgccaaaataaaacatacattaagaataatctatacaggaaatccaactgacactaagaattattaaaactaataaagaattcagcaaaagtgttcagtaaagaatatttaaaaactaataaagtagaaaatatcattaagtaccattcataacaccaacaaaactaatgatatattaaatatctttacagagaaaataacgcctgaaagcatgaagatctatacaaatggtaggacacatttttttaggatggcgattctcatgaacatctataaattcaaagaaattccaatcaaattgcctacagtatttttaataaaagctgagaaacagatctaaaagttcacatggaataaaggaccaacagcaagaaatttgcaagaaggcatgatgcaaatacacattaccagacagccagatttgctgcaaaactatagagagcctcaaaacgtagaactagatacataaaagataacgggaaatttttaaaaaatcagatcagtgcagaaacgatcaaactactcaataaatagtactaaactggccagttctttaaaggaaaaagtaaaattagttcccttcttcatgatataattacaaaattttggcatttcaaattgctaaatatgaacagccaaacttaaaagaatatcttcgggacttagagcagggagcatttcttagataatacacaaagatttcacctacttttcaacatacaatagaaaatctaataaagttaaaaggccaactacattttggtggaagatatctaacacatataactgacgattaaacatcagaatatgtaacagaactctcagaaataggataaaagaaaaaaagacaatcttaacagaaataggaaattcacataaaaggcaaataataaatatataaaaatgtgtcatctcgttaaaatttggttaaaatataaatattaggtaaaacattaagatgctgtttgaaatctggatgggaaaacgcacagtctcataaagccaacaggtggtgagaaatggaaaagagcaattaatatattgctggtaacagttaaaattggaaccaccatttttgaaaaataatttgaaaatacttagcgaggtgtaaaatgtgcatacccaaccatcatgatactgtattttttttttttttttcctgagaggcagggtctcacactctatcattgaggctggattgtggtggtgcaatcacagctcactgtaacctagagttcctttgcttaagctatcctcccacctcagtctcccaagcagctaggatcaggagcatactacatacctggcttttttttctttttttttttttttttgagatggagtttctttcactctggttgcccaggctggagtgcaatggcgcaatcttggctcaccaccaaccttcgcctcccaggttcaagcgattctcctgcctcagcctcccgagcagctgggattacaggcatgcgccaccatgcccggctaattttgtatttttagtagacacggggtttctccatgttggtcaggctggtctcaaactcccaacctcaggggatccgcccacctcgacctcccaaagtgctgggattacaggcacgagccactgcacccagccctgactaacttttttttgagacggagtcttgctctgtcgcccgggctggagtccagtggcatgatctcggctcactgcaagctccgcctcccgggtttacgccattctcctgcctcagcctccggagtaactgggactacaggcgcccaccaccacgcctggctaatttttgtatttttagtagagacggggtttcactgtgttagccaggatggtctcgatctcctgacctcatgatccacccacctcagcctcccaaagtgctgggattacaggcgtgagccactgagcctagccccactggctaatttttaataaaaaatgttgtggagatggggtcttgctatggtgtccaggttgttctctaactcctgacctttagcctcccaaagacacgagccactatgcccagccatgaaattctgtttctgagaacataaactacacattcctctgcataaggaaacaggttcactggaggagagtctgtaatagataaaaactaattatattctaattctgctgaacttggtaaataaactataatttattcatttaatagttctatagtaataaaaataaacgacatctgtatgtatcaacatgattaaatctaagaacacaatgttgaatgaaacaactacaaaaaaactaaacaagattaagtacacacaagtagtgaaggaatttgatgaaatactatctagcaatttatttactgtatgtatcaacatgacctaatctcaacaatggggaatgcaaaagctgcacaaaaataaacaaataaacattaataaggattgttaccaatacagataactgatgaatatattttaaaatgcctaaaactgacatacaacaaatttacaatcaagctcctcattatctctggaaaggggatggagaagttggattttagctctacctataatgtttgacttctcatgtaaaaaaacaaagatggaaatgtgacaacattaacattgtttaaatattacactggggatacatggtgtctactatattctgtaatctaaatatttcataatctaccacaaaactattttcccagaaagcagcagcagtcacacagccctcagccccacttcccatcaggatacacacactcactgctaaaacttatgactataggtgaacttgaacacagtctcccataggggcaaaatacaaaatgtcaaaaataaaaaagaacaaatctgaccacgacagagtaagacatgaattaatacttaatcataccataataattaagaccaagggtagtaatggtattttaacttttgtatggaccaaacataaaccattcaaaccaaccactgtgataattatcaattatgtctcttcttttagaaagaaaacattttacagttccctaattttgatggaaccacttcaagataaaaagatacttttaaagtacagttatctgcttcaatgttggctgcaggtctagctctaccctaaatccaggaaatgatctcaagagatcaataagaaactagggatcattcttgaacaacaaaaatgccccctacccacaaagagacaaaactagttaaccctcgtattttattcccacctttccttacttttcaaggcttaccacctttctatcctgcaaaatcttttggatttatagattcctttcattcctaaaactaccaccacaccaggtccccatctatcaccactgggcaaccccaacagcctccttagctgctcttcccaacaccagtcaatcatactacttttcctcaatcaactcccctcacacctttttcatcctggcattctaatgtttaaggaaccatgcagctcctttgaaaatacaaaaggaaaagaaaattacttaaaacattttagttcgcaagaactttgataaatacactttttcttggatattaatgaaggtcttatgtcccctacacaggtatttacctaaataacaatacaaagcgagcctcctgataatatgttttggataatatggttaataaactaattaaagaaaggcaagacagcactaaggaatactaacaattcccaatttatgaacaagtttcattttacaagtgtatctgtgatgtgatggtttagaactcgaagtgatttccaggagaaagttgttacaacattattcttccataatgctgctcaaactctcatcatctccaatgaaaaatggaaaaccacaactcaagcgtccaagaagtatcttgtgttcaaaataccagcaatatgagcagaaagctaaactgttattaagcatgagaggtgtacagttaacaagtctggataagatatgaagatgttaccatactccagtggcagagcagagcaccactaaacagtaacacaagaataagagcttcacatcttttgttccttaacaaatacaagcggccgggcgcggtggctcacgcttgtaatcccagcactttgggaggccgaggcaggcggatcacgaggtcaggagatcgagaccatcctggctaacacggtgaaaccccgtctctactaaaaatacaaaaaaattagccgggcgtgatggcgggcgcctgtagtcccagctactcgggaggctgaggcaggagaatggcgtgaacccggaaggcggagcttgcagtgagccgagattgcgccactgcactctcgcctgggccacagagcgagactccgtctcaaaaaaaaaaaaaacaaaacaaaaaaaaaacaaatacaagctatataaactcagcttatcagaggtaaagatagacttcctcctcaatattcgaagtgtaaatttatcactctgacaatttacagctcaaaacaagggacacacattgaacattagggacatgtttaatgttataccatacagacttcaggaaagaacacaggactaaggttgcagaataatactttaaatacaatgaggacttggtttctaatatagtcattatcaataatgaagaaaatcacgtggattctaacactgatgagtcaactcattcctgatgcttgtttctgtgctattagtgaaataactgttttaactatgtgcctgagtaggacactagaatgccttagaacgtttgattttaccgtgtgctttatcctagtccatacaaaaacatgtactatatatactgtagttatcacctgagtgggaattcttttcaactcgtattttgctcattgcttttataaactttttattggtaaaaatggctttgtcaccatgtgctatacaaaaattcattaaaatgttacatgatgaattactttttggttacctaaatgcagtatcaatatttgcttttgtgacaccacatgaatagtacaccttaatgttaaccagctatgtgctagtattggtttacataagaaatatttgttgtatataaatatttcattagctatgaacttgtactttaatcgttctttttacacagttagactattaccacagagaattgagaatgctctgttgactctaagaacatagatctttcctgtgtttgtttcacactgcttttgagctaggtagtgagtacctgtgaatggttttttgttgttttcttcatgtgactcaacaattttaagacttctcattggtgaaatctatggtgaaaccccatctctactaaaaataaaaaaaattagccagacgtagtcgcgcacgcctgtaatcccagctacataggaggctgaggcaggagaattgcttgaatccaggaggtgacggaggctgccgtgggcccagaccacacgccactgcccttcagcctgtacaacagagtgagactccctctccccaaaaaaaaaaaaaaaaagcgccctctataaacacacttaaaccatacagtaaaagtaattaatttttttccttgcaaattcagggttcagcttacatgttggctaaaaattaatttttgtttttagttctttaaagttattaatagtcaatgggtttaaaagggattatcaatagatcaactcttttgtatttattagataagtagcaccaaaagctagacattgaaccacatggaacaccacatgttgactaccaggcctagtgcctctaattaagtcacctaattctattctaagatgggaaatttgtatgtcaatccagtagaacagggctggtggattatgcttctcttccctgatgtattaacataaatttttttaaatctcattaaggcaacaaacatgccagaaaaacccgaatggtggtaatttcaactttgattctgatttcagtcccatctcgattctttccttttaatgaaacaaaggttctattagccaactaaagtaaaatgactgttcacagtgagctacacagtgctacattcacactggtagataaattgacaaaggattatgtgctacttccaagtgtgcaggaaatcctgagacatctaagttctgaaatctccaggttatttagataacttttaaaaaccaaaagattcaaataaaactgagatcatcccagagcgtacaattgccagattaacagttttcagggtaagagttagggtcactgtggggcaggaatgagaaatcttgaaattgctgagtcacatgaaaaaaacaaaaacaaaaaaccactcacaagtactcactacctagctcaaaagcagtgtgaaacagagggaagatcaggagacaagttctcacttttacttactttatgtgatcctaaacatataaattgacctctgcaaataagaacaacatctgcttcacaaagttgtgatagccatacaatgatgtaatcctaactgcaacctaaaatgtatgtattagataagaataacaatttagtcagctgggcacggtggctcaggcctgtaatcccagcactttgggaggccgaggcaggcagatcacaagataaggagtctgagatcagcctgactaacatagtgaaaccccgtctctactaaaaatacaaaaaaaaattagccgggcttagtagcacgcgcctgtaatcccagctactcaggaggctgaggcaggagaatcgcttgaacccgggaggcagaggttacagtgagtcgagatcgtgccactgctctccagcctgggggacagagcaagactctgtctacaaaaaaaaaaaaaaaaaaaaaaaagaaataacaatttagtcattataaccatggatttaaattccgtatcaaaaaggtacaaaaaaggaagaaaaacagaataagattaaagaaaaacctctcagataaattcaggaaacaagtgttttcagttagcaacaagccatattctgagagtttcttgagctttgaactttagagtcatctaaaagttccactctaaacagaaaaatcaaagtagtctattagaatagacattgcattatcagtgacattaccaccaaatttaaaaagatggaggggataaagcacaaggagaaaaagaagagaaccaaactgtccagagttaaatatcccacattttagttgtaaagtaaaacccaggaaaaaactcggatacatacttcgtcttaacccattctcatctgtcacatgacctaggttgtgtcagctttctacagatatctgtagtaatgtggaacaaatgtaccagagccaatacttttttttttgagatggaatctcgctctgtcacccaggctggagtgcagaggcacgatctcagctcactgcaacctctgcctctcgggttcaagtgattttcctgcctcagcctcctgagtagctgggattacaggtgcctgtcaccatgcctggctaatttttgtgtttttagtagagatggggttttgccgtgttggccaggctggtctcgaactcctgacctcaaatgatccgtctgcctcagcctcccaaagtgctgcagttacaggtgtgagccacagcacccagccccagagccaattctacctaaactgccaattcatcctgacagacccttgaaattgaacacagcacttttgtcttactacttcaactagattacctctaatatttaaatgaaatttgtgtagttttggtagtttatttcagccaagcatttagcccaccatgaactcactctatccttcttccttccatttaacaaatatttaagcaactattagttaccaagaattagactaggttagggatgcaaaaacaagaactgtggctaaagtttacaatttaatggggcagatagatgttaataatcaaataatcatataaaatatacgataagagatcctaactatgtcagatttagactgggggatctagaaagacttgtgatataaatatttaaacagacctccaaagcataaaataggacttggatgcacaaactggtagggcttggggatgtggagcagaagacattaggtggaactgtggtgtgtcacaaagaaacgacatgtatacaatggttatgtggttagaactccaacagtgaacaacgaaaagaattcattcaacttgacaatggatacaggtaggcagggccaggtcacacagaacctggcaatccatgttaatcttataaaacaatataagcaatcctcatctttcctcatgctcttttatttatctcagaccctgtttgaatgaaaatttacaaatacaagctaaaagataataaactcccacaaaaccatcaaccaatttcaactatcaacttttggcgaatcctacctcatctataacatctatctcccatccctatgaattatttttaagccaattcccaacatcacatcatcacctctaaatatttcggtatgtttccaaaatgtaaggtcttttaagaatatataccagtatattttataatctaaaaaacaataattccttaatgttaaatatccagttactggttaaatttcctggattgtctcagttttctccaaatcagagtcaaataagatccacacaattcatttacttaatacatcacaagctcgtaacacgctcctcctcattttctttcctcacaatctgtggaagagacagcactatctgtcctttagaatttcctccattgtggattttactgactgtgcctttaacacaaagcccatacttctaaacttgataatttgacacctctaggctggccgtgctggctcatgcctgtaatctcagcactttgggaggctgaggtgggtagagcatttgagatcaggagttcaagaccagcctgaccaacatggtgaaacactgtctctactaaaaatacaaaaaaattggccaggcgtggtggcctgggcctgtagttccagctgcacgggaggctgaggcaggagaattgcttgaacccaggaggcagaggttgcagtgagccaagatcacgccactgcactctagcctgggcgacagagtgagactctgtctcaaaaataaacaaacaaacaaacaacctttagtagtttgatacatttcattttctgtaggtcagctgataaattttttttgtacattaaatttttacatgtttaagattgagatatgttttaaaatacactcaatcttttaaaaatcatttaaggtactttaaactcctttcaatacccgtcagtcagatttttcatcaaacatggtaaacatatacatattatatactctgcctagcacaataaaagaaatgtaattgtttgtcataccctatgcaaatttccaaccagaaaatacccagaagcatcttctaacactaaaacccacgtctctccaggaaagtttttccttgtgcatcgtacctcacaattcactctttgtcctcttcaagcttagttggatcctcttattttgttatttgtatgtgctattatttccaagtcatgtcatatatataactggtctccaactagattatccatgcctccttatgggaactaccatgtgttttaactgtaagacaatttttaatgatgtctgtgcacatgtagtttacaagtaaatttgcaaaaaatataaacaatatgagagagttttagctgatgccttatcctgtttaattctcaaatgtttatattttaaaaacacttaactgaagtattctaatggaggaaaaaatggcatgacaaagaagtatggaaatggcttacagttcttgactggctgtaggactgaacatggaatttgagcatgaagattttgagcaaaatactaggctacttactgtgtcttttttcttttttttttagacaaagttttgttcttatcgcctaggctggagtgcaatggtgcgatctcggctcactgcaacctccgcttcccaggttcaagcgaatctcctgcctcagcctcccaagtagctgggattacaggtgcccgtcaccacgcctcgctaattttttgtatttttagtagaaacaaggtttcacttggacaggctggtctcaaactcctgacctcaggtgatccacccacctcggcttcccaaagtgctggaattacaggcgtgagcaaccgcacatggcctactgtgtcttctttagagaataagactgttatgtttcaagaataaagcaaatgacaaatagtgaaaggctctcagttattcaaagtactgccattccagagcagctcctccagagtgaattaattttctgtctacttttcttcctttcaaaagttaaactgaggttagaatgttcaaattctgtatgtgatactaatttctctttcaaagagattgcttgaggccgagcatggtggctcaggcctgtaatcccagcactttgggaggctgaggcgggcagatgacttgaggtcaggagttcaagaccagcctgaccaacatggtgaaaccccgtctctactaaaaatacgaaaattagtagggaatgtggtgggtgcctgtaattccagctacttgggaggctgaggcagaagaattacttgaaccctagagacagacgctgcagtgagtgagatcacgccattgcactccagaccaggtgacaagagtgaaaccctgtctcaaaaaaacaaaaacaaaaaaccccaaaatgatcactcgagctcaggacttcgagaccagcctgggcaacaggtgaaaccccatgtctctacaaaaaaatacaaaaattagccgggaatggtggtgcaagcctaaggtcccagctactcagtaggctgaggagggaggatcgcttgagcctgggaggtcaaggctgcagtgagtcgagactgcgccactgtactccagcctgggcagcacagcaagaccttcacacacacacacacacacacacacacacacacacacacacacacacacacacacaccccagaagggtgaaggagcagaaaagtacagtgtattgaggcagggtccccctttcatccctactaccccagtcccacatattccacagggagaacttgcctccggctatctctagaagaatgagagaattttaatactaaatccaacagaaaaacatcttctttctcactttgaaaatacggtttattggaaaagagtatggtgtctggagtcagtgaacactgagttccaaatcctggccccaccacttagctagctattatcattgagcccccagtcagctactgagaaatcaaacaagttccaacgcacaatctccaggaataatgctccaactttagtaagtctaagaattgcctgagagagttaagtctcacgtacctttatgaagaaaaagcctcttagttattatgtaagatatctatgagaccatactttttttgttttgttttgtttttgagatggagtctcgctctttcgcccaggctggagtacagtggtgcgatctcggctcactgcaacctctgcctcacgggttcaagcaattctcctgcctcagcctcccgagtagctgggattacaggcgtccaccaccacacctggctaatttttgtatttttagtagagacggggtttcaccatgttggccaggctggtctcaaactcctgacctcaggtgatctacccacctcggtctcccaaagtgctgggaatacaggtgtgagccaatgcgcccagctgagaccatattttcagaaatagtccttaaagacactgaggtttagcaacagaacccatcttcaagaaaatgagttgaaccaaaaattaatttgttaataaacttaccagttcttaaaaataaatgtggtaaaaaggaacaaaacaaacaaaaaagtgaataaatagaagaaaccctggtacaggcaaggtggtgtagactctattctttctcccagctcatccctgttctaagcacaattataaatcctgcaaataacacaagaggcaatcaaaggaaaactctgaaagatagaaaagggaaggcaaactagttaaaggccccaggactaaaggaacaacacagtgacaaaagcatctaataaacactatccaaccgaaagaaggtaacccaagtttggcatttcctggcttccaagagagcaacaaagagcatctcagacaggctcattccctgcctccatataagggaagtatttccttcaataccagggaagcactgcagcaacagcaagggggatggatcaggaggtctgctaataataggaagccagaggaaacgttattgccccatttctctatttctttttacggcaaatactcattattctaatttgtctcttctcactgtttctttaacacagggtttcaacccactattgcaccaaagctgctggtcaaggtcaccaatgacctccactgtactaaatccaatttccacatttcagtccttaccacccttgatccatcaccagtatccaacaaaggtgattactccctccttcaaatactttctccacttctctttcaagacatactaacctggcttttctattgtctttttgaattccttgtaagactgcatatgcgaaatcactaaatcttctttcctatacttcctttctaggtgatcttacccaaactcatggctttaagtatccaactatgtttctgactcccaaattcctacctcgagctgaaatcgctcccctcaactccagattcctgtttctacctgcctactcaacacttctatttgaatgtctaaaaagtgtctcaaactttacatgatcaaaatgaagttgatactttcccctccccaactcctatatgccatcccaaacctgcttcaactagatggatctgttcaggtcaaaaacctccatgtaatccttaatttcaaccccccaccacctctatctctctcataaacacactcaattggcaaatcttattggcactgtcttcaaatatatccagtattcagccacttcttgccacttcattgttagtactttggttgaatctttctagatgagtccaagagcctctaaatgggcttctagctctcacccttgaccactttcaggatattatcatgaacatagcagccagcctaatattgtataaaaggataagttcgatcatgtcactcctctacccaaaacctagcctagttgtttaccatctctaaaaacccaagtcctgacaacgaccctgtaaggcctcaaacagagagcctctatcacccaatccctgctacctctctggcctcatctcctgttctcctcctggctcattccattccagtcactgctgtttgctgaacatgttaggcaagctgtcacccacaggaccttttatttgctattcctaaagcagatatcctcactttcttcaggtcatttccttacatgacactttattaaggctttcccttaactgtcctataaaattgcaacccctctccaaataccccctacacacctttctttcccgcttcctggctttattaatagaaccttcatgaaaattatttttaattatctatctttcttactgtctgtttcccccactagaatcatatccggaaaacagagatttttgtcttgttcaccataatatctctgggtgcttggaacaatgcctagcaaatggcaggtactcaaatatttgttcaaagggaaggaaggaagcaggaagagagagggaatgagggtaacaggctggaactatgatcctaacttttccttacaaaagattaaaaccaaagtaattccagactgaagctaaccccttttctcatctggtgccaacagacctcataaaactaactctggcctcctcataaaactaactctggcctctaatgctgaaagcgagtcaagcaattatagtccacactcttagtccaagtatacacaaaccagagaaaataaagctatattacaaagtgaaaactactaacaagatatttgagagctcttctttttttggagataggatcttgcactgtcacccgggctgaagggcagtgatgcaatcatagctcactatagcctcaatcacctgagctcaagcaaccactctcacctcagtctctgcagtagctgggacctcagatgtgcaccaccacgcccagctaattttattttttcatagaaatggagcctcacgatgttgcccaggctggtctcaaactcctaggctcaggtgattctcctgcctcagccttccaaaatgttgggattacaggtgtgagccactgcacccagtctaatcccaaccatacacaacttgaatggaaacttgctgagggtactatagatgttccagagtaaaaacgtttccgcttttacacatggtaaaatacaaaattctcacatctcaatttctatgcttttgcaaaccacttactaacagaatcgtgaattatatgatacgtgtaagatagttaagttttattggcagatttcgattctgccacatcaaattgaaaaatattctgtcatgttcatcattatatattatataaatttgcctccctcaaaaaccacacccccaccaaaaaaaaacccttaagaaataatttttaatgacatagacctcaaaggtcgagctagttttcagttaaagaatgactgagggcacaaaggtggacatttttaccatcctaaaaattggaagatatcactcccagggtggctgtgtgatttcaatgacataacatttttaaagtctagcattccattataagtgctcagtaaatgggaagttgctgctgctcttacaagcttctgactaccatacctggttgaactaactcagttaccacaaggtactctatgcccttacatctaatgacaaatatttgttttgaaaaacgtatactccttaaacacacttgagaaacaggaaccagagacccaagtacattttgttctgaatcaaattccagcatgcacagcaaagtgcatgtagaggggtgagagggtgactagggagactgcttcaatgggagattattctgcagtagtgccttaactgtagaacagtgatgatgataaactcatcctaaatttaggactactgacaggaacaagtgaccacagtaactgttcatcttaagtcgtaaaaagctttctggcaatactcatcttcaaaaaaacctagcatgtaggaaaaatcttttatgtgtttgaataagggtaatatagttaaagctaaaggcttagatttttaactggtctaatgagagaaagcacagtagtcatataataagaaggtttatgttttacttcattttactagtgtttcctcatgagaattaagtaacagaaattataggaatcacaaatgaagtgcttactccatgcaaaacactggtctggcacattacagatattaattcacgaaatcctcattaaaaccctgtcaagtgggtattatgatcatcactgccccatttttataataaggaaactaagacaataaggctaagtaacttgtctaaggtcacaccactaacaagcagagccaagacttgacataggtgctctgggccagagtttttgttaacagttggaatatacaaatttacaagtattactgccaaatcaattttctcaaaaataagtcaaagtggaggaaggggggagatgaccctctgaattcactaaggttctgtgaaaagatgctgaaacaaataaaaagagtatttgattgtcaaatatatgctatttagaaatactaatggaaaagaatactgtgggcaagaaaagaatcacaagtatttgtgctgagttctgaaaggagagaaataaggttggggtgggaggtggggaaagcaggtcaagcatggaatagagcatgaataaaaatgcacagtcagaaaagtaaaaagctatgtcctagatacaaagcagtagtaataggtagaaatagtattacaaaaacagcagtgtcactaggtatcaggcactcaatgcataactaaagagaacataaaaataattaaaactatagtgaaacaaataacaagaacatgtcatattcctggttgtgataactacctatcataattgtagtttttttcccttaaattattaagttggagcagttattttacgtctgatgcatttcttaagcggttttaaagaagggcatagaatatgtgatgataaatttgacacaataatttgagttcatgtgaatgagtgttcaaacattgccaagaaaacactgaaagataatttttaaagatggagtttcgctctgtcgtccaggctggagtgcgatggcgtgatctcggcttactgcaacctccgcctcccgggcaagccattctcctgcctcagcctcgcaggtagctaggactacaggcatgtgctgccaagcccagctaattttttgtatttttagtagagatagggtttcaccatgttggccaggctggtctcaaactcctgacctcagatgatccccctgcctccacctcccaaagtgctgggattacaggcatgatccaccgtgcccaaccgaaagagaatattaaggaagactctgcccaaccaattattaaaattgccattatacaacaagtataatcaatagatacggatggtatttgaactagactagacaaagagatcagcagaccacaaaatacaacatatacatccaagtatacatggcaacgtaatatgcaaagatgacatctcaattctcagaggaaagaacattgtatttaattgttgatattgatataaccaactacacatttgggaagaaaggagagggaattcctatcttacactacacacaaaaataaatctaaagtgtgttaaagactttagcataatcactgcattgggaggcattcttaaagaacagaagaaaagcagaaaccagaaaagtttattttttggaaaattaattaaaaattctcatgctctctgatccacttttcaagattcgatcccacagaaacgagagcaccaatacaataatgtttactatcaaggtaactgaaagcaactgtatttcccaaaggagaatggctgagtatattattgtacacctctatagggagtgttatataatcattaagaatgaagacaggcacggtggctcacacctataatcccagggctttgggagcccaaggtgggtggattgcctgaggtcaggagttcaagaccagcctgaccaacatggtgaaaccccatctctactaaaaaataaaaaaattagccaggcatggtggggtgcacctgtagtcctagctactcaggaggctgaggtaagaaaatcgcttgaacccaggaggtgaaggttgcagtgagccaagatcaagtcattgcactccagcctgggtgaaaagagtgaaactctgtctcaaaaaaaaaaaaaaaaaaaaaaaaaagaatccagaccgggagtggtggctcacgcttgtaatctcagccctttgggaggctgaggcgagcggatcacctgaggtcaggaattcgagaccggcgtggccaacatggtgaaaccccatctctactaaaaatacaaaaattagccggacatggtggtgtgtgcctgtagtatcagctactcaggaggctgaggtgggagaatcgcttgaacctgggaggcagaggttgtagtgagccaagatcacactactgcattccatcctgggtgagagtgagacattgtctccaaaaaacaaaacaaaacaaaacaaaaaactgggcagataaattttttttttttttgagatggagtgtcactcttgttgcccaggctggagtgcaatggcacaatcttggctcactacaacctccgcctcccaagttcaagtgattctcctgccttagcctctcgagtaggtgggattacaggcatgcgccatcacgccgggctaattttgtatttttggtagagacagggtttctccatgttggtcagggtggtcttgaactcccgacctcaggtgacccgcccaccttggcctcccaaagtgttgggattacaggcgtgagccaccaggcccggccgggacagataattttagacatcaatttaagtgggaagaagactacaaagaatacaaagaaactagcaatgcctgaagacattttttgttgtcacaactgggggtggggggatggtacttggtagaggccagagatgccgctaaccatactacaacacaggacagtttcctacaagaaaatgtcagtagagctgacactaagaaaccttgctgtatatgaaccactgataagaataaaatcttagctttccaaggtcaatcttgccttttagccccatcatggccccacgtgtttgcaggttctttggctaagccaccaaatagctgttatggtctgttaacaatcaaatgaatggcaagggagaagtttaagccatgacccagcatttaaaaaataatggaaaagaatacaacagaaaactaagagtatgcagcatgcagagtatgtggggaaagtaatttttgttaaagttaggcatatgcaagcctttgtgtctctcaaatttacctgtaggtataagtggggcaaactgtttatcgcacggtagatcatgctcaaagaaagtcattcaagatactcctcagttctctcatccaaaaaactcatgagttggactaaaaaaaaaaacaaaaaaacctacgaggcactttctttataaaatgttaatgaatttatgatcatctgcatgaagtctaccctgtatgtacagatgtaacctacatgggagggggtacagtccttataggtagacacctgaaaggctcaattcatttcagatgtttcaagaaaattccttagtcaataacattcacatagactttgtaagatcttgattaagccatgaggccaaatctaaatctaaatcacccactcagaaagtgccaaaaaccttaaaaccaaaagaaacattagagattatctatctctaagcatctcaatttttaaatgagtaaaatgagcccaaaatggggcccaaaggattaaatgatttgcccagagtcataagccaagtcagactgtcaaaccgttaaagcaaactgataagaaaaagatgctcagggccaggcatgttggctcacgcctgtaatcccagcacaatgggaggccgagtagggcagatcacaaggtcacgagttctagaccagcgtggccaatacggtgaaaccccgtctctactaaaaatacaaaaattagctgggcatggtggcaggcgcctgttgtcccagctactcgggaggctgaggcaggagaatcgcttgaacccaggaggcggaggttgcagtgagccaagatcgcgccattgcactccagcctgggcaacagcgagactccctctcaaacaaaaacaaaaaaactaaaacatctaactgaatcaggctgcttaagtatcaaaataatcttaaatatctgaagaggaagaaggataaagattccctaacatgcagaactaaaactagaaaaactttattctaatgttcttagactactatcaaattctccctaggacttctacattgctgataacagcttacaatatttttcccagtttagttaagaccacatgtcagtattttattacaatctttcaagcaagaaagaaggtctctgatatactaatttaaagacatatacactcttgatagagctatattaggaaatggcaatggctaattcgtaaactagatttttaaaaaatgacaatatcttgtttaaagttattagactatgacagtcatctgagtggggaggtaactagttccccagcagaagccttaatcccattaaggtttatcagacaagtgtataacagaaatgttcatttcttctcagaaggaggttatgaattatatcacacggattctgtttagatgaggtttagaacaatttttctttttaacagtttctccttttgatttagacactctctaaagatctgtccagatttaggtccatttcactgaaattttgtactaaagtccacgaatttttttcattttttctttggcaaacaggtatttttgtaaacccaagttttatttatttatttattttgagatggagtttcgctcttgtcatgcaggcaggagtgcaatgcacaatcttggctcactgcaacctccacctcctgagttcaagcgattctcctgcctcagcctcccgtgtagctgggattacacgcgcctgccaccacacccagctaatttttttatttttagtagagatgggattttgccatgttggccaggctggtctcacactgctgacctcaggtgatccacccatctcagcctcccatagtactgggactacagacgtgagccaccgtgtccagcctgtaaagcaagaatttttaaagagcaaaaagaaagtgcagattttctgtctccttactacagatgagaaaatagtataaagctatcgagagtgtcaacagttctatattacccccgtccccacccccactgtactgctcctgaaagctaaacagaaatcccaaggaaagtatacattcaaggaacgaagataactttagatatgtattacatgatgcatatacgggttttcagtgaactatatgtgatttcaaactaaattaaaaacaaggctttactatgacattatgaatgaaaaacagtttatttataggatactttgactctactcaaaaagtatgcttaaacaatccaacaactttaggaaagccaaccgataaatctttgcaatcaggcagaaatactaaggcatttaaaaaacatacccagaccgcttttaacatttaccccagagatctctaggctcatcacagagggtaaccacaaaatgcttaagctgcatacagacatcaggcaaatgccacataactgctggacagtaagttatcaccacagtagttaccaatgtgacaaagcagaggataaggagcattcagagttggaaactacggtggaaacgtttccatttatggcacattttctgattggttttataactcatgttactaactatagaatcatagacgagaagaatccccggaaccaagcctcttataaataagtcaactgacctgaaaaacttacgacagagtgaaaactagacccaacttcaaactgagataggattttatacttcacaaaaattaaagttagttatttagattttattagaaatagctcagcacgtaaagtcctcaaaggaaacagacatacagtcaaaaaaaaccattactgcggggcgcagtggctcacgcctgtaatcccagcactttgggaggccaaggcaggcggatcacgaggtcagaggatcaagaccatcctggctaacacggtgaaaccccgtctctactaaaaacacaaaaaattagccgggcgtggtggtgcgtgcctgtactcccatctactaggcatgctgaggcaggagaatggtgtgaactcgggacacggagcttgcagtgagccgagatggcaccaatgcactccagcctgggcaacagagcgcgactccgtctcaaaaaacaaaaaccaacaacaacaaaacattattaaactataataatgttttctatcaagacacaaaatattaaaagtagatcaggaaggaataataagtcaattcattatcaaccttgtgactcttctgtccagcctcttccagaggttccctttacttttaagtgcaatgcaatctttaaccttaactctaaaaactcatttagagtcctccaatttcttatcagttttccaatacagctcaagaacttttccatcagtgaataaaagttgcattacttttccctttcacagcttgttggcagggaattattttaaatgtacaacaaaaatctataaatctgtagcttccaaaagagtgtttgaaaatatattttaaatggcaaaataatctcagtaatcaacagtaatactgaagtaatgtttgaaaattacatttttagaaagtataaagttacatttattacaagtgaagaaaaaaatttttatgagggaatgtttttaaaaagggttacaaattctttgacacttctcccaatgagaggcagatttctgtcaattccccctcaaatctgagggagcttgtgaccactttggtcaacagaatatggtggatgtggtactagatgactttccaggacaggttataaatgggtatgcagcttcaactgagcacagagacttcatgttaagagatattataaccctgagaattccatgctgaacagccatgtgcacacagtacttgacgaagcaacccagccaagcaaagctttctagccattccttaaaagctgccagacttatgggtgaagaaactatctcacaaatttgtgtatggactctccttccagtaacgtaaattccaagagagtaggaattcgtctttgttttattcactgatgtatccacaccattttaatagtttccttttatgtatgcagtaagcattcaataaaggtctgttaaatagatattagtgatggtggcagtggcaggtggagaaggggatatcctattcatgaatagttcacagcagtaaccatgtgcatgcctcgcaaagcagccaaagattttcagagagtctatctaattccaatgaaaagcccaggcttttaaaacggtattttacaaagactgatggatctgactaaagaaatttaaaacttctatcattcaaaaaccataaaaattaaaacataaataaataaaaagctagggaaaacaatttgcattttaattatgcttttaaaatgcaaaaaaaccctttcaaataactcaaaaagacacaaagatttacagatttctttatataaaaaagtgacaaataaatacaaaagaaatacactactaaatcaaccaaataaaataatccaagaatgtcttttttgtttattaaattggaaattctttaaaaactactatctgttaggcttcagaacactgctgacaaaacagcagtttcattctggagaacataacatttctcaaaagccttaaaactgtcattatcccatgaccactccccactacccccaccccagaaaaagtccacatctagaaatttaacctaaggtaataatctgtgatatgaagcaagctttacacacaatgtttttaaactcttagataaaagagcactaactgagggtcatgttcccgacgttagttttatttgcttgtagttgggttttctttggccttcacaagtgtgtcaaaaaaaattcagtaagttgccagcattttaaaatctattgcacacaaacacaagatctgccagcactgggtctgcaagcctcttaatgactattagctaaacagtagccaatcccttcagatgtggcacatgatacacagttcaaaatcatccctaatctgaaagcttggttcatttacattagatgctttatcttctaaagttatctcagttggaagccctacactagagatcaaactttaagcatgcagggcttgctaaacgctgattggtgggccccacccccagagtttccgactcaggacatctgaaatggggtcccagaatttacatttctagcagatttctaggtgatggtccaaagactacactttgatggtctagagaccacattttgatgaactttccttgctgaagccagagagaggcctagcatcctttgaattacacaattacaggatacttaaacaatattggagattccattaatgggggagggaggcaaggaagagtagaaaagccgacggataaacaaccaatagtcagtgcactgcttccctctatcagaggtggaaaaccattgccctacactaaatttaagaataatcctagattaagttgctagtccaaattttctattctacattctttctcatgggccttatccatttctcaaggtttaatgacctcttctacacttcatggataaaataacaggggtaaacaaaaattgtggtaaaagatcccacgtagctccaatattttatgactaacaaatgtgtatcaccagccttaatattttctactgaatttgctttctccagctggatcctatacatagcagcttttgctgaatgcttcctttgttccgggcattgtgctacaacattacatgacttttcatcatttcatcataataacaactctatgaaacggtgcctactatccccatactacagatggagaaaaagaggtcatttgtcaaggggttaggtcatttgtcagagaagcaagcacaggtaaaatctacatctgtatacgggtaatctggctccagagtcctcaattttctttttctttttttttttttgagatggggagtctcgctcagttgcccaggcgcaatcttggttcactgcaacctccgcttcccaggttcaactgatctcgtacctcagcctcccgggtagctggaattacaggtgcacgccaccacgtccagctaatttttgtatttttagtaaagacgaggtttcaccatgttggccaggctgctctcaaactcctgacctcaagagagctgcccacctcggcctcccaaagcgctggggatacaggcgtgagccaccacacccggcccagagtcctgaattttaaccactacacttcatctaaaattcaacttgtacaaattccaatctttcatctaaaactagctcttcctctaaacttgcctactgtcaatgttttcaccttcctgctcaggctgccaggctccaaatcactaagttcctaccataattaagtccttctacatttcacatctgtctttttctttttatttcaattgacctaaatgtccttattcacccttcacctggcctctaaaatgcctagtatttctgcttctagtcttacacccaacggtgctcctcactcattgcctatgggtcaaaggccagcttatttaacatcaaattcaatttaagaccttacctacctcttggatccatttctgtggttccacaaacagattaaaaattatacttaaaacacaccaacacacatgcagagctttatttctgaagaagaagagagaggggtggaaaggaaaaaacttaagaaacaatgttcaatctgaaagtatcacttctaagtggaaggctacaagggataattaatagctaccaaaactgaacactgaaacatcacatccctctttcatggagccatgtaagttaaaaaagaatcttaaactgttgaggtatatcaacatagacaaaatctgaatgccaaagtgagtttcactctaggatcaggttatctggcagctcctgaaacaggacagtttcaggaaccctgtacaaacctcagtgaaatgaaataacttcaagctgtttgttacaggggactcttgtgtcttttagtctaagtaaaagcagcaattttctacaatatatttatataagctgtgcatttccatgaaagaaaggaggtctactgtggatatatgcttggtatgaaattatgtcagaaacaagtgggagcgaggggcaagtcaacatgctgtcactaaataaaagacagacccccagaaatgacctcaacaatcaaagaaaacatgatagtgtaagttaacatgattaattttttaaattaatagactatattttaaagtaatttgaggtttaatgaactgagtagacagcagagtacccatataccctcccttccatttcctttgcacatttattatacttaatgagccaatacttgcatattcttattaaccaaagtccatttacatcaaggttcgctttgttttgaattttgacaaatgtaaaacatgtacttaccacgaaattttacaatatgcaataccaaaaaatacagctagattcaaagagagaatgtttcagcatctcattatctttatcacagtaacataaactgaactccgatcttctcccctgctcccacctagttttcccagtcttcccatctcagtaaagagcaataccttccatccacttgctcagaccaaaaattccttcctcttttataacccatacatccagcccatcagcaaatcctacctgctctaacttcaaaatatatccagaattgaaccttaattctcacactttaccaccaccactggaacccaagacaccattctctcactaggttattatagtagccccctaactcttttttttttttttgcttctgtccacaaactaatcagatcatgtcactcctctactcaaagcaggaactggcattctaccttagagcaagagctacaatcctcacaacaggcctactaggttccacacaacctgtctccacctacctcagttcccttttctgtctatgacttcacctcctgtgtcctcttcaccacttgctgttgaagctacactggtttgcttgccggattacttcaggcagtctctgtccttaaagttttggcactggctgttctttttgtccaaaatatcttccacaaatgctcacacagctgacttcacatcctgacacaaatatcactttcatagttaggcctttttccctgatgaccctatttatcactgcattgttttcccctgtactccttatccctcttacctgctttatttttttctgcatagcatttgctgcaaccaaatatatattctactttgttattttattgacccccccaccccactagaaaataaatgcagcaactgaggtttctggccttaaaaagcacttagtaattatttgttgaatgaataaactatggtgtacagattctcctcaacttacaatgggggttttgtcccaataaacccatcataatttgaaaatatcataagatgaaaatgcatttaacgcacctaacctactgaacatcaaagcttagctgggcctaccttaacgtgctcagaacacatacattatcctacagctgggcaaaatcatctaacacaaagcctattttataacaaagcatgaataactcatttactgaagactgtactgaaagtgaaaacaacggctgtgggtactcaaagtacagtttccagttttcacacgataataaagttgaaaaaccataatttgaactatagtaagttggggaccatctgtcaaggttcctaaaggtgacatacaggtgctagcaactacagtctaaaaaaataaagccccaattctcaacaaatcagtaactgattctggaaacacagaagttcctttgactctcttaaaggcttcaagcccctctatcagaaaaaaatgtctacagtttgaggagactagcctgctgccttcgggatgtccccatctgttttctagccactaacacagccacaaagcataccacacttaggaacagatctatgggtaggacacaagcatatttaggctgctatcataaagataaagatgcattcagccataaatacttaaacaagtattcatactggaaatatgaaacacttttaatcatattcctaacaaaagtaccacgagattaactggctgagaaataatgggggtgatctcctatcgactacaaaagtgggttagaaactgaagtaatctaacctcatcaagcaagtaaagcttcactttactgcactttgcagatgctgttttaaaaaaaaacaaattcaatgtttatggcaaccctgcatcaaacaagtctattagcgtcattcttccaacagcgtgcactcacttcatgtccatgtgacacatttgggtaattctcacaatatttcaaatgttttcattatctgttatgatgatctgtgatcagtgatctctgacactgccattgtaatttctggaggtaccacgaaccgcgcccataaaagatggaaaacttaactgataaaaatgtgtgttctcactactccactgaatggccattcccctgtctctctccctctcctcttgtttccctattccctgaaacacaacaatattgaaattaggccaattagtaactcctcaatggcctttaagtgttcaagtggaagagtctacagctctcgctttaaatcaaaagctagaaatagacacttgcggatgttttctggtaaaatagctgaaagaaaagaattttttttagagacggggcgcagtggctcatgcctgtaatcccaacactttgggaggcggcggcaggcggatcacctgaggtcaagagtttgagaccagcctggccaacatggcgaaaccccctctctactaaaaatacaaaaattatgtgggtgtggcattgcgcacttgtagtcccagctactcaggaggctgaggcaggagaatcacttgagcccgggaggcagaggttgcagtgagccaagatcgtgccaccacactccagcctgggcggcagagcgagactccatctcaaaaaagaaaaagaatatatattttttaaaagctagaagtgattaagcttctgagaaaggtatgttgaaagccaacataggctgaaagtaaggcctcttgtaccagttagcaaacttgtaaatgcaaaagttcttggagaaaatttaaaaagtgctactccagtgaacacacaaatcgtaagcaagagaagcagctttattgctgatatggacaaagttttagtggtctgtatagatcaaaccagccacaacattccattaaactgaaagcctaatccagaacaagaccctaatcctcttcaattccatgaagactgagagaggtgaggaagctgcagaagcaaagtctgaagatgacggaggctgctttacgaagtttaaggaaataagccatctccaataacctaaaagtgcaaggtgaagcaacaagtgctgatggagaagctgtggcaagttatccagaagatctagctaagatcatcgatgaagatggctccattaaacaacatgtcagcaatgtagaaaaaacagcattctattggaagacacaatccaaaacttttgtggctagagagtagaaaggagaaatcctgtcttcaaagagaggagaatgcttgacttcaaagcttcaaaggacagcctctcttgttaggagctaatgcagctggtgattttaaggtgaaggccaatgctccttgaccattctgaaaatctaaggcccttaagaattacactacatcagccaggtgcagtggctcatgcctgtaatcccagcactctgggaggccaaggagggagaactgcttgagcccagtagttggagaccagcctgggcaacacggcaagaccccgtctctataaaataaaataaaaacaaattatgctacatttactctgcctatgctctataaatgaaacaacaaagccaggatgtcagaacatctgttgacagcatgttttactgaatattttaagtccaccattgagacctcatgctcagaaagattcctttcaaaatactgctgctcactgacaatgcaccattgccggagaggtctgaaagagatgtacaaggatataaatcctgttatcatgcctgttaacacaacatccattgtgcagcccacagatcaagcaataatttccacttctaagccttataatttaaaaaatacattctgtaaggctatagctgccatagatagtgattcttctgatgaatctgggcaaagtaaattgaaaattattctggaaaggattcaccattctattgagtcactcatgattcatgggaggagttcaaaatatcaaccccaacaggagtttggaagaagttgactccgactctcatggataatcgagaggttcaagacattgctcgaaaaagtaactgcagatgtgaaaaacacagcaagataaccagaattagaaatagagcctgaagatgtgactgaactgcaatctcgtgataaaactgaaacagatgcaaagttaagttgactctgactctcatggataactgagaggttcaagacacaggtcgaaaaagtaactgcagatgaggaagaaacagcaagataactagaattagaaatcgagaattagaaggaaagaaagggaaggaaagaaagggaagggaagggaagggaggggaggtagggagggagggaggagggagggaggagggagggaggagggagggagggagagagggagggagggagagagggagggagggagggagggaaagaaattgccacagcttccctaaccttcagcagccactaccctggctagtcagcagccatcaacatggagataggaccttccaccagcaaaaaagattatgactcacttcatgaaggctcaggtgatcgctggtatttcttttagcaataaatattttaaaattaaggtagtccactatttattatgacataagcctaccgcatacttaacagactacagtatagtgtaaatgtaacttttatatgcaataggaaacagaaaaagcccatgtctctcactttagtgtgatattcactttattgcagtactgtggtcatctggaaatgaacctgtgatatctctgaggtatggctgtattttcatacaaataaaggcactccccctaaatctagagtctagatcccaaatacatctgtccatatagggggtaccactcccaagaccaaaggggtgtatggctcctatctccagccgtaccaaatcatatatacagtgtaatatctggttactctttattcaggacagctacattcaaaggaaacataaaatgggcagaataaggactccttgctcattaacaaaacaaagccaactcttatgtcagagtacccttttgatcaattagtgtgattatgttcactagtaacagattctaccatcattgttgtccatttcatttccattctcaagctttaaaaccccaaaaggacagaaagagatactacaggctagtattagtaatactaaaaatagttacctcttattgaaacctgaagggcctggtacttgacatatatcattttctaatctttatatgaactcaataaagcaaatattgttatttcaacactattacatattagagactgagcaatctggacaaagtcacacagcttatcagtaccagtaggaattcaaactcaggtctgactcaacagtctgcattcttaaatatacctcaataaagctgttgaaaaagtaaaagtcggccgggcacagtgtaatcccagcacacctcaataaagctgctgaaaaagtaaaagtcggccgggcacagtgtaatcccagcactttgggaggccgagtcaggcggatcacctgaggtcaggagttcgagaccagcctggccaacgtggtgaaatctggtctctactaaaaatacaaaaattagctgggcgtggtgatgggcgcctgtaatcccagctactcgggaagctgagacaggagaatcactcgaacccaggaggcggaggttgcagtgagtcgagatcgcgccattgcactccagcctgggtgacaagagtaactacgtctcaaaaaaaaagtaaaagtctccatctttccactagaccacactgcttttctcaatctttatgacaaacatgtaaggcatattgggttctggataatatgtcaaggagatatactattttggaatattttggcaaataaaggggggctttaaaacatgaaatttttttttcttaataagaactgtaatctatttccccaacttcattattaagtgagttttaggcctaggtcttccagaacagtttcctccaaaacatacagtgtaatatctggttactctttatgtgtgcataagaaatgtcactgtgacaaatgttataaagaaaaaatttgattaccctaaaaacaaatacataaacagcccgcaagtttagctcctaaagtaggaaagaataatgtgaaaatgtttctggctgtaccactcaacaaaaatttgcccgccaataaggaatcctttcttcaaaaattggtcatgatcattagccaaactgtaaccagtaacatccagctggattatggagctaataaagaacaacagaggggatccacaggaaattcaacaggtaacttacaactggctctctcatcagactggcagactgggtctaatccgaggtcagatgacatgggggattatggaagccaataacaatcatatttaaataaatgtcctttacagaacaccaccactttcctcataaaaagttcaaaggactattttcacccctcacaattacagtaaggataagaagcccaagcacagcttgaagcagcaaaattttctgaaaaggaattgaattctgtgttctcttcaggatcttcctttcccaataatgggggtattaaatttcacttataaatcaaactgaaagggaaaaaaagaacaataaaaaatgagctggaaaacctacattcatcatcttcaaaacaacatcaagttagaaacagttttaaagcaatgttacaactcctttagaatctggcaggttttctggtttttaccagatcccgctccggcaacaacaaaaaaagaaacagttttaaacagttttatgggcgtggtggctcacacctgcaatcccaacactttgggaggccaaggcggacagattgcttttcagcacaagagtctgagaccagcctgggcaacatggtaaaattttgcctctataaaaaaataccaaaaaataccaggcatggtggtggcacactcctgtagtcccagctacttgggaggctgaggtgggaggactgcttgagcccaggacagcaagggtgcagtgagccgagattgcaccaatgcactccagcctgggcaacagagccagaccctgtctcaaaaaaaaaaaaagttaaatgctgatgactgaatagaacacaattctctgtaaattcttcaatgtgataaagcatttcctacaccagttaccagtggcagcacctaataagacttgagagcaacttaatacttcaccctcatgtatgtatgaatttaaaatagaacatcacaataactacgaagatacccaaacaccccttccctaatttttttttttggtacaaacaaagtctcgctatattgcccaggtggatctcaaactcctgggctcaagtgatgctcctgcctgggctttccaaagtgctggggttacaagcgtgaaccactgtgcctggtcgcttccctaattcttaacatgtcccacaaaagattctgcttgatcttggcccccactatatcatcactatctctagtaaatagactcaaagcctctgctttctctgtggctctagccacactggcagagaccaaaggagagttcaatgataggccctctcacagaaccttgtgccttaccatacttgtcagttacaattttattcactcgattcaagcattttttggatgcctcatatgtttcaaggtacctttgttacagcagtgaacaaggcaaagcccctaacaggaggaaattcacattccagaggtaagaagagaattaaaaagccaaaaaaaagtgtgtgtatgcatatatatgtgcataagaaatgtcactgtgacaagtgttataaagaaaaaaaacacagtaagaggacagagagtgaagttgtccttgtacagttgacagtcaataacacctcttttaacagtagtagagacctgaacagggtgaagaacagagccaagctgacaggagatctggattaaagctttccaggcagaaggaatcgaaaataggcgggaatatacttagcttgttgagcaaggcaaacagcatggctggagcacagagagccaaaagagaggtgataaagacaacaccaatgaggtaaataaaagcagacagaacttggatcctctagagcctgcagctcacgatatggagtttgaattttagtctacgtgtgacaggaagcctttgaagaactttgaggagggacacggatgtgttatcgacacactataaatgaccagtaacttcagaagcaaggaggccaactgggaggctgcgaaggttgtccaggcaaaggatgataatagcttagactagggtgatggtagcagtcaaatgaggaatgttatttattttcagaatgtaatctgaaggtggagccaagatttgccaatggaatagaatgtagagatgaaaagaaaaaaaaatctattcatctctgcatcccctcagagaatgtacctgaccaccatgaaagcaagggccatgtttgtcctattcaggtccttgaacaaaggaacagtgcagtatgttctagttgaattaataaatgacctgcttctttccctacagaatcacaatattggcatttattttggctggcaaatactggtacgatgtcaagcatagaaattaagcaccttaggagaagaaaagggagttaaataaaaaagagatccatgtttcactgaacttgcaaattcaactcaaagcaccacctgtctgaaaatggaacgtatatatataaaaaaactgctcattaaggaaaataaatcacagtatctcagcaacagtgctttgtcgtgagttacaagattggctacaccatctgacaggattacttaaattgacaaagacctgcctcaccaaacacagctagaggtccttgggtccttgtggtactggtatcaggaatctgataaatcagtcagagtgtggagtgtttttaaaacacagacaaaatatatttagcaagcaaagtctgttaaagggaagattggagatcactttaaaaataattcaaagcctactctaagtatttgcaaaattgtaagattatatttctgtgcttttgaataagattcagattggacagtctcaactctcccttgtgggagagggtaggggtgggggtggacctgttttctactaagaaatttataggactctccaaaaacagaacttagggcagtactccttaatagtgaccatacattagaatcatctagggagggctgggcacagtggctcacacctgtaattctagcactttgggaggccgacacaggcagatcatttgagcccaggacatcaagaccagcccgggcaacatggtgaaatcccatctctactaaaaatacaaaaattagccaggtatggtggcatgtgcctgtagtcccagatgctcaggaggctgagacgggagaatcacttgtgcccagaaaggtagagggtgcagtgagctgagatggtgccactgaactcatgcctgggcaaaagaatgagatcctgtctccaaaaaaaaaaaaaaaaaaaaggaatcaactagggaggcttttaaaacatgaatgctggagacccacaccagataaattaaatcaaaatttaatcgggggtgggtcctgggattttccctttaagtgtttcccacgtgatctgaatgtgcagcccaagttgagaatcaccaatttacagcaataaagtttaaagtagaggatttaaataaaagtcttttaaagaaacaacactttcagaagtcaacaaacttgagccttcatgttaacacgtgggggtcacagtgggcattttggagcacagataaaaggacctgctttggaattgtaaaaggctgtttcatacatacaaacagttcaggaaaggatagaacgaaaacaaaaacaagaaaccttgattaaccccaccacattccttcccaagggcttgaattttttaaccgaacactacaatagcaacaaacctagagagtcagttcaagacggcttctccctgtaatgctgccttagaactctacagaacagcagtcactgctgcacagctaaatacatctccagccaaggaaatctagacatagaagatagaaaataacatcccagtttgtccctcctctttcccctccctcatcacatatcaacagctaactttgaacacatctgtggttcactgtaccacttacaggggtacagaggaatgaaattaccagtcctcactgtaaaataaacacatttctttaagaaattctataaagcacaagaggaaagcaaaaccttagtaaactgacaaatgttcccattctcccagcacatgaagaagactgccacagtctttttcaattacactttgaaaccctctgtcctggttttcaagcacaagctgatcttcacctcattatagatactcaaactgccacccgtcttatttttaaatatcagagaagtgacaaaattctatctatgatcaaggatgtattataaaagagaagaaattttgcctggtttttacatttatttaagtcccttctacaatgaataaaaatggttgttcaaatcaatgggtgaatgggaatacaaataaaatatgggtagcattttaaggcatggtattaaggctaacatgatgtccatctaacatccagtttctgaaaatctgaaatcagaacacaggaccttttcatttcaaatttacattaaagttcagctcactgattaagcatttccctcaataaaattacatttgtcataccttaattgtgcaaaagctgcaaactggtaaaaaacttgaatgccatggcatgattattcaaaaataactggtacaccctatgcctgaaacctgagtgcctactgtgaacctgccaaaatgattacaatgacaacccatcatcttcatcacatgaattactgcaatgtgaacagtattctgctgagcactatacagtaatcaaaagacaagctccacatcctcaagaagcttataaatttgactgaggagatagggctgataggcaagatagcaataaaacacataataagggcctaaatcatgcagtacaaactaagttttgaataccagttcccagcttgcagtctcagacatagatagcaacaccaccaccaccacccttgccaagccaagtaagtaaaaagtaaaatgagtaggctaggcacggcggctcatgcctgtaatcccagcactttgggaggccgaggcaggtggatcacaaactcaagagattgagaccatcctggacaacatggtgaaactctgtctctactaaaaatacaaaaattaactgggcatgacggcgcgtgcctgtaatcccaactactcgggaggctgaggtaggagaatcacttgaacctggaaggcagaggttgcagtgagtcaagatcgtgccattgcactcctgcctgggccaaaacagcaaaactccatctcaaaaaaaaaaaagtaaaatgagtatacaggagtcctaaaaacttgagaaaccaaaggaagcaattcatttggtcaagagaaaggtcagggcagtttcaaccttcccatttatttagctgtgtgactttcaacaatttacccaaccctttaaaggaagatagtacctactaattaccatgagaaccaaatgagatagtgtatataatgcgctttgcacaatgcctggcacatagtctcaaatactgcctattatcattactgttagaaacagtaaaatcctagtgttggcaggggcctttcaataatccaattttccagtcgaatagttctcagggtgtagttaccatcagcatcatttgggaaattgttagaagcccatactctagggctccactccagacccactgaatcataaattatcaaatctgcgcccagtaatctgtgttttaacagcactccaggtaattgtgatgaccattaatgttagagaattgctgccctaattaaaccctctaattttacgtataaagaacatggaggccaggttcagtggctcttgcctgcaatcccgacattttgggaggccgaggtgggagaaccacttgagtccaggagtttgagaccacgtaatatagttagaccctgtctctgaaaagaatacaagaattagctaggcatggtggcatgtgcctatagtcctagctgctcgggaggctgaggcagaaggatcacttgagcctgggaggtcgaggctgcagtgagccatcatcataccactggacttccagcttgggcgacacagcaagaccgtgtctcgaaaaaaacaaaagtaagcagatggaaacctgaagagataaaataacctgctcaaaaccacaatcatggagactgtttgtttagggtccattatatgccaagtaccagggtgaccactttttacatttttaacatcaggtcctcacaacagcccagctgggccccaattaacagaagaaaaactgaggttcaggtgtgagatggatggagtaatttgtcaaaggcggctcaatttttaatgggcaaaattaacattcaaatccaagttgtatgtgatcccaaacccttactgaaaccaggaccactgagtgttctgagggaacgataccaagcacacgcccagacttccccacccaagggcatcgttcttttcattctatcataccaccttagctgcaatgattttaccatgaaacataaccagaaattagcactttaaagcaactctcagaagacaggtggtaaacgattcttcactccaactagaaaggaaaaaatgacaacatactatgaaaaaagctatgaggcaggaaaaagcacacgtcaaggcatggagatacggatatagactaggtaattttgcaaccacataagtgaaagaaaatttgctatccaatcttcctattctctactcccaagagcctagtgcttttgtatagttttcagctcagtaaagtgcctccagatttataaaagctcaatgacaataacaaggtatctttattacaaaatagttgttaaaagtttgattcgaaaaattttaaggaaacctttcaggtaactgaaagtggagggtaggggcgcgactcatgaaggagttttttaaccaaagaaatgatatgatacatttttaaatgaccacttcagttgcaatataaaataacagattttggaggaaaatgtcaatacaaggatatcaattatcaattattaggttactatattggttcaaggagagatgatggtggctgtggagatgagtgaaatcaacagatccaagatatattttagagagtattgtagaagactaggaatgggagtgaccagacaggaatgaagacttctagacttactgcacactgtcatgaggaaggatggggatggaagggtacagtggaataagctgggttttagcagaaggaatcaagagccccattacaaacacattaaatggcctggcgtggtggctcacgcctgtactcccagcactttgggaggctgaggcaggcggatcacctgaggtcaggagtttgagaccagcctgaccaacattgagaaaccttgtctctactaaaaatacaaaactagctgagcgtggtggcaggtgcctgtaatcccagctactggggaggctgaggtgggagaatcgcttggaccctggaggtggaagttgcagtgagctgaggtcgcgccactgcactacagcctgggcaacaagaacaaaactccatctcaaaaaataaaaaataaataaaaataaacacattaaacgtttataatgtatttacaagactaacaatcagataaagtctgaacttcagaaaggagatagagctgacctgaaaatataaattacgaactattgttatatgaatgttacttaaaagacgaggaggccaggtgtggtggctcatgcctgtaatcccagcactttgggaggccgaggcaggtggatcacttgaggtcaggagttcaagaccagcctggccaacatggcgaaaccccacctctaccaaaaaaaaaatacaaaaattaatcgagcacggtggcatgcacctgtcagcccagctactcaggaggctgaggcaggagaatcacttcaatctggaaggcggaagctgcagtgagctaaggtggtgccactgcactccagcctgggcaacagagtgagactcggtctccaaaaaaaaaagggcagaagatggggcggaagaatagagataggaaagaggaggatgttgagaactaaaccctgaggtacttttagtattcaaagtgtaggggggtctggaaatcttgtagagaccagtaggggttggagtatgacatcttccaataatgaattctcgttgctgtccccttatgggtctgggtctacctgatagtctcttctggaagtcggtatcacttgtgcttaatttctactcttttgtgccctctatacagcctctactacaaatcttttttgaagaagcacagggagaaataacttggggaaaaaaaaaagcctatcttttagaaatagattctgaaatatttacagatgaaataatatgttgtacagaattggcttcaaaatagtccaagtaaggggtggtctagataaaaaaaaaaagaacagctctgagtagatgcctgttacagttgggcaatgcacacatgggaaggttcactgcactggtctctctgaatatttcacaataaaacataaaacatagtatggaaggttggcaaacacaagtccatgagaaatctctccatcttacccagattaacgagagatacaaccaaggatccacaggtttgatgcagacattctaaaagattcaattataccaagactttaaaggtgacagatttttttcccctcaactatacatttttttttttttttttttgagacagagtctcaactctgttgcccagactggagtacggagccataatcatggctcatttcagccttgactttactggctcaagcgagcctcccaagtagctgggactacaggcatgccccaccatgcctggcttttttttttttttttttttttttttggtagcgacaggggcctgctatgttgcccaggctggtctcaacctcctgggctcaagcctcagcctcccaaaagtgctggattataggtgtgagccactgcacctggcctatattgctatcttaaaatgtctcagtgacccaacaatttgccaaagagcatgtagagcaaactaggctctattcagcatttccatttcttaatgtatctatttgatttcaataaaatttcatcattttgaagatctctcccattagcttgggaaactacagaaacatgcacataactactgagaaggtatcaagtgttcctacactagtttaaaaaaatcattcaacacccacataaattctgatatgcactaggctgaacagctgttaaccactgagaagctgggcactgcatcctctccctgggtcaaaactctatatgctaatcaaacagggtcatgtatttgggaaaataataatccatggtaaaagtcacaaaaagaccttaattttaaaatgagaattcctaatctatacattctttaaaaaatctagggtatataggttgatgtaccttccttgatcaaaactcttacttctctgaagcctgtcagagtattttcaccacaaggcttggattaggtttcattttacatatgcatgcacatgttcacatacccataatcatccttcttagtagtatatagagacggaccatatcgttaccctcttctgctcaaataaatgtcttcccctacaaatgctaaggagtaaaatgatccagaaaaagtagaaatttggcataatcagcactgacttcctcaacggtaacatacatgacataaacacattaggtagactggatgcccaaaggccaatccaacctcatgtcttcctggcatttctcaggcctttctcgtcacccaccccacctaggttccacgtttccaaaaaagttccatgaagattcaggaaaaaacaaaaagggaggaaaactcattttattaaatttacatcatatccttcttcccagggttcaaaattaaataaaaccaaaagaagaaaaccagaaagacaaaagcacttttgtccaaggtggcaaaacacaagagcaatttaactgccattatgaaccaacttatactaaaatagtatttcctggaatgtgtataaattaaaaaacaaaacaaaatgttcatggttacttttactttcagggttgggaactgaatcccacaaacagcagctaaacctcaaaaaaattgtaattccctaattatttccagattaaaacacttctcttgaacacatgtttctgctgttctttggggtgagtgtagggcacagctggagtacagtataacacagaaacagcaagtgcactaagagcatcaaatccttccccccaaaattgtttatctcttccagactcctattcacacttattcccctgacttaattttaattctgcctcttggccctcttaccttgtccctttctaccctactcacttattctctattcatcctcattctctgaaatgatagtcaaaataatacttcatgctaaagcattttcttaaatatttccagatattccaacttgttatgatctcccacttctttaaaccagaagctattactacttttagagtgcatacctatttctgccccatatttatcacatacaacttacgtatgatttagttagcatcctcaaacttagaaaatgattctcgcagcccagcaaaaatccttactatagcagccaatcaatatctattgaaaaatacatgtaccccctcgatacaattgtcataaaagttttcagtgtgcacttaatttgataatgtcacttccatctttctgttttgaaaactgtttcgccgggcgcggtagctcatgcctgtaatcccagcactttgggaggccaaggcaggctgatcacaaggtcaggagatcgagatcatggtgaaaccccgtctctactaaaaaaaaatacaaaaaattggccaggcgtggtggcgggcgcctgtagtcccagctactcaggaggctgaggcaggagaatggcgtgaacccaggaggtggagcttgcagtgagccaaaatcacgccactgcactcaggtctgggcgacacagcgagactctgtctcaaaaaaaaaaaaaaaagaaaattgtttcataagaatgactcatccttcaaaggaaaaattcagatgaaaaggtgtctgcactatgtagtgtgttaaaatttgttctcaagcctctccagctaccctcaggagtgaacagtggcaaactgcagcttaggctagtgaagtgatctgccctacaccatcaagttagccaagaatagaagccacatttcctgactcctgccttgactcctgatctctttccacacatgcaaatacaagttcagcatcccaaacccaagatccaaaaagttcccaaaataggaaactttctgagtgtcaacatgacactcaaaggtaatgtttattgaagcattttgggtttccagatttgggatgttcaactggtaagtacagctgaccctctgtattcatggattcaatcaatcaaacagcaaaaatatttaaaaaacaatgtctgtactgaatatgtacagactttttcttctcattattccctaagcaatacagtgtaacaactatttacatagcatttacactgtattaggtgttataagtaatctagagatgacaaagcatacaggaggatgtgcataggttatacacaaatactatcccatcttatatcagggatttgagcactgtcagatttggtatccacggaagttcgtggaacaagtcatccaagaatactgaaggataactgtataatgcaaagattccaaaatccaaaacacctctggtcccaaacatttcacatcagagagactccacctgtaatggctttcagttctgtaaatcaacagcacatctagttgtgtgaatacatacgtggctaaggttcaaagtactttaaaagtattaagtccaagacaaagatgagatagtattcctcacctgatccaagggtcacacctgacagtaagaactggagtcaaaggatcatcactgtaacccatcaacataggtacagttcacaatattaggagaagtcatgaagtaacatacatacaggacacacataaatttcacctctaaccaggaatcctgtgatagaattcattaaacctattctcactcaactacccccagtggcttatgaatcaatcctaaaggcatcagacacaagactattaccattacaaatttctaatctgctaagaagtcttgagttttaaggaagaaactagtgccaattcattaaaaaggaaggcagaaaaatggaaaaccagaagtctttcattgctgctctatccccataatctaaaacaatacctaggacatcacaggaaaccaatgtctatttactaatgtctatttacctcttagcctttattaaagtgaactcatagtattgacattattttctcatcctcacagggcatttgaccacattttggaaccaagtttaaaatctttcataggccaaaaaaaaaaaaaaagtatataatgactaacatgctttaaataccatgacaaatataattaaatacttgctctcactgaattcaaaatttttagttccctcaaggtgaagttactcattttccattatttctctctaacatcaatttctccaccagatttcctccacctgtgccactactcacccatctaaatgtgcacatgtgtactcaagcattcaatgaattgcttattatgtactactcagcacgaagaagcagaggaaacccagcctttggagtgatatgaacctgactctacttcttgttttaaccaattactaagccttgtgacctcgggaagtcaatcattatgtctagtactcctgttgcctaactgtaaaaatgtgaaggattattacgtacataaaagcataataccaaaaataggcactaactgattgttagtttccgtccctctcctacaacagcaccctgactttggaaactaaccctccacgaactgaaagcattctcagaatatactgtccttaaaaaaagaggaaggaatgaagggaaagaaaagaaaagaaaaaggagagagggaagggaaaaggcaaaaatttttaaaaatacttttggtcctggtttacaggccaccacaataattcaagtaaattagcataatccagagagacaaaaactttttctattttttactacaccaaaaaagctcataataaaatttcaaagtattaaaaaataaatgaaagtaatcccttcccttcctccatcccaacccatcccatccctcagaaataatcactgttagcactctggtgtgcacatatacacatacacatacatacatatatatttttgttgccaaaattttactgcagatatctggaaaataaagagtagcataaagaagaaaaatatgtaatctatacaaccggaaaaaattttaagctgcaaataagtttccacaactaaatttacattgtaaaacacatgatggggaaaaaaaggtctttacaataaatatggtacaaggacaactgaatatccactatccacaggcaaaataaaattggattcctacctcacaccatacagaaaactaacttaaagtcgatcaaagccctacttaaatgtaagcattgaaactcctggaaaaaagcataggagtaaattcttcatgaacttgggttaggcaatgatttcttatgctgtgacacaaaaagcaaaagaaacaaaaaaaaaacataaattggactatatcaaaatttaaaacttctgtaaataataatcaagaaaatgagaatacaatccacagaatggaagaaaatatctgaaaatcatctatttgacaagacactggtctccagaatatatacaaaaaacacaattcaacaatttttaaaaaccaaataactttagaaatgagcaaaggatctccaaagaagatatacaaatgaccaattaagcacctgaaacgattatcagcatcattagccattagagaaattaaaatcaaaaccacaatgagataccacttcacattgactagcatggctataattaaaaagacaattagaagcattggcaagaatgtggagagaatggaacccacaaatatcgctcatggtaatacaaaatggtaatataaaatggaaaacaggcagttcctcaaaaagttatacacagggctactttatgtgttaaatgctgaggatgcataaaggatcagaaattcagataaagcattcccagaacagtgattgatcctgtttgtttaaaaaaaaaaaaagacaatgtactcaacaattaactaaagtacttgtatttctctttacaaaactaagttatgtaagaactaaacattttaaattgaaaattgtttatctggttctttgaactgaaaatccttttatattcccacctgtgagtgtacacaacaaggtgaagcaaatgcattaaacccagtaggtctcaggacaggaagcatttacactcagaggctatcccacagagcaaaatccacactgaagactaaatcatttcacagaaccctagatttagataaacttggagacaggagagcagctgaagagcccttctctttcctcaaggttgtctacacatctaaatcaacttcactgggggagcataggggctgcttaagggtctaagacaaataaattcttctatgcaatactttacatttatttacaaacggtctatcttacactaagctcaaaatattccactgagctactgcagaaaatctgggtgcgaaataagaaaagacaatcagagagtgtatactcataaaaggaattaaaaagaacaaaatgcccaagaatacagtatcctcacaaaaaataccctaaatgaatctagtaaaaatttggcaacccatattctggaaagatattctttacaagttaacctgtatgtcttatgcaacttccaaagtcccaaagaaagtaatacaaaattaagtggttttgagatactagtcagctttttcggaaagagggttagagaggacttacttccttgtattatgaaacaaaaaacgctctgatgaattaaaagggtagtttctttctttatttctctttttttcagacaagtctcactctgcgtgcccaggctggagtgcagtggcatgaccttggctcactgcaacctccacctaccaggttcaagcgattctccagcctcagcctcccgagcagctgggattacaggtgtgtgccatcacacctggctaatttttttgtattttagtagagccaaggtttcactatattggtaaaagggtagtttccaaaaataaaaacatgtacaaggaaatttaaaattctcctattagtgtctggaaggatgaagaatttctactattttaggttgagaaagaaagctaaaggcaaaagatcaacagacaaaaatttaaacaatttataatttctaacttatccaagtttgactccaatatttttaccaaaggataaatatctctgcttcaaagaatcataaaaacattacaacagcctggcacagtggctcatgcctgtaatcacagcactttgggaggccaaggcaggaggactgcttgagtccaggagtttgagaccagcctgggcaacagagcaaaaccccatctctacaaagaaaaaaaaattttttaataaggggggcataagggtgcactcctgtggtcccagctacttgtgaggaccacttgagtcctggaggttgaagctgcagcaagctacgactatgccactgcactctagcctgggcaacagagcaagactgcagactgtatcaaaacaaaacaaaacaaaacattacaacatatgagaatgttcaacttcactaatactttcccaatgcaaatttaagtaaagatagtattttttatttatcagtttagcaaatatttttaaaggatcctccatgctaattggagtgtggttaaacaaaaaacctgcttgttacactgctggtatgactacaactgggaaccttttggaaagcaacctaacaagatatatctgtagtcttctgaattgttcacactctcttttattcttagattcatacaatataaataaatacaaaaagcaaagcctatgtgcacaaacagcaagcatcagaaagtccatgaaaagaatagtacaagtatatagtaaaggaattaacttatactttgcttttcaaactatgttcaatccaatagatttctaaatatggcaagtttctaaaaatccaactccttaagtacactgtaaagacatttatgcacacagctaaaatatactcaaactaagaagtcctcaaaggccgtaagatacactaaaaatataatacctcccagtgaaataaagggaaaagcagaagtcaggtgagaatatttacatatatgtacccattcagcagttctgtagaagtcattatcttctttgggaggccgaggcaggtggatcacctgaagtcaggagttcaagaccagcctggccaacatggtgaaaccccgtctctactaaatacaccaaaattagccaggtgtggtggcaggcgcctataatcccagctactcagaaagctgaggcaggaaaatcgcttgaacccgcgagacagaggttgcagtgagctgagatcacgccattgtgctccagcctgggcaacaagagcaaaacttcgtctcaaaaaataaataaataaataaataaaaaggccgggcacagtggctcacgcctgtaatcccagcactttgggaggccgagacgggtagatcacgaggtcaggagattgaggccatcctggttaacacggtgaaaccctgtctctagtaaaaatacaaaaaattagccgggcgttgtggcgggcgcctgtagtcccagctactcaggaggctgaggcaggagaatggcgtgaacccaggaggcagagcttgcagtgagccgagatcacgccactgccctccagcctgggcgacagagcgagactccatctcaaaaaaaaaaaaaaaaaaaaaaaaagaagttgttatcttcccagtagaagagatgagaaaatttgaggtccagattggttgagtgatatccgaggaccacagagctagtaaaattatggagctagaacttgaagtctgattccaaatcacatgtttcctatgctaccccaaacaaagggagtattttctacagtggcattacaacagaccaagtaacagcagaggtaaaacaagtttcacatgtctgtggctctttgttttttacaagtttttattactttgtcatgggggggaaaacgaaaaattataattaggtcaaggaaagatataactatactactactatcattctgaaggaagggaaggtataccttctaagtcctgcatagtttaaaaattcccattacttgcgagaccaggtgagactgcacagttctagacttcctatcgtgtgccaaaactctagggataatcaaaaaatgtttgttgaatgaacgctaatttaaaatagaaaaagaaattccagatttcctcctcagtacaagaggcctgcaacaacaaacttctgaaataccagcagtctactaattgcatattcaaatttaaaccacagaaagttgaatcaactctgccaatttctgggactctctaaatgaactcttaatacaaaaatacatactcaggctcagcattttttctaatcatttacaaaagtaaaaggacgtcaggacaagttctggtgaaattttataaacagccatgaattgcagctgtagactgccagatacataacctgtatatgacagggggtaccacgtggaaattagagacatcccccttcaccaaaaagattatatccaggggatactacataataaaaaaaaaatctgaaaaatgtaatgggattaagatcctttagaataggctagtagtgatgattttgctttttcagtcccctcctcacaaacaaatgatgatgacactgcccttagctttctatgtgcaaagacagtattaaccttcccaggccaaacttacgactacaccttttccacacgaaatgcaaggcatttctaactccccagattacctcacattcgttggatgccacacaatagattataaagtatcaagatatatattaatttttaaaagttcaccaggagttggatattctaaactgggtttctgattcttaacagtgagaatgaagtcaagctccttatttggtggttagaggagaggatttggccagaaataattcttttaggattgacagacaagtactacttaagttctatcatctcatccaaaaacttgcttcttatattctgcttttaacccgatctacacaatgaaaagccacggagactagttttgcatgaaagcaaaggacttttctaatatgacttcagagcatgccatgctttaaagtccatgttcaaccacttactatcattttccaactcactctctatgggcccatcccatatttcaactacaggtatacctcctggccctttctatttcataagcttctttggaagacaaatctactgatttatgcaataaactttctacctctacttaaccaatttgataatttaatagctggagataattctaaattccccaaaccttaatcaagaattttggaaaaaaagagctatctagaacagttatcttcctgaaaacactgttgtgctaaactgaaacacagccttttctcaagagctaagcagctacttgggtctacattttaatgcactaaataattttataagatcatgtttgaaaccaaaaaacccaaaaaggattgtcaagctaggtcagcttacaaaaccccttctgttatgaactaggaaatcaaacaacaaaacataagctctaggaaatgagcatggaggtgctccatccatactagcttttccttgtttttttcttgagaggagtgactctctgtcacccaggctggagtgtagtgatgcaatcctggttcactccaacctccacctcctgagttcaagggattctcctgcctcagcctcccgagtagctgggattacaggcgtcgaccatgacactcagctattttttgtatttttagtagagacagggtttcaccatgttggctaggctggtctcaaattcctgacctcaagtgatcctcccaccttggccccctcaaagtgctgggattacaggtgtgagccaccgtgccagcccatactagcttttctgaagcctctttactcattcttttgttctctactctagcagctaaagacatctcctaaagaaacaactagtgtgcctccatacaacccctcagtaagcactcagtattgagactaaactgtgaaaagcactaaaataaatgcatcattcatctatgaccttctgagaataccaccacctcatatttgaatagacgtctagttttcatgagaactttcacgcactcatttgatcctctttaaaaaccacaggaaacagggcaagccatcttatcagctctatttacagagagggaaatcaatttgaaaaggttacatagcttaatcaaggtcacaaagtgactgactggccaagctggtactcagtcttatgatagtccagggctctttcctctacactgatcctaaattgaaaaaaaaaattttttttggactgctcctgcaaggtagggctaccccataggcagagagtagctgaaaaattctgtatgtgtctatcacaagaagttgaggccgggcgcggtggctcacgcctgtaatcccagcactttgggaggccgaagccggcggatcacgaggtcaggagatcgagaccatcccagctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaagaagttgacaggcctaaaaggtttcacatttagatgtttctttttttggaaaaggtgaagatctggctgggcacagtggtgcacatccttaggtagttccagctacacaggaggctgaggcagaagaactgcttgagcccagcctgagcaacacagtgagactccatcactaaaaataagtaaataaataaatcacataaaaaataaaaaattttaaaagggggtaaagagccaatgaattgactaagaaatgtgttgtttcaaatcagaatgaccttgaaaagccatagtacttgcatgcaaaaatatgatccgatttaaaaagtcaatatgcttaaaatacaacagaaaaatcaaccaatatatgtatttcgtattactggtttaaaatttctgaatatgctgtaaagagaaggaggtgaaaaacgtcaaccagactggggtggtggctcatgcctgtaaacccagcactttggaaggccaaggtgggtggatcacttgagttcaggagttcacgaccagtgtgggcaaggtggcaagatcctgtctctacaaaaaatacaaaaattagccagatgtggtagcatgcgcctgtagtgccagctactcgggaggctgagatagaagaattgcttgagactaggaggcagagggtgtagtgggcagagatcataccactaacccctccagcctgggtgacagagtgagactctttaaaaaaaaaaaaaaaaaaaaaaaagagagcgagagagaaagaggcagagagagagagaaagatctcaactgataagatactacataatcacattatctcttgcttgaccaacttaacaaatatttcaaaatgtttataaaaatcaaaatgggtcagcattggaagaagttgtaagtaaaattcaggtgttctccacatgaggcaactgctgttaatagaagactatatgacggtattttctcgaagtttggtacaaagatcaaaaatagaatcacaggcaaaacccttgaaaggcttaggaatctgaatttttaagtactaggttgttgatgaatataaaatttaaagatgtgtatttagggtagaaataaccttgaccttggtagctgtggaacttgtgtggttactcgttctgggccctggttttcccaatggtaaaacagaggaggtagggacacaaacgtcctacttcatagaaaagttataagactttaaaggcgatggtttataaaaagtaattagcacacagttttgacacacactaaataataattagctactatggtggaaattttatttctatttaacacttctgacattagcaaatagtgtaccaaacagacatgctttttacatagttacatgattcttctcaacaaccgctcccccgaaagaaagcagtttttaagagggtcactctcatgatttgaagagaactgggagaggaggaacataaatcagttctgtcacattttaaggattagaatttaaacattaaaaacaattttaatatgttcacatatataactatcacctggttggaccatgacaaaaacccacccctaaccataaacaagggtaacctatcatttatcaaaaacaggaaacgttcctatctctcaagatcagcgctctgaactaattatttaacataaggtcatttttacgagttcacatgctgaatggcttacaattaaaagcctcttctaacccaaatcaccatcctccttcacttacctttttttttttttgagatgggagtctccctctgtcgcccaggctgaagtatagtggcacaatctcagatcactgcaacctctacctcctgggttcaattgattctcctgcctcagcctcctgaacagctgggtacaagcacccaccatgccttgctaatttttttttgtatttttagtagcgacagggtttaaccatgttggccaggctggtctggaacgcctgatctcaagtaatctgcccacctcggtttcccaaagtgctgggattacaagcatgaaccaccgtacctggcctgttgcttacacttaaaaaaaaaaaaaaaaattcctcccctctccctagactcctaacctaatcaagttaccaaattcaaaaaattattttatctcacccattcttgcctctttttttcttttttttttttttttgagacggagtctcgctctatcgcccaggctggagtgcagtggcatgatcttggctcactgcaagctccacctcccgggttcacgccattctcctgcctcagcctcccaagtagctgggactacaggcgcccaccactgcgcccagctgattttttgtatttttagtagagacggtgtttcacgtgttagccaggatggtctcgatctcctgaccttgtgatccgcccgtctcggcctcccaaagtgctgggattacaggcgtaagccactgcgcccagcctgcctctttttttctactagggctatcacaattctggccttcatttcatttgacaggaaggcatgggtttataccctaaccagaacaacaatgaacaggatttctgcctccactcctctaatccaggggttggcaaactttttctgtaaagggccagatggcaaatatttaggctttgcaggccacacagtctccgtctcaactacacaactcttgccattatagtactaaagcagccacagacaatattcaagtgaatgagtatgactgtgttccaataaaactttacttacaaaaacttgccttagactgcatttggcatacagggcatagtctgttgattgtgctaatccaaccaactaatatcaactttcctaaattccatcacagatcatgtgatttctgatttaaaagtcactttccttggctgggcacggtggctcacgcctgtaatgccagcactttgggaggccatggcgggtggatcacgaggtcaggagatcgagaccatcctggctagtagtagagatgatgaaaccccgtctctactaaaaatacaaaaaaaaaaaaaattagccgggtgtggtggcgggcgcctgtaatcccagctactcgggaggctgaggcaggagaatggtgtgaacccaggaggtggagcttgcagtgagctgagatcgcaccactgcaccccagcctgggcaacagtgcgagactccatctcaaaaataaataaataaataaaaaataaaagtcactttccttaccaaaaaaaaaaaaaaaatagaacttaacattccttggcctgatactcaaaggcttcctccatgagtataatcttcattaaccttggtcatttcctttttctcatactagattccaaattgtattccatgattgtggctgcttatactgctctaattccaaacctttgctcaatttgtatacagaatgtcctttcttctttccctctaaacacctacatctcccttgcttcccacactaccacctagaactaaaatccatctatcctctaagaagtctccttccctttacccagaaattcttcttcagcagaacttctatggcacttaatctgtatcttttctgacaatgattgctttgtatcttttaccacagtgaattatatcttagatcccctaagcctgtgggcagaatttatttacaagtcatctctgtatttcccacagcactttacaatcaagagataaaaaaacaggtattattgtttcaaagaaaatattcctacaactaaattcctttacataacatagcactgttaataagaccaagacacacttattctgtattaaaatgttacctaaaaactaatgacactggctcaacaaattaagccttcaaaaattagtctccatcttattacccagagggcagcatggcaaagtgggaaaaggaaaaaaggacaagattgacatcctgattctgccattgttgttaaatttctgcttccttatcttgtgaaacagatgttaccactgcctacctgggaaaactaggaataacgactacagtaaattattatgcattatggcttttataaacagaaatttaagaacagctaagttaactgcaagatccctattctgtcaaaaaaaaaaaaaaaaaacacgagtatcttgtgttcagcattatgaatataaagaataaagacatgagcagtctcataacatagacaagttcagtctactgtagatcctttcacagagaagtaatacaacatactgagtgctaaccttccagctatttctaaaaagatggaagtccaaggttatttctaaattattttaagcataaagctaaatatttaagaatgagttataactgagtttctaccaaattaaaacaacgatgcttacaacagcttacagggctcctgatctcaccttctaccactcattctatacctggatcagcatgcatgctcctgccaccccgggcttactgatgaaaatccaacaaaccgggctcagtcccatcttagggcctttgcaagtgttctctacaccttgaatgctcttcctcaagatcttcacaggtcttgctcacacacttcatacagatctcattcaaactgtcacctcctcagagaggctttccctgaccaccctattaatatagacatctctctcccataaccatcactttcaatctccttaggctctttcctttttatatctctttatagcacttgttaactagccttcggtcattatttacttatctgtcttccctagtaggataaaactccctgaaaactgtaatatcttattggctgctgtactccttgtaactaaaatcatgcctggaacacactgagtacttgatacatattaatttttaaattgatgaataacatttgtgagtgacgaggaatattcatcattgcaacttacataatttcttaaaccagctgcttacaattaaatctagcatgttgaggctactcctagaacaggggttcttaatttggggctttagggaatcattaatacccatgtttctggaaggaaaatctacagcttttctttaaatggtccctaatctgaaaaacatcctagaccagtgatttatgactctggctacatcatggaatctcctggtgaattttaaacatacagatgcttggatcccatcccagagggtgtattttttctcatctgtggtacaaccacaggacttctaaaaaattacccaggtgattctagtgtatagcaaaagttgagaaccatgcaatttgaacacaacaaatgttaactgggtgagagtcctcaaaggtacttacagtgggaagaaaacaaaaattgaaaactatgaattttgagggaattggcattgctggcaaacagatcaatacacaagttcctgaataattctgtatcataaaaacattttaaacaaaaactagtagctctacctccacttaaatactaacctgacattgagattctagagcttactcccagaacacaaataacacctttcacttaaaacaacgtatttcagacaaacattcacttcttaataacttacttataaaaacctaaaactatcaagaaaacaacagaatactttttgaagacgaatcagctatattacaactatgaagctctttgtagttttattcctaaaaatgcctttgaagcaacacatttccaccaattaatgtcctcatttagcctcaactgttacacaggatgacaggccctgaatttaggtgaaactaatactgacaatagacacaaaggggggggggggatttcagagatttatttagatcatgtcaaaagggtttgaaaagagcaggtgtcagactgacacaggtggtaaattgttttctttttgaagtcaaacaagcaaacattgagtaataagcgaattcactgataccaaccgagggtttcataagttactggtttttataccttcatccaagtagcccttttaaaaaagggattagcaagatagagagcaaaacaacaaaatgttaagtatttgtaaaataaataaatccagatgcttaaatccacagtgataaataattttaaattattcctggatacttagaatcacgatgaaactcattccatctatccctttctttctttattcttggctgtatggagatacctgctgacacagaagcaccaggtcatgagcacatctgacataaaacattacaaacttaaagcagtattttttaaaatctaaagggcttagggaagacagccatgctcctagctatgaagcctctgtggcttgacttcctggtcatatcacaaggatttttttttaaagtattattcagttcccttgttgagtaagttaatttactaggaaagtgcaaacaaagacatacatgcaggtacgcagctcatcaacgcattttagttgtggggaaagatcaggcttaggagacacgaataattataaaactattagagctggaagagccctctttaaatttcccttctagaaagatgggcacaaggaaatccttagctttctatgtcgttttactcggtaaaatagtacactcttattagtaactttatcttttatcaaaagcctgtggaaataaatgttctgggattaactagtaaatatataaataaagccacagaaacatattcccaaaatgtgggctggaaatgaaaacagaacagcatgggatacaaaaccccactggctgtttacaaaatgtttcgtgtacatgacttttatgtaataggaacagaacactagtataggaaatgaagactacatggaagggctggctacttggaggtgacggagttaaagatttcatgaaccatcaaaagaccaggtcatttatacactagattatcaaaccagaaaaagtctgagtcccctcattccattacatttgaagaaatgagaagcaccaaaaaaataaagtatcaatacaaagaagagagagaaactaagacaatctgaccctgaaggaatcgcaatgtggagggaaaacccagccctaggagttaattgtctaagtcaggtaagaaaagagtgaaaaagttgaacagcacaacagactatttcatgaacaccagatgcctcgatatgtaagggctttaaataaagagaaaacactctcctcatgagctgctgcttcagtgcctagttcttcactcaactatacccccctctaaatcagatgcagcattttgaaatcgacctcactcccttaaccacacttaatttttggagtagaggttaatgaacacaccaggataaaacgatgtctagtttggcaggagtgggagtacaaaagtaaggggaaaaagacaagaaagaacaaagcactggttcgcacacctctctccaccccagttaagctgtggaaagctgactggcatatccacatgcttaaattatacgttactggcaatgagggaagtggggaaatgctaacattctgatttgtcccttgacaaatgagggaggatattcccccctcagggttgcactttaagaatttctacttgcaatgctcactgcagcctcgacctcccaggctcaagtgatcctcccatctcagcttcccgagtagctgggactacaggtgtgaaccacaacatctagctcatttcttgtggtttattgtacagatgggcgtcaccacgttgcccaggctggtctcgaactccttgagctcaagtgatccccctgcctcagcatcccaaagcactgggattacaggcctaagccaccgtgcccgggctctcaccacaattataaaaagagagagaatgaagggaagggtagaatttcctctttaaaagtggtctgactcaccaaaccatcttcactgcaaagccttaaacagtaccagaatacaggaaaaggatattgtatgcttttcttagagctgggacaaagaaatgagagggtgtggtggggggaaggagtaaacaatcagagcataagtaacccatattatacatggtttatatgatgccatctccaggtttaatctttcccttttattattttatgattattttaatggagatggggtcttgctatgttgaccacactggcctcaaagtcctggcctcctaaagtactgggattacaaggtataagccaccacgagcagcctaatctctcaattttagtttccttaccataaaacagacacaatgcttactatacaattaaaatatgctataaaatagtaagtgaaataactatactaaaaggcattcctggcattcagaaaagttgatggtagcatcctttccccctcaaagataggtacaggaggccctaatccaatagttctcagccagggatttttttttttttttttttttttttgagatggagtcttgctctattgcccaggctgtagtgttgccatctcggctcacagcaacctccacctcccgggttcaagcgattctcctgcctcaacttcccaagtagctgggactacaggcgtgtgcgaccatgcccagctaatttttctatttttagtagagacaggatttcgccatgttggccaggctggtctcgaactcccggcctcaaatgattcgcccacctcggcctcccaaagtgctgagattacaggtgtgaaccgctgctcccagccttggggattattttgaccttaccccaacccccaaaagggcacatataataaagtctggaaaaattttgttgtctcaactagggtgagggaaggtcctactggcatttagggggtagaggccagagacgccatcaggcattcttacagtgcacagaatagcttcccatgacaaataattattagtcccaaaaggttaatggtgcctctgttaagaaaacctgcctaaaaaacattcatttttggaaaaaccacataaacacagaagaggagcataacactctagttcctacagtctattaaaaaaaaaaactatttaaaagatattacaggctaagtgcagtggctcacacctataataccaacactttgggaggctgacacaggaggattacttaagcccaggagtcttcggctgtagtaagctatgatcacgccactgcaccccaacctgggtgatagagtgaaaccctatctctcaaaagaaaacatactctaagaacaatcctttcttgtgatagctattactcaaatgacaaaagctgggggaaataccttgtaaatatcagaaaaaaacttctcctcctaagtagtttaaaaatatgcagataggcgggcacagtggctcacacttgtaatcccaacacttttgggaggccaaggtgggcggatcacctgaggtcaaaagttcaagaccagcctgaccaacatggtgaaaccccatctctactagaaatacaaaattagccgggcatggtagttcatgcctgtaatcccagccacttggaaggctgaggcaagagaatcccttgaacccaggaggcagaggttgcagtgagccgagatggcaccactgtactccagcctgggcgacagaccgagattctgtctcaaaaaaacattaacaaagaatactccagatcatccagaaagtcagtatctgatagtgtttatatggagaactcctgcactggaatgtaaactcctaaccctagatccatctcttctcaggtcttcctatcacctcagcctacagcagtcaatccttccctctaaccactccctcctcctaagatttcagcatttaatgcctgtaccatgtatctaatacttagtacacaatgcctaattcttgttttttaatttttatttaaaatactaaaacgaaacagagacggggtctcgctatgatgcctattctggtctagaactcccgggctcaagggatcctcccaaggaactcggcccacaatgtctaattctaatgcttcctcttttacttgaaagtggaggggaaggctgggagcagtggctcacacctgaaatcccagctactcaggaggctgaggcaggagaatcgcttgaaccagggaggtggaggttgcactgagctgagatcacaccactgtacgccagcctgggtgacagagtgagactctatctccaaaaaaaaaaaaaaaaatcagtcacataaattactcattgaagacaggaaccaagttttcaattcttcttaagtgttttcatcattcctgatctaaccaccagagaagtgtttccttgccctttggtggcaaggttaatcttggtgataaatgatcctgaaaggctagtctccaaataattagaaccttgaaaatgtttatatttttctctgctcggaaaattctggaaccccttttctaggactgccacaaggacacttctgactatcctcaatgatgacacattttagtttccattcagattaccaattatggtaactcccctgatcactgtttaagtactacttattaaaggaacaaacattaagctattgctcttggaaggccagcctgctaggaaacacccaagagcaattctgtaccttatccttccctaaattagtcagccaatcttaccattcaaggatgaaattaaaggcatttatctcatctagtaataccatcagtaaaccatggaagcttaaataatctaacattgctttggacattatggaaatgacaacctcagcacctaataaaatgtaaaaccaaatatatacatatcatgtcaatgtcttgaatgtacaattaccttgaaaatttcaaagtcacctcacatttctcaactcttggacctgagacctgcttactatcaagttatcattgagaacaaattaagaattctcaattgagaggtcacctgttgcactaagcaaaccgcctgcaaatactaaattagcttttctacttacactatcaagtcaaattacttctggtaatgcttgagtgtatttgcatgagatcaatttcatatacagttgggcagaagcaaaatgagtcttaagcaagcttcattctgttttcatcttacaaagaaaagactggcctgtcctcccagccttttgaataaggatcttgaaaaattcactacgcacagggtgtgcccaaagaatacttgctggaaaaatatgctgggagagtgccaatttaaaaagaaaaacattttcgcccagttggaaatctagagaaagaatagttgtagcaattcagctaaaaactctcaagacctgaagaaaattttagaaaaaccccagatctttttgttattggagtaaaattctatgaaaggcaactaaatgaatcaatgaagtattcaactatgctaattttatgcacctaaaaagcagtaactgaaattctgcctttgacatttgacggtgcaaaaagcactaagtaccttatttgttctacataaatgaactttataatctgcaatagtttttaaatcaactgtttctgggaaataatgaaagcattttattttcctttttaaaaaagcaagaataacaaaacttctttattgttttgctttttgggaggaggggttgggggaattgggataaatttttgttttccattagagacttttttttttttttttgagacagtctcgctcagtcgcccagctggagtgcggtggcacgatcgatctcggctcactgcaacatctgcctcccaggttcaagtgattcttgcacctcagccttccaagtagctgggattacgggcatgtgtcaccatgcccagccaatttttgtattttttgttttgtttgtttttgagactgagtctcgctctatcgcccaggctggagtgcagtggagcaatctcagctcactgtaacctccaccacctgggttcaagtgattctcctgcctcagcgtcccgagtagctgggattacaggtgcccgccaccacacccggttcatttttgtatttttagtagagacgaggtttcaccatgttggcaaggctggtctcaaactcctgacctcaagcgatctgcctgccttggcctcacaaagtgctgggattacaggcataagccaccacacccggccaagagacttatttctgaagcataacactccagcaatagcttgattaagctaaaaagatacccatctgttacaggcctttgtcttcagtctctcactacaacacccacccctttccaggtccactcagaaccttacgctcagatttttttttcactgcaataagtgaacacaacaaaaaattacagttactacagggacacactggtcccaggttgcctcatgagaaaagcaggtgagtaggcctgctggagctttgcactaactctatggaccctgtggaaactgcatgcaatgcaggctacatggagggtcaccgggctgctcactatacctcagcaaagcaaaaggcctgcctatgcctatgacaacagcctttcccatcacagcctggtcccaccacaaaacaacaagcaatattcttccaaaaagtacagtcctaattttaaaagtgaggaactcgagcctaggtagacaaaatgtaacaattcttaacagttgtccagaattctttctactctcttactccccttttagtactaataccacaaatgctaagaaaaataacctctagttcatccttcaagttttctggtacttgccaaatcaataaaaataacatgtgaaatgttaatcacaaaccacctactcagacactgaaatgacacaaatacagactaagtagatgaaaaccaatcaggatagtcctcaactattctttcaatatcctttcaagttctatggtaactagatttaccagcaagagttttcttgaggaaaatactaaacacaaagcacatgcttacaattcacctgtaagcacaagttaagaataatggagaaagaacataaaataccttcataactcaaaagagctccttttccagcaactggggaaatagttgtttggggcttttccacataagatataaatcatccctttcgaatgtcaaaaatgtttaatttagccatttgatggggaaaaacctttaatagttcacttctctagagtgtttattacagtaaaggaaaactatttaaacttcccaccatccctcctggtcaatgctggtgtccacccacgtactgtgtggtcagagagctgtctaaaggagttacagcaaacagcaaagctatgtgccttcaggttgctccatttctcaaaatagaatcttttttctgccctctctctatcagttccaggagttatcttctattcagaagatagaacatgtatgaccacaagcaaattatttaacatatctatagtcttgggtctcaactgtaaaacagggtatcatcatcatatggaagatttaaagacaacaaacctaaaccacctaacatacagaaaggtgtgatcaataaatactaattcctttcttttcttccttttttaaaaaaaataacttcaaccacttcctagatgttagtctgccctagcaaaatgtccctcctctacccatccaactttttttaagacaaggtctcactctgctgctcacgctggagtgcggtggtgcaatctcgactcactgcaacctctacctcccaggctcaaagcaatcctcctacctcagcctcccgtgtaagctgggactataggcgcatgccaccacgcctggctacttttttttgtagagaaggggtttcgccatgttacccaggctgctctagaactcctgggctcaagagatctgcccgccttggcctccccaagtgctggaattacaggagagaggcatcacgcccatataacccatccaacttctactccacaaaagaaaatgagtaattttcttttactcatattgtaggcttaaggatgtatctggttaagatacatatggccattatacctttcctcaaaaaatacgtattaccaaattaatgtataatagtcttctgaatataaacataaatgccattattttacatgatggttggtagacctcttttcatcaaccaaatctaatgaacaatttgattctgtttacactaaaaaagctagtgcttatgcccaggagataggtaaagagcctagattattatcttgatctcttattagctgtttgacattaagttacttaaactttccattctgcagtttgagtctgtaaaattaaaattatctatctcattgtactgttggaggattacataaattaatttgtaaaaagctctttataactaaagagctaaaaacaattcaacaaatgtgggctattatttctctaccagaatgtctcaactctgttgtctgcttaggcaaagttggttaaaaacgttgttcccagcagggcacagtggctcacacctgtaatcccagcactttgggaggccgaggtgggctgatcacgaggtcagcagatcgagaccatcctggctaacatgatgaaaccccacctctactaaaaaaaaaaaaaaaaaaaaaaaaaaatacaaaaaattagccgggtgtggtggcagacgcctgcagtcccagctacttgggaggctgaggcaggagaatggcgtgaacctggaagttggagcttgcagtgagcccaggtcatgccactgcactccagcctgggcgacagagcgagactctgtctcaaaaaaaaaaaaaccttgtttcctagctcacccaaatcagttcggtcaaaatcctcctgggttctcaggtttaagactaattcagtcccaaaggccctaaactctgccaccctgtttcttcccaggatacatctcttgtaagtacctgagaaacaaaccggaaatagcaattaaagggagagcaaggaaatggcactacatatacaagggtattcaattccctggcacatgccctctattcttttaggcctaagtaaaacaacttataagaacatgattttaaatgaactatgacacctctctctagttgccattccccaatctccccatttcccccgcccccaaaacaattttctctacaattcctcttacctgagttctgaatataatctacatgattactacaatgctactaaataggctgctagagcaaaccacaacattcacaatttaatagcaaattttcagtatattctgcttgcagagcagaccctacaactttcatcaggcttaaaataatttcaaagcaattttgtctaccatggtacaagaaacctttcttcacacttatagaaatataaaatcaaacaggacacagttgccacaaagccttaactaatgagaatcaaaactggtaagatttattcttatgtttactatatactaaacccccttggtttcaaatctatataaactcaatgttttctttacattggatatgtaagcataattttcccagatgcacaatagaaaattggagaaagataattcactggtaaacatgaaagggcatgaccttaggcatgaatttctacccagcttgcaaaataatctagtccactttggtccatgtttagggaggtggggaaatgaattaaagtaccatccatttataacagaatgtggacccatgctttcccttttctagttaaaactatttgttttatcacactgacagagcctaatcgggggctctacaaaggacactccaggtatacccaacaaaggaaaatatttaaataaaaattaatgaatgcctacctcatctgctccttctccatcttgacatatccatccaatgtagttacccctgccaaacaaaaatctgggaatcacccatggcacctcttcccttttgctcaccacatgcaatcagccacaagccctcatcacccctacttccaataaccaattctcttaaatctttcctgccaaaggctgagtccaccattcagctaactggttagcctaaattcacctctattccccttctccacacaagcggggtctgaaaaatacaaatcatgtaagccatgtcaatggcttcacaataaaaattttaactttatataatcaacaaggccatctgtatgatctggcaactagctacctctctggtctcatttctcactacttgtaaaatacactatactttgctctgttctttgagagtcaagcaccttccatttccaggaccttagcatgtcttgtttcctcaatgagcagcaaagccccttctcacccaccaattccttcttatccttcaggtctcagcttacatgtcacttccttcagaagactcaccatcacatccccatcacatgctgcctagatatatccaatatgcaccctcagatcactctgaactttgttcctgtagcacccacaacaatcataaatatatcatctatgtaattacccgcttaaatattaatctctctctaatctatattccccatgagggcaagacaaggattgtatctttcttaaccactggatccctagcatcccagcatgtagcaggcattcaatgtagagttaatgaatgaattaatcaaatccaaactcctccaatgaaggttttcaggtctctacagagcaactcctcccccatttatagaagattatttggaagcttatttcctcactgttttttattttttcagacacagggtctcactttgtcgcccatgctggagtttagtggcacaatcatagcttacccaagccttgaactcctaggctcaacccatcttcctgtctcaacttcctgagagctgggattacaggctcaagctactgcacccagccatttcctcatttttaacacttgctggaacttgtaaggaatacagaaaccttcatttttaagactctagtaaagaacctggactctcatgagctcttaagattattttgcaaactgagtactgaaatgcttctggtaaccatctattgctgtagtcagccaggcttaaaacttcaatcacctatgatgatccctcccgtcattgcccccacacatcacagttattaagtcccattcaatttacctctacatcatttctggaattatctctttttcttctcacattacatttaccatctgtacctataatactatgtcttcaacatatcccattcccatggtgccaccaaagccctatacctttcaacttgtcttctctgtgtgccctgtgctttctgcctatactgacctctcagtaggtcacaatcaaaagaaaactgtctatcaaaatctttgccaaccttcaaggttcatttctaacatcactaagtgccaggcactgttctaaacattcatctttgtcttactaagttcttcactcccttcactctttaaacttcttgaggatacaaacttagcttattcatctgttatctcttgtgtcttacacatttacttactccataagtacttattatatgactttaacactaccataaaagagtacgttcacttcagagaacaaaaacaacaatcacaaggtggcagaaaacactatagcaactatatctacggtaaatgggtaacacccaaattcctgatgcctaagttcctttcttcagaatcccacaacaagcactaagaatgattttcactacctacgtttcttctcaggaaaaaaatgagaagagaatagaagaaaaaaacacaagttcctacttctgccacttgacgtcatgtgcagattaggagaaaagccaaggggcattaaatcaaaggtgttcaacaaatgaaagtttactcagctctgaagtaaattctgtaagaatacaatgaaattattcccacatttctatcccatacatcaagaaataagataatcactttaatggactatgaaaagtaaatcaaccaaagaaatgaatgaaggcattagaagaaccaaagctttaagtcacaagtcaagaaacctgttttgtttcaacttataccagtgctttgctgggttctttgcctcagcttcccccaatgcaaaaaaatggtgatgagaatagtttcattcatgttatttaaagataaacagtcacatttcaaagtagtttgagacctaaaggtcacgtagggtcagctccctcactttaattagaaaaatggttacattagtcctatagctagtttttagcagaagaagggtttagctgagaagacttgggtatcctggctgatgttcctcccaacccaccactttatgaaatgataaagagtagaaaaatgatagccgggtgtttggtgcatgcctgtagtcccagttactcctgaggctgaggcaggaagatcacttgaacctgggaagcagagactgcaatgagctgacatcacgccactgcactccagcctgagtgacagaacaagactctctctcaaatatatacatacatacaaacatacataaaaagtaaaaaatgacaaagcaatttgattgccactttggcaacatcatctgtgtattcttaataaattcaagtaagagttacttttttttatttttatttttacttatttatttgaaatggagtctcgctctgtcgcccaggctggagtgcagtggtgcgatctcggctcactgcaagctccacctcctgggttctggccattctcctgcctcagcctcccgagtagctgggactacaggggaccgccaccacgcccggctaattttttgaatttttagtagagacggcgtttcaccgtgttagccaggatggtctcaatctcctgaactcgtgatccacccacctcagcctcccaaagtgctgggattacaggtatttttattttttttttgagacacagtttcactctgccacccaggatggagtgcagagctgagatttcagctcactgcaactcctgcctcctgggttcaagtgattctcgtgcttcaacctcccaagtagctgggattaaaggcgtgcaccaccacgcctggctaatttttgaatttttggtagagacggggtttcaccatgttggccaggctggtctccaactcctgacctcaagtgatccacccaccttggcctcccaaagtgctgggattacagacatgagccaccaagccagaccaaaagcaacaatatagaacattccaaagtatctaaaaagcaaaacctataaacacactagtaattcattttaccatgaggtcttcataaactccaagaggataaaattccccaggaggggctaggcacagtggctctcgcctgtaatcccagcacttcggtaggccaaggtgggtggattacctgaggtcgggagttctgagaccagcctgggccacatggtgaaaccccgtctctactaaaaatacaaaaattagccaggcatggtggtgggcgcctgtaatcccagcttactcaggaggctgaggcagaagaattgcttgagcctgggaggtggagattgcagtgagccgagatcatgccactgtaactctagcctgggcgacagagtgagactctgtctcaaaaaaaaaaaaaaagggctgggcacagtgacttacacctgtaatcccagcactgtgggaggccaaggcgggtagatcacctgaggtcaggagttcgagaccagcctgagcaacatggcaaaaccctgcctctactaaaagtacaaaaattagccgggcgtggtgacaggcacctgtaattccagctactcagaaggctgaggcagcagaatcacttgaacccgggagccagaggttgcagtgagccaagatcgcgccactgcactccagcctgggcaacaagagcaacattcggtctccaaaaaaaaaaaaaattcctgagggtgagaaaactcactgcaatcaagaccatccaaaattcaaataagcgctttagtgtcactgaactgcatccatagtctatttttacccaaccctgatctgaaacagacttcaggagactattagacaaaacacaggttagcataaattcaaccagaaataaaaacatgaaaatagggaaacaaaatgaagctattaaaaaggtacaagcttagctctaaatttccagatgtcaataggaaaaaagaaacctagtgaacaattacagcacccaggtaataaaaacagactaaaagcttagacaaacatacaattattcttggctgcacatctttctccctgaggtctttataaagaaggcattgcagaatacagagaatatcctcaacaatatttcagtaatcacaatgaaatgttttatgaggttatttttatactgaacttcaagataagcctagagtaacggttgggagaaaaaaaagaaaaaaaaaatttcggggacagagagaaaaaaagaaaggaaaaaaaaaaaaacttaggagagagagacctacataatgtggtccaggtacccagaacactgctgatttaagagcacaattaagagaatttctggaaaaaaaatattattttaacaagtagttactatatagaagtttataagcacaggacccagaaaatgaaaagcaaatttagcaaaatgtggaatgggtccaggaattaaacaaaattgcagggaaaaaaaaacaactctaagagggaaaaacaaagaatataaaagaaagaagagcaagcacaactcagcaagtacattacatacatatgataattaaatgcttttatttctacatctacaattaagaattaaacattaagatatttacggaagcatgcagcttccttcttaatcccataatcaaggagataaaatttaaattcctgtaccttccacagtgatgaaatatcattgtttagtgacatcatatcaaacacaacgtactgcagaattttcaaagcagttatatttccactgtaccaagaaaggaagatatgtgaaatatttcatgaaaattttccaagaagagtttaaaacaaaaagggtaagagtttttaaaccagacataaaatcagtcaaccataaaaattaatttaaaaaactctctctaaagtctcatttagcaatatagtttactgtcaagcataatacaatgataaacatacaatttgctaaacattcaacaacatagaaaaattaatcattctatagctagcatgtaccaacgacacagaatggatcactgtttctcctctgggaggtgggaaagaaaaaaacaattgaattcttagtgaagaaagggattataatttccacagaactatccacttgtaatttaagcaacatcatttaaaaacagctcattccaacagtctcctctactaaatattttcatcagggctgcctagacgaaacctagcccaccactctatcttgggcaaaagagtaaaatacagaccagctactggaagggtggggggagccaaaattcaccagctgggtcaagttcctgaagaattaactaactacattctaggattcatttctcagcatcaaagaacaactttttcttcttctttttaaattaaagcaatgcctccattctcattgtctggtcaactgctgaaaacctttaaaacactcagaagatcaacaaacacttggctaaataaataccagccttaagagtcaacccggtgatcttgctcaacaagaactttaaagtatttatgctttactggtggttttagtttaaatacaatttttttttttttttgagacggagtttcgctcgttgcctaggctggagggcaatggtgcgatctcagctcaccgcaacctccgcctctcacgttcaagcgattctcctgcctcagcctccagagcagctggatgtagaggcgtgtgccaccacgcccaactaattttgtatttttagtagagacggggtttctccatgttggtcaaactggtctcgaactctcaacctcaagtgatccgcccgcctcagcctcccaaagtgctgggtgggattacaggagtgagccaccgtgcccggccctaaatacaattacaatgtgcaaaaagagcatgtacttcagagtactttcagtacccaaatatgatctaacgcatgaaaattcaactttttaaagtatcagttgatttaattgcaagaggattcaactgatcccaaaatgtttcctaaaagccatcctttggctgttcttatacacttcacacccttccaaaccataaaccattatgtgagaagaatgctcagaactaagtagtgaatgaatggccttaaggtttttccaagtcattaaactatcctacagaataagaaaaattctcaggtacttttatttcattggtttgtaacgcttacctacaacagtaccaaaactcagaaatgttttcaatgcaacgtatcctgaaaacaatacgcttatagtgtctaggtgcttttctgttactcaaaataagtgcatgcaatttaaaatcctttaactacagtgtttattatacctctaagcacaaaatatttaacgttaaccaagatatttttaaagcggtgatttaaacagcaaagttagtggggataatgccatgaatattagcaagctgaattaagctactaatccatttaaagaaagatgggttacggaagaagcaagcctctgaagcatttgctttaaatctaaatacagaagtggacttgagcacagtgaactaacaaatgataatagaactaggtctacaaggaagaaattcagcaaaaattatccatttcttccttcaaaatagaaaaaaaaagtttcatttcagatacaatatccatgcagataatataaacaaaattgggaaaccagaaaatttacttttaaaaatcatagctgtctcaacaaccaaacactccagtgaaaatcttcatcaccttttaatacagtcaaggaaacaccaattcttcccacatattcatctttttcagccttctctagtaagccagcctctagcaaagagaaaatgaaagatctgctagtcaattatcctgcccctcttttccaactcctcatgctctctctcaaatctgatattcctaaggagataaatgcacttatttaacatgtatctttaagtatgttataatatagtactgctttatttaattaagtacatagatgctgaattgggagtgacaggaatgaaacgtctctgtctccaccatgccaatttggagtgccacccataaaaagcttatgtaaaattttctcaaaccaacagatttagaaaaaccagtaagatgaggtgggcggatcacgaggtcaggagtttgaggccagcctggtcgacacggtgaaactcagtctctacttaagaaaagaaaaaagaaaaaaattagcctgacttggtggcgggtacctgtaatcccagctacttagggaggctgaggcccgagaatcacctgaacccaggagccagaggcttcagtgagctgagatcgcactactgcactcctgcactccagcctgggcgacagagcggaactgtctcaaaacaaaacaaaacaaaaaacaacaaaaaaaacaacccagtaagaatttattccaaatacatcaatacatttaactcagcttaacaaatctgcttaaaatgggcttttttttttttttaataggaagagagtcaggttgtgaaactagactgtgcttggaggcgatgtattaaatattctgaagcattttctaattgtcagtccttaaaatgtaagaaaatctcaagtgttaaaattgaagactgggtgtgctctctgctgaaagttcaatcaaaagcaactgtaatttcctacaaaggtaactaggtcaactcagcatttgtccctgcttactggaaacaacaaaatctcaacaatcaggccattaacttatcatgtcctatatatagtttcaaaagaaatctaaattcactcttaaagaggtactagtacaattttacacataagatgtctcctagttatttttcttagacttcaaaaggaaattaccaccatttagactacaacaatacaaccctacagcaaaagtatcttccccttcttcactagcatgtatatgcactcatctacccaacatcagggaaaaaacaaacagaacctagacacctatgtacaaagaatcacattctctccataatggcgattcattcattcttccttgtgccaacatttctcaagaatgctatcatgcatgaggtctactcacaggggtacatgacgctgctcgggatcagctctggtcagttcttcctcttcaatatcagactcccctcctgaactactgtcagtgacatctgaatcaaatgcctgttcactgcacctcaagttggctatgccactagctgtaaatctctccaattcttctgaaattgaattgcttttcagaaagttgctaagtccctctgaagtggtggtctcactggcagcttttctcaaggcagcttcagcctttcgagtcagcatcaactggctccgtggtctcaaggattccaagtttggcagtttgctcaaagtcttctccaaaaatccacccagctgatgttgtatatgcctctcaacctgcttggcttgcacaacctgtaagcgcttttgtaatctgcgggcacggctctcaatgtcagcctgtcgccgcagtaaagctgttatccttgtgtcagaatctaaagcactgaaaagaatggaagacaggggagactttttaccctccaatttgacaccccccaagttagagctggagtctgtaccaggtgataatctactgcttccttgaagtgccggctgttccatggaattgacagaggatttgtttgcagtgctattattgctatacaaagttgtgtgttctacatcaaggcttctatgtggaagagtgcaattggtcataccccccttcaagtccccagattcagatcctcccatttcacccccatgaagagcagatgaagtgagagcccgttttcccccattgagggaagtggaattgtcatgatcagaatgtgttgaacttttagtcaatttcttagccaacccatttacaggtgcttgtggcagagctgtctgaccactcgtattcatggttctaagattttctaaggaaaactccaaaactggctgtctccccaacagctcagctcggagttcataggactgagataagagaggatgagatttaaggactgtctgcttgctgaagaccccttgcaacttcaaagactcctttgagggaacagatgttacatcagagcagagataagatgccaccagtggttgcagctttcccaagtcttccttggtaggattatttcggaaatctaggctgggatcctctgcagcaatggcttttcttttggttccgttggcagcaataaggatgttggcgttgccgttattttcggcactgccaggggacaaggtagaggatgggggagccagtttgaaccggatatggtgtgcttcagctgctgcgtcagtgagagcgggcgccatcgcagccattcagcacagagagacaggaagtccagcctctcccgatgccgaggccgaggccagctccacggccccttactgcctccccagagaacagactagaagagaaaggagaaaagaatattagaaatacaagcacttttaaaaacatgtatatttttaacaaaagcactacttgaggctgttgtctaaactgcctccagaaagaaaacactctggagctaactgtaccacagttattctagagacccaaatatctttcatctgggagaaagggggaggcaaaatccctgcacaagggaaggaagaattgcacccttcttgtcatttgttaccacagattgaaaggtgccaaaacacaagttcgattcagagaaaatcacagattgttaaaattaaatcatctccattaaaaaaaaatctctttaagcttgttgaaataaatggatttaaagcaagacacatcaaactaagcaataattaaacagaaaaaaattagtaaggaattcccgtgttcactaaaaaaagtatgccaaatatcacaggtctgtgcatttttctggccagggaatccagttttcatcagcttctcacttctctagaagtatagattatactacaaagctaactgtaccacatctgtaataccaacttgtttcatcagttttcttttctttcagatcaaagtggtcatcaatatcttctctactggcttcttcctctcagcctaggaatttactcaagtatcttctgccctcagtacagcctctctctcatacttaattgcccaaatatctctctttccctttaccccaaaacttctctaagaatagtataaataactgtctctgcactcttcactcttccataatctggatttcaccccctactgctctggcaaaggtgaccagtaatcttattatcaaatccaatggtcaaacctcagtccccattctatctgacttctctgaagcactggacaataccgaccttcttctaattctttcctgatgtccttgtactatcatcctcttctcttcctcctggacccttaaatgctggtgctgcacaaggtcccttctgccctcttctctctcaacaaccactagtatggtgaggtttcttaaccataagaaaaacttctgagctgcactaatcaagattcctataacctctatgttcctcaagccccctgaagctcagaattcactttctccttccagcacactattccgcatcctgtttcattaccttaagtaatgacactgcttttatttagtaaccaagctaaaaatctcagtcatttgcctctgtttgatcccccttgatctatgtggtctgggagccaaaggaaacatacgtaaagaactaagccagttgttctttaaagtgtggtctctggacttctggggatctcacaggctattttggaggttcgtgaaatcaaaggtattttcatagcaatactagaatattatctgccttttacactgtgttgacatttgcaatcagagtacaaaaacaaaggtgaacaaaactgctggtacattattagcacaaatcaaggaagaggcaccaaactatactaatagtcattatactctccactcagtttttctttttttaagggagttccacttaagatgtccttgatgaacagcaaaaattatgaattatcttgagcctttagtgcattttttaaaaatattctttgtgatgaaagggaaagtatgcataaagcactctgctgctttatgaattctcaggaaaaagcacagtacaactgagttgcaaaatgaactagagctttgttcatggaacacgatttttacttggcagaactactgacaaacattatttgaaacctgcttcactagcagacatttccttgcaaatgaacaaagtgaacctgtcacttcaaggaagaccactgacgatatttgctgccaataataaaatctgaattttttaggcaaagattagtgtttttgaaaacttgtatcaacaatcatgaacttaaacattttcccaatattttatttggtgggtgtggatgtgtgtgtgtgtgtttaacagagtcttgctctgtcgccacgctggagtgcagtggtatgatctcagctcactgtaacctctgcctcctgggttcaagtgattctcctgcctcagcctcccgtgtagctgggactacaggcacgtgccaccacgcctggctaatttttgtatttttagtagagacagggtttcaccatgttggccaggatggtcacaatctcctgacctcatgatccgcccacctcggccttccaaagtgctgggattacaggcctaagctgccacattcggactttctgaatattttaaaagccatttctgatttaacagacttgtgacgatattaatgaacgtgaatttttgattgcatataatgtaatgtgtaacatttggaagatctgcataacccagtgaacgataaaatgtccagtgaatgtcaggaaatcatgcatgggtaaaaagtttaagtgcaagacaaatcatttatttgttgctgttattttgaaacagggtctagctctgtcacccaagctagagtgcagcggcacaatcatggctcactgaagcctcaacctcctgggctcaagtgatcctcctgcatcagcctcctagtagctgggactataggtgtgtgccaccatgcccggctaattttttgaatttttgtagagatggaatttcattttgttgcccaggctgctatcaaactcccagcttcagccttccaaactcctgggattataggcataagccgccatgcccagcctgaattacttattaaatattttttaaatttctcaaagtttataagaaaaacaatttatttgctgttctcaacaaattttaagagttaaaaaagggtcctgagaccaaaatgcttgtgaaatcactggactaagcacccccctccctgccccaaatgagggcaatctccaatttaatcaaaaatgcttatctttggagcaataccaacacaggatggtaggccctacaggaccacagtaagcttctttatagtatgacaatttgaatcattaacataaaaatactcaaataaatgactgagaaaacattattcataaaagcaccaatatacatatgggtcgaatctgtcttattgctgtgtgtgtgtgtgtgtgtgtgtgtgtgtgtgtgtgtgtgtgtgtgtgtgtgtttctgagatgtagtctcgctctgtcgcccaggctggagtgcagtggcgtgatctcggctcactgcaacctccgcctcctgtgttggagtgattctcctgcttcagcctcccgagtagctgggacttcaggcatgtgtcaccatgcccagataatttttgtatttttaatggagatggagtttcaccacgttggccaagctggtctcaaactcctgacctcaggtgatccgcttgcctcagcatcccaaagtgctaggattacaggtgtgatccactgtgcctggcctcatataattattaacaccaaaagtttcttgttccagggttgtattttaaccaacactctttatgaactagattttcagggcttatgtagttttctcctgtgggctttctggcatatggcattctgtgtggcacaaattattctatgttgtcttttcccatttctaactttaaatataatactaattactaatatattattaaacattgtgttacagaccagttgacagtactaattcctgttattaaacattgtgttatagaccagttgacagctggaccaatatagttgttaaaaatattttgagtcacttttataatatgcaaagggtttttcccatggacaaacgaaaatcactaccagataattcccatcaattcaatctcctccccttttgaatgtcaatatgtagttgatatgagcaatgcaaggaggcatattatcagtgccagatgattaatacaacatgtgaagagtaattgtaccctactgcctgacagcactacagtaagacttagcaagggcaggaaacagcttccctctgaggacccaagcaagggcacaaatatgctttatgacttacataaaacttaggaaaacccaggctcactccagcacaaatgaaaaagagggtcataattaacatcacatcacagaaggtgcttaagtagtaaacttctcaaagttattctgagattattcaattctttaaagcttacaactttaagaaaaaatgccggcttaaatcccatctactccagctgggcacagtggctcacgcctgtaatcccagcattttgggaggccgaggcaggcgtatcacctgaggtcaggagttcaagaccagcctggtcaacatggtgaaaccctgtctctactaaaaatacaaaaatcagctgagtgtggcggcgagcgcctgtaatcccagctacctgggaggctgagacatgagaatcacctgaacccaggcagcagaggttgcaattagccaagattgcaccactgcactccagccggggcaacaagagcaagactccatcttaaaaaaaaaaaaaaaaatcccatctactccaagacttctctgaaatgatgtctatgaacttgacattaacatatacacttcaaagacaatagtttatttgatttgcactttatccttggtctcaatatccccataggatacacagcatagtgtagttactaaaacaatcatctaagtaagggggtgggggaggagagagagtgcagagaacaggaaaaagtgaccactttttccgaaaaaattcccattcctaattcctaaatcttgagatttctataccaaagaaataccatttattgacttgacatacctttattgactcgaaatactatgctaagattcaacattactcccaaagatattcataagtaagaggagcactgactcaagtgagcaaatctcagttcccatcctggctccacctcctgtaggttacttaactattctgttctttaagtctcctcatctacaagtaacagagccttcccgacaaggatgctatgatgatgaaataagatactttcaattacttggccacgtacctggagcaaccacccagtattatttgcacttttattacactggaaacaaaaaggaaacatagaaggaatgaatttccatggctttttaatgcacctagtttgcaattagctacaattgccataaaccaccacctaagtttagtactttaatcttttccctgttatgtctagacttacttttaatatttcatgatgttgtttataataaaaagaaaactgaatgccaaaaactcggttaaattattaaatatccatacaatggaatactgtgcaaccctaagtgtggcagagctatatttactaacatagaaaagtgcttgcttcattattaaatgaaaaaaagttacaaaacaaaacacagtatcatctcaattttgctttaaaaagtcattggttaagattcttttgtcttttgtttcttggcttatgtaaagtctccaccataaacatgtattacttctataataaaatggagagaaacaaaaagaaaacaatggaaattcttaaagagccaataactaagtaaaacaaaatcacagtaacattctttttttttttttaagagatggagtctcgctctgtcacccaggctggagagcagtggcgtgatctaagctcactgcaagctccacctcccgggttcacgccattctcctgcctcagcctccccagtagctggaactacaggcgtccgccaccacgcccagctagttttttgtatttttagtagagacagggtttcaccatgttagccaggatggtctccatctcctgacctcgtgatctgcccaccttggcctcccaaagtgctgggattacaggcatgagccaccacgcccggcccatagtaacattcttaaatttaatatacagagcaaaacaatgattcctatcccacttgacccctacaaaattcaaaaagcttcaatctttgacaatgtaaagcagggaaagactgtcaaatttaagcagttcttagagaagctcagggctaaaggaaaaaaaaacgaaaaacaaaaaaaggaagcagttctacacaaacagcacaacagcctatctgataaatcatctttctccaaagaatacaaagccttaaaagctataattaactgattaatcctcataacaacctgggcagtagaattagggctgagattataatttctaatttaccggtggggataaagtcagactgtacattcagaataaaaattcaagccccaaatatcccaatttttagttcattcagttagtaaactataatctgacaaatacagatggagctgctacacctgctgtcactcacacaaattgagattctgcagtaagcttgtacagataaaagaaaaggctacctattcaaggtcatttagctataaaaggttgggctagataatcaatagtttctctctcagtttcaaagaagtattttagggtctggaagatgttaaatgcactcagcaagcaaatacatttcggaaaaacttcccagatggagactcacaacgtattgcatcatactgaatatgcaaatgtttacctttaccaaacttttttaacaagcacctttttccattacatctattaatatcaagcagaaacatcattgtgagaaatacaagttgggataaagttcaaatatgtgacctctagggtcccttcctatgttaattctattattctaaattgcaccatcggtccaaggacaaacttctacctaacacaagtggcacttgggaagcaaaaatatacttctaggatagagtttctcaacctaaccactaactgacatctcacgatgagtaatctatcacagggggctatcctggcagtagcatgtttagcaacatctctgttttccacccactagatgctagtagtgcccttctgaaaattatgacaatcaaaaatgtctccagacatgtcaaatatgggagctggggggttcaacatcacacctcccaacagagaaccatatcctaaagattatacacacacatatatatactctttcaaaagcaaaacgtatccagctgcttcaaatactgtaagtcagaactaactccacacccacaaatgaaaacctcatttattcccagtcaatttccaagacaagactccagatacacaagaataacctggaagcatccaccttgcaaaaatatttagctgcagagaacaaaggggaaggaataggtcatccaggtggccaacaagtattacaaccacacttgcactgaaagcaaaagcaaaaatcagatggggaagaaaagtttgcccataatgtggcttctactaacctcttccttcaccattacctcatttctctacacaaaggacggaaagaaacagcaggaaggatgattagggaagtgtccatgaagttgccgcaattttagctgagacttgaaaattagctaaaatgtcattatgcaaaaggctaggacaagagaatggtaatgtggcattctagtgagaggaaatggcataagaaaaggcaacgctgtgtgggaaaaggcgacattctgaaggttaaaagaaatgaacaatttgggccgggcgcagtgactcatgcctataatcccaggactttgggaggctgaggcgggtagatcacctgagatcaggagaccagcctggccaacatggcgaaaccccatctctactaaaattaccaaaaattagccgggtgtggaggcgcgcacctgtactcccagctacttggaagactgagacaggataattgcttgaacccaggaggcagaggttgcagtgagctgagatcgggccactgcactccagcttgggtaacaagagcgagactccatcttaaaaaaaaaaaaaaattaacaatttgcttaaaacacaaagcatattttaatagaggaaatagtagaatgaaggtggaaaggcagtttgaagccagatccttaacggacagcctttaatagccttaattcagacttaaagacagtagaggggccaggcacagtggctcacgcctgcaatccccgcactttgggaggctgaggcgggtggatcacctgaggtcaggagtttgaaaccagcctggccaacgtggtgaaaacccgcctctaataaaaatacaaaaaaatcagctgggtgtggtggcgggcacctgtaatcccagctgctcgggaagctgtggtaggagaatcgctgaaacctgagcggcagaggttgcagtgagccgagatcgcaccattgcactccagcctgggtgacaaaagtgagactccatctcaaaaaaagaaataaataataaaaataaaaataaaaaatttagccgggcatgatggcaggtgcctgtagtcccagctactagggaggctgaggcatgagaatcacttgaacccaggaggcagaggctgcaatgagctaagattgagccactgcatttcagccagggcgacaaagagaggctctgtctcaaaaacaaaaacaaacaaacaaagacagcagaggccaggtgcagcggctcagacatgtaatcccagcactctgggaggccaaggcaaaaggattgcttgaggccaggagtttgagaccagcctggtcaacatagcgagatcgagtctctgaaaaataaaaagtatatacatatatatatacacacacatatatatgtatatgtatatataaaataatgacagcagagtatcattaaacactttttaaatgggagtgaaacatcagactgtgctttagagagatcagttgggtaggatggattgaaagtaagtaaaaaggcatctatagatggcaaagaccaataaaaaagctaccacaataatccagataggatgcaatgagaacttcaaccagaaaataatagtcaaagtctctaccaaagcttaaatccagaaatgtgaaggggccagtctaacaaaaaggccaaatatatgacaaacaaaaacatgatggcttataaagaatggaaagaaagctctcttttccttcataatttcatctcctttgtgacgaaatccttcttttctcacgaagcttttcaggtttggtatgtcctctctatacttctaacactatcagtctagcccaggtcctcatcagctcctgtctagattatcacaacagcttcctgactagtgcctcagtgccccaaactatcctttacctttttatcatctcactttcctactctgaacaagttcctcacactttttttttttttgagacaaagtctcgctcttgtcccccaggctggagtgcgatggcgcgatctccgctcactgcaacctccgcctcccaggttcaaacgattctcctaccacaacctcccgagcagctgggattaccggtgcctgccaccacagccagctaatttttttgtaattttagtagagatggggtttcaccacgttggccaggctggtttcgaactcctgacctcaggtgatcgacccgcctcggcctcccaaagtgctggaattacaggcatgagccaccacacccagcccctcacacctttttaatgagttcaaattcttcaagatgaaacttaacgtcagggcaagcacatcaattgatacggacccagaactccccacagattcccaactccgtatctttgcctatgttgctacctctacctggaaggtccttcttctactttttttttttgtccccaaacttactaatttttcaatacatagcatctccacaaaaacttcttagactcttccaattcatatcactttcttcctgcttgaattgtataatgcacttaaagtcactgtcattcagttcaaattatctgaattttccctaattgttaactaattctatttccaagacaagcaaaattccttaacagcacccttctttagcgtgctaactttatcgagagcttggtacatagtaagtgctgtaagccctaaatgactggactagagaagtcaaaaaggcctcgtgggggttgccctcaagtgtaagattttactaagaagagaaaaaggaggaaacacgaatcaaaaaattgacacaatcaaaataatgggaaagacgtggggcatgatccacaaaacaacttgcatgaatcaggtggtatatgtacagcttctcaagagaaagagaggaaaagaacagtgatttgtgatgaagtactgcaagctacattatggaatgcactgcaaagtatttattttacatatgaacaaaagtagatttgttgtggaatacaatggggaaggagagacaaaatttttactataaaacaaagagataatgtgtgtcacccacaagaccattatcaatttccttggccaacagggcttcttaactgaaaaagctttatattactaaaggaatcattcctgagtgcaggataggttattacaaatgttgttcactaacattaattagcgttttactatgtcaatcactatgctaagtatcttacatatattctcttaatcttcacaataacaatgtaaggtaagtactactgtcctcattttatagatgctcaaagaagttaagtaatttgcccatgatcacacaactatgaagttgcaggggcaggatccataatgctaaagccgatgcttttaactactacactagatagtttaaggcttaaactgaaacggtcttaactgcctgacagtaaattctgaattttagtctttagaggaaagtcagtcaaagaacaccaactacctactgagtatctccaataaatattaaaatgcctagagtattcaaagcaccacagtaagtacatacaaggatgacaagcagcagtaaagagagacactactgtgtgatttgggggatggaggcaatcctcatacaggctgagaagtaggcggagtcagaaaatgcttttcagaaaaaagaacatccaggctgaaacctaaagaatgagtaggagctgggtgcagtggcaggcgcctgtatttccagttactcaggaggcaggaggatggcttcaggcaaggagttcaaggccagcctaggcaacatagcccccatctaaaaaagccacccaaacaaaaacactaattttttttttttaaatgatggcctaccatggtagctcacacttataagcccagcaccttgggaggccaaggcaggaggatcgcctgagcccaggaggagtttgagactagcctagacaacacactgagacccagtctctaaaaaaataataattagctgggcatagtgggagggtcacttgagcctggcgggtggaggtcgcagtgagctgttatcacgccactgcactccagcctgggttacagagcaagattctgtctcaaaagaaggaaaagaggagaggggaggagagaggagagaggagagaggagacaggggagaggggagaggaggtgagagaagaaaaggagggaaagaaggaaggagggagggaaggaagggaaggagtagggccgggagaggtggctcacgcctgtaattccagcactttgggaggccaaggcaggaagatcacttgaggtcaggagtttgagaccagcctggccaacacagcgaaaccccgtctttgcctgtaatcccagctattcagaaggctgaggtacaagaatcacctgaatctgggaggcagcggctgcagtgagctgagatggcaccactgcactccagcgtaggcgacagaatgagactgtctccaaaaaaacaaaaagaaagaaatgagtagaattcagcattgcctatacaactacttcaagcatcccatattcaaaacccattccctgccccaacaccaaatccaaaacttcctcctgctcctcaacattgtctatttgagttaatcatgacctcaaatcaccaacttactttttaccataaatatttaatttaaacatctactaaatgccagatacaagatagtaaaatataaattaggtgtgaaggtagcctagcttgataaagtactgtatttcacctgaaggggtcaaggaaggcttctagaaaagatgacatactgactgaattttgaaaggtgaggtggtgcacagagggtgagggttggcaacacacagaatgacaggcacattcattccatccttggtgccaatgccctagtgcagaacctcattatgtactatagtaattcaggcagtaataatctcccaactattcttccttcttcctgtctcagcaagcctctaatctagcgtccactaccaaaatgattattagaaagggaagaaaaaaggaaaggagggggtaaacctaaatctaaccatttaaaatctttcactgactctagagtaaggatgagtccaaattccccacacaccattatctgtcccctttttacattagacctcatctccagcctgtcctcactgcagccacctgaaacatatgtttcctggctcttctatgcccctgcacctttactcatgctactctttcacggttcagctcaaggttacatgctctttcaagtattccccattactcccaggttgaggtggggtccctccctctaggctcttacctgcacccccatgacaccctggctattgctcatggtacaatataaactcacaattttgtcttgtctctttcttccccagagtatgtacttttttttttttttttttttgaaacagagcctctcattgtcacccgggctggagtgcagcggcacaatattggctcactgcaacctccacctcctgagttcaagcgtttctcctgcctcagcctcctgagtagctgggattacaggcacccgccaccacatctagctaattttttgtcttttttagtagagacagggttccaccatgttggcctggcctgacctcgtgattcgccagcctcggcctcccaaagtgctgagattacaggcatgagccgccacgcctggccaactatgtacttcttaaaaaaggagggttatagcttgttttatctctgtcccctacaagcagcacaatgcctggcagacagcagaccaacacacgttaagcaacctgagcattctatgctaaacccatcagatgaagatccattaggacgttaatggggatgtctgaagtgatcaaccacctaacaagaagaggcatcaactgaacctaggataggcttcacccactacaagttccagttatttacttgaccaagcacctgtacccagactaggaaactttttaactacactttttaagctattattaaatgtggttacacagcattataaaggtaatagccatcaaaatcacaaatgtaattgctcaaacttttacccagcaactgcacttctagaaatctattcaacagaaatattctcataggtactcaaagatgtatacacaatgctttcactgaagaactggaatacaaaaaaaaaaccctaattaaaaagatcaagccatataacaagtatgatcccattaaacatatatatatacacatatatatacacacacatatatacacacacacacacacacacacacacacacacacacacacacggataggctaggccccatggctcatgcctgtaataccagctactctagaagtcaaggtgggaggactgcttgagcccaggaattcaagaccagcctagacaacatagcaagataccatctcaagaaaacttttttttctgaaggatgtctatatatcaaactattaatggtgttaatcctacttctatgctagcactgaattcaaatttcctaccactctttagctgacaaaagacagaggaaaaaaaaatcatactttttatcatatctctttccaacaagccctaatggttggtgtaagtgctcctgaacaatcctaaaatcagcgacttctggaagattttaagaattctaaaggaggccgggcgcggtggctcatgcctgtaataccagcactttgggaggccgagacgggtggatcacaaggtcaggagatcgagaccatcctggctaacacagtgaaaccccgtctctactaaaatgcaaaaaaaaaaaaaaattagctgagcatgatggcgggcacctgtagttccagctactcgggaggctgaggcaggagaatggcatgaacccaggaggcagagcttgcagtgagctgagatcccgccactgcacctccagcctggggcacagagcgagactgtgtctcaaaaaaaaaaaaaaagaattctaaaggaaacaggttattctgggagggtccatggccaaattcctgagttcccactgaaacctaccttatacctttagagaaaagtcaattaatgacttttaaaagtacatttttccaatgccaataaaatgttaagtcaatactaatatccatttttcattctcttgggaggcaaggggtaaggagtaaatcactaagtgcaaaaaaatacagtccaattttttggagacatgcttaaggtcttcaaagagcttcagttctccatggtaacatatggagagtttaatgaaactttcctgacagttcaacttatcagactggtatttcttttttcttttttttgagacgaagtctctctctgtcgcccaggctggagtgcagtggtgcgatctcggctcactacaacctccgcctccaggttcaagcaattctcctgcctcagcctcttgagtagctgggactacaggcatgcgccaccatgtccagctaatttttgctgtttttttttttagtagagacagggtttcaccatgttaagccaggctggtctcaaactcctgacctcaggtgatccgcctcggcctcccaaggtgctgggattacaggcatgagccaccacacccagcccaggctggtatttctatgaagtgtctctcctatactagaaaccagaaactagctacagtacttagctttgagcctctttcccttcacaccctctggtggaggtgctaacaaacagtcacaaaggccaaataacaagcagcaagaggaaagtctagatatgagttcttagcaatttttggtttaacatcctaacaacaaaattgttattcctcttttttattccctaatacttaccttccaactgaatttaaccaagtctaaccttaagctctcccctttttaaaaaggaattaaaaggtgagggactccattaagtttgatgtcactcaagcaactttttccaaataagagcagaatctgctgtaattaaaattcagagtaagatctcattttggattcctggttcaggttacaagaaccagagtttttaaaataacatttagataaaactgcactcaatctacctccactttgcatttcctgaccctcaaaatcttggaaagaaactttaattctaaaaaaattacagccaggaaaaaaaagggtaagttcacagtcagcaacaataaaatacacagctaaataatttcctggtagagggctttcaaatgttaacactgtggaagcagcttaaaatcttggaaaagcaaggcttgcagaaagtaacatttattaaacaactattttgccgcattgtgctactaaatggggaaggtctactctatttaaaaggtctcttccaccttaaagggactctttgcataaaggtttaaaatcttcatataaaatgtttgatttttttctttcagactgcccaaactcatttgtttttgattcataaacatgagctgtgttttctactttggtcaagtcagtttccgcactctattttagctttacctttattctaccaaagacaagaaaatgcttaataaaaaaaaatatatattgcagctctttttggagtccaagtattttggtaaatcacaccttttggcttattttctcctatgtattttgttctacatcctaaaaggcacatggcttaaaaaagaaacaaataataatagttaccccctgccatactagtcatctcctatgacccacaatcctcccctcaatctgcaagtgacacccaaggatatcacttacctcctatatcttctgatagccttcaaacgctggtgaactctagtacagtggatatttgtcttttctaattcatactgtcttctacagccatagtgtggttcaactgagttttgatctcacatttcagggaatgggaagtactgatgagggaaacttatcttgtcatataaactattgttctgcacaacttttagtatgcccagaggtatatacgcaacttatcagcatagaaactgtaatttaaacatacatcttcagaagcaacatgagaactaaaaaagtcttaaaacagacttccaagaaacagttatgaagtccaattttaggaaaaagacatgatccaagtgttctttgcactgacacagtaggcaagccaggtgtctggggccattttacttaagaacctgccctgtactcctttcttaaggtaagtaagtaaagaggcactaaggtaaaatacgcttcccaagacatagactaatcaaatcactcaaggcaggaacatttaaaatgaagaaagagtacaacgaaagctgctttaaaactctaaataagacaagcaaggggccaggcccggtggctcacgcttataatcctagcactttgggaggctgaggtgggtggatcacctgaggtccggagttcaacaccagcctggccaacatggcaaaaccccatctatactaaaaatagaaaaaaattagccaggcgtggtggtgggcacctgtaatgccagctacgcaggaggctgaggtaggagaatcgctagaaccctaggggtggaggttgcagtgagccaagatcgcgccactgcactccagcctgggcaacagagcaaagattgtctcaaaaaaaaaaaaaaaaaaaaaaaaaaaaaaaaaaagacaagcaaggttatatgctcccgttgctcaacctactcaggaggctaaggcaggaagatcacttgagccccggagttcaggcactctaaactgtagcgcacaatgattacatctgtgcacgccaacctgggaatcacagcgagaccccgagacctcgtctctaaaatgaaaaagaaacaaaatctctaaaccactcaataagatttactctggggcaatcaacagacaaccacttattcagtttaccctagtccctcccctctaaactcaaggaatggaacggagaggtcctttgttggggggtggagagggacaataaaactatatacatctatctagcaagaaagtcgcttatttctgtgtcttaatggactcaccaagaagaaaaaaatagcccctacccatctccccacaagctgaaaaaacataaaaggaatacgcattactctttaaacatggcgtttactatgtttagaaaatccagtgtggattagtttggtgttttatagcacattttaaaaattgcttgtctaggctaagcgtagtggttcatgcctgtaattccggcacttctgggaggccgaggcaggtggatcacttgaggtcaggagttcgagaccagcctggccaacatggtgaaacccccgtctctactaaaaatacaaaacttagctgggcatggtggcacacgcctgtagtcccaatggcacatgcctgtagtccctgctacccaggcggctgaggcacgagaatcgcttgaacctgggaggcggagactgcaatgagctgagatagcaccactgcactccagcatgggcgacagaacgagaccctgcctcaaaaaaaaaaaaaaaaaaaattgcttgcctgatataacaaggtaactaagctttactcgcaaaggggcctaatcagaacctctcaatactaaaataccttctcaaacaaccacaacacccctatgtttacagagtacacaaatcaggtcataacgaacagaacaaacctaaaacttcttattcactttaaaatgcaattaaaacctgtggtcaactcaatcctctacagaagacgcagagacactggttacaatgtagcattactagagatggaagagtagccttagtgacagtgaagaaaaaagtttagtatagttacttcactttcttctcaccttgatatgagttcacaagtgaactaaggcctactcattttctaacttccagaattttcctcaacaggaaacactcacgtaacaaagagtgctctgcaggtttaaccagagaaataacatgtgtaggcaggaagaaagaaaatcagacaaaaatttaacatctcacgttggtaaagcaccaaagtcaaatacgaatgttctgaacgtggctttcagaaaagatgcaagaaaacttctaaaatacttcacttcagtggactcatatagatggaaagaccgaaaatcccaccctaccataaaggctctaataattcttaactgatcattcttttaactggtcacaatcacagacactggtatatactcaaatgaggtggccatcagtgacaaccatcttcaccataatatagacattaagaacctttgtaacatttaatgtttccctccaagtagttcaaaaaataaaaagtcaatcacctcaaattatgaggtactaacaaatacaccaaatatgctaaaggtcgaaggaacggcacactttgttgcataaacctagtggaaatccaattcagaatttcatgactgaaggtagttattccacatttataatacattttttaaattcccaagggatgagcatttttaccttgccttatttttagaactacacatcacactgcacatatcacatgacatgatgtaactgttagcaaagaaaatggtccaaaccattgacaatgtacatggtaaatcaggatcaatgcatactcaagaaccacatttcgtatttactttaaaaaaaaagtttcttaattcaaaatgttttttcaaattgaaaaaatgtctagtaacctatgtagaaaaaaccagaaatgtacttcgtattttataaaataggagtttacccaattatgggaaaaactgatataaagaaacagataaaggaataacatacttctaaaactacaggattaaaagtaaaaattttctagatcaacaccgaaatgctaataaatacacttagcattaggcacaaaacaattactactcaaaagtattcactgttgataggttaaaaaaatagttttaactgacaacgcctgtagacaattgaaattttctaaattggtcagacagcatgctagaaaaggaaccaagtagagcctataggaaaggggaaagggaaaacacacccacttaagcctttgtaaatagtggtcctttaactgacccaaaaagcagagaaaacagaaattacagaccatcctgacaaatggaaaacatattctaacgtactagtttccatacttgaaaggactttcaaaatgaagttcagtagcaatctataactatatcatgattatgcaaggcaaagattatgtaattttatcgtttattttaaaatgttctccgactctaaaactaaaacaagtaaaacgttttgatctctccaaagcgaaaaggaaaggttcctctgagctgcaatttaaaaatataaacacacaccccaaaacaaacaaaaaaacacaatgattgctagccacgtgacaaaggagatggcaacaccaggattgtgaatggaggggagggaggcgaggctggaggaagagagatttctcggaactttggggaccgcggcagtcggtctgccgaccctaggagcactaaactccagcccctacgagttgtgcttctaacaccctcaagtacagttttattaataagtcacagaaaatgctccagtgacctccaggataaaggggggtgggggggaccgaggaaaaggaaagagagcaatttaaagtggcgccatcatgtcaccccttctcccctaaagcaatcagtaagcaatagttaagtagcacgtttctctataaatccacattgggattccaacattggaaaacgaggatttttaagtaagacacgggagtagcgctgtttatcgtatggaaaacaaactatttgctaagaatcaaaagaccgtcagccggaaaacaggcccccaaaaaggcagttaagattccaactcacttaaaagcaaataaatccctcttcctctttagtttaaaaaaaaaaaaagtccgcctgagggagactacatctgaaaacgtaagtgacctgaatttacaggcaacaaaaataataaatgaaacaatcagagttgtgatacaaaccgtgcaacgcgccaagatgtgtgtttcgagcagagaaaggccttttgcagtcaagagaagttcaaggcgagagccagagtttgtttggggggttcttttacgggaataaatcatgttcttcaggccgcctttttaaatagaacgccaaaggaaaagctggcgaacgaggcggcagctcctggggaagggcccccgcacacccccgcccttggggcgactcccagcccggacccgcagcagggaagcccggagaggccatttaaagttccgggggatttttctaccctgccctgcctttctagttacaactaacaaagagagagagaaatgggagccacagggagagcgaggagaaggagaaagggcagcaggaggaggaggagaggagcagcagcagcacctaccacgtgatggaggagcgtagcccgggcggattcagccccacaaaatgggcgcagtttgcaaacagccccccggcctgggcgccgagggccagcggcgggcgggggcgcgcgacggcggctccggcccgggcccgccgctctcctccccccgacgcccggagccgccctgactttccgggcgggggggcgaggcagagggggaggggaaggcggcggcggggagcggctgctttttcttctctttcgggccctttcccggccttgctccgcaccgacggggcccgagcacggctggagaccgcagcccggccgggagggcgggcgggcgggggcagagagtgaaaccgcccccccgccccgcacaaacaagcaccgccgtctgcagcccgaacccgcacccaggccgccacccccggccgcctctttccagccggggagcgcgcttcagccgccccccgcgccgccgcggcgagacgagtcggcttcgctacggtgctcggttctcccgccggctcggcgagcggtggcggcggtggcggcggcactgggaaaatggcggccgagctccttttccctccccccctttaatctgaagcggagggagaatggagcgagcgagcaagcgggcgagcgccggggacacggggaggagggacagcagcgcctccgccggctgcggctgcggcggcgaagggccgctccaccccggcgcgccgccagggggcgcccgccgcgccgcccccgcgggccgccaggaggcgcggccgccgccgcctcagtcatggctcctcgccgtggccgatgtttttgtacctccatctgcggaggccgcggcgcccggccccagctgccccggacgtgcggcgacggcacgcagcactgcggcagggggaagccagccctcgctgcggccgaggtgagtctaacctgaggcactgacgccgtcacatgccctccgtgctggggccggcggtgcggctcgccagttgaggggcagggcgggccggcgccgcggagcgagaggacgtgagcgaggaactgtttgcactgtgtagtaaagagggtaaggccgtcggcaccacactattccaaggctaaccctgcagaaagctccctgaccagtgaagcggcttccgccgcccgccctttgtccctagcagccagcctccgtatactgcagcacggctgggcactagccccagcaccgcgctccgcagccaccagagttgggcggggtggggagggtgcacgtagtcactgcgcaggccccagccagggcccgcgccgggccagcccgggaagggacagccgggagccagaggggaagtgatggccccgccggcgccgggcccgctgggaactgtagttttcgtgaagaaacacgcgtcttgttttgggtgtcatggcttggcagatccgccaaaacaggcaaatggcattacacaatgagtatttatgcttcctgccgccaccaaaaggaagttcactgccatgctaaaagtttaacaaagaactccataaagaaacacaagtctcacaacaaaaagccaacttcccacctcgttaccagagttggtttaaagtggtggcaccttatcatttctcatgaccagtttatcagtacagaactttatattgtccccaaaataggacctttaaaataatggaacctttcctagacttaaagaattcataaacataatgtaatacaaagtgtcacacaaagtgtaattctaccaccctttaaagttgccaaaagatgagtggagtatcttgagatttaaaagactaatctaggattcatcaaaactggcttaaatgactgaagaaaaaatcgttcaaatcattaaatcatcaaattcggcagataagaagggtatgtatgctctactaccaaaaaggaagacgcaaaatgcttcacacttttttgtggcttaccagaaccaatatccggcattatacgtcacttctgcttatcaaaaaacaccctcacagtcgttacagaacggttttagtcttcccacaaagttacactaactcacctgcccctgcaacatctgcacctaggtttctgcgaatttccatttgtactcctaaaatcacactctcaagcatagtcatagttctcaaataccaaaggcaggcagtttggagtcatagggtcaaattacacaaagaataaactaatatttgtatacacatccaaaagaggtctttagtcttggatttttaatttacaaccctggggaaaaactttgacttttttattgtacacacatacacacataaatagtaattccacaaaatacagtagaagggtattggaccaacagatggcgaactagagccccaatctgaggctcctgaaatctaaattagcagaatgaaaaataccaaataaggcaaagccctttgcagcgtatacttaaatattaaattcagacacaccataacaaaataatcttactgctgctccaaatttttaagactgaactgtcagatttaattaggcaaccaaataagcaagattatatgaaatatatttttctaatggattaggagaaaactggaaaatgctcatttttaaaaccatgtatttgggggaactataaattccagtttcccctttctctcattgcttagtgcaagagtcaagagttcacagggtttatggcacttaaatcagtcaacctgttgtatattcttatctaaaatcagacatctttcttattaggcatccacttgtacttttatttttttgacagggtcctgctcggttgcccaggctagagtgcagtggtgcaatcaaactcactgcagcctcccaggctcaggcgatcctacctcagcctcttgagtagctggcactacaggcatatgccaccatgcccagctgttatttttttcactcctttttgttttggtagatacagagtctccctatgttgcccaggctggtctcgaactcctggactcgagtgctggcattacaggcatgagccaccacacaaaaatcttatgaagagaaacaaattttcttaaatttccccccaaaaaatagtggatgtccaaaaggctgattgaaaacacctacatacaaaataaaacaaacaaacaaaaaaagatttaaagaaaaaggcctggtgcagcagctcactcctgtaatcccagcactttgggagggtgaggtgggaggatcacttgagctccggagttagagaccagcctgggcaacagagtgagaccctatctctacaaacaaaattttaaattagccaagtgtggtagcatgtgcttacagtcccagctactccagaagctgaggggattgcttgagcctgggaggtcaaggctgcagtgagtcatgatcatgccattgtagtccaacctgggcaacagagcgagaccatctcaaaatgaaaagtgataaaaaaataaaaacaccaacatatttcaaatcactcttggaatagtcatgttgactctccaatatccactctattctgattagttttaacccattctctttgccaatgattggttaggaatggccatgagatgtgagtagaagccccctggacagcctccaaaagagaactgtgagaaaaggttcttcaatcctaaaaatgatggaggaaaaaacagtccctcttcctcagacagtgacacctcaaactgctacagtcacctttgcagcaagcctgaagatgccaccaacatcaaagggaatagagagttggtccttggtgatagcattaagccactgtatcaaccaatcctgacaatttgtatgacttctggatttccagccacattacaacaatgtaacaataaacatttattaattgcttaagccaatttgagttaggttccttatataataaatgaagtcaaaaaacaatgattgagttctaatgttttttagtatttgtatcttactttatgattacagtattttatataactaatcttattatttcttcctcagaaaagacattccatggccaggcatggtggctcacacctataatcccagcactttgagaggccaatgtgagagtattgcttgagcccaggagtttgagaacagcccagggaaaacagcaaaacttcatctcttcaaaaaataaataataaaaaaatttagccgggggtggtggcatacacctgtagtccaagctactcagaggctcaggcaggaggatcacttgagcccaggaggtcaaggctgcagtgaaccatgatcacgccactgcaaaccagcctgggcaacagagcaacaccccgtctccaaaaaaagaaaaagaaaggaagggaggaaggaaagaaagaaaaaaggaaaaggtgttccctcttacacacagctctgtatccatccatctttgtctgtgttctctctacctagaaaaagaggaccatccctcattaccaccattccttgttaattcctctctccaatccacctacaactcatgttatcctcttatattccaccacaccactgttatcgtctactcacttcacttgacaataatgtaggctgggcgtggtggctcatgcctgtaatcccagcactctggaaggccaaggcaggcagatcacctgaggccaggaattcgagaccagcctggccaacatggtgaaaccccgcctctactaaaaatacaaaaagtagccaagcatggtggtgcacgcctgtagttccagctactcgggaggctgaggcatgagaatcacttgagcccggaaggcagaggttgcagtgagccaagatcacaccactgcactccagcctacgcgacagaaggagactgtgtctcaaaaaaagaaccaataatgtacagagttggcactacattacccttggttaaatgctgtctgtaattcctctgagtttgttttcatataccagtcttgccacctcaagccagcctgaaagcccttgcaggcaggaactgtggttgttctaatttaagatctgtaactcatctatagataataaacgtattccaaaaaggcactctctaccttccctgccacagaccttctaaacaagccagaaattcctaaacagaataatctcacaaattcagtacctcgtatgtccaaactaatctcaaaaggacaatgaataactttttttgcacttaagaaaaagcaattattatatattaactcaggacaagttctaaagcctaggccatttagtttcaaaagcacaggggcccatttttttggttacttacctaggacctagcccagggcctggcacaaaagagacacatcataagaactgactgaataaatgaaaaaggtagagtgtagtacttaagcacacaggacctaggtagcccgattctaatcctgcctccctcacttattctttgtgttactttgggcaaagtacgtattctgctctgtaaaatggagatagtaataccacctacctcttaagtttaactattattattagtgaatgaagctattttccacagttctaaactttaaaggttaaaatctgagtgaagcaaaaatcagcacctctttcctaattcaaacttcaaacacctatctacttaggacttggacctactttaattaaaaaaaaaaaaaaaaaaaaaaaaaaagcctggatgtggtgactcacacctgtaattctagcactttgggagaccgaagcaagtggatcacctgaggcctggagtctgagaccagcctgggcaacatggtgaaaccctgtctcaactaaaaatacaaaaattagcctggcattgtggcacatgcctatagtcctagctacttgggaggctgaggcaggagaatcgcttgaacccacaaggtggaggatgcagtgagccaagatcgcaccactgcactccaacctgagtgacagagcgggactctgtttcaaaaacaaaatccctgtctagactctagcaaacaatgttttcattcatgaacttagataacactatatataaaaatacttttagctccctaaaaacatattctgagaatgattatttacaatcataaatctaatgccacattaaatacttcaaatacatttaattcaacaaaaatctagtgagtacctattaagctcaagaatttattctagatatcacagaaatgaacacataaacctatgtaaaaacccatattaaaattataaaagaaacatctttaagctgaaactgaggcatgttctcacattaatatttaaccagctaaatattaaatagccagagtcaactaaaccaaagttaagaaatttaagtcaaaaaatttaggatgtagaaggaatatgttcagccgccacattttattagtgtgaaaatgaggccaacagaaagaagccagttaagagattgccaaagcgtcaaagctggaatcagggtctctcagtcttcaattctcacttttcccacttctaattcaccagtgctactcaattggtgaactggatgtgcaaacatgctaaaggcattaaacctaaaccatactacctatttcacagtgtcacaagtataaagatttagccaaatgcaagtagaagaaaatcctcatactgattacaatgactacaaagctcagaaatcaagattttttttcattaaatggaggccttagctgattcaaaatatcatacagtatttttatgtactgactgaatccagtagaaacaaactttcagtaagattaaacaaaagcatttcataaatggcaaagtattacaagaatgcatagcattccttcatttcaatccaacctaacaagatattttcctcctcatactactgatacaaactgcaggatttacataaagatattattttgccatctcaccacagaactgacccaataattcatacaaaagaaaaactaattattaggcagcctcctaatttaactgtgttagtaatgagaacaatactgttgtaggttaaacctaaatgtactagtaagtctagaaataatttactttaggataattcagaagacaacattaaagctcagctgaatacaattatatcactgaaagaaacaagtcaggttctctcaggccatcagctattgttaaaatctaacacccaagattgttggtcttctccacagtggtggatttaatagcagctaccagcactcatttctagtgcaagcagtttaagcaggattttatacgaacattttaataaagttcctcaatgagtttacacacacacacacacacacacacacaccctgattattttggtgaattttagttaattctaatgtttttaactttagaatattttaaaattctcaaataactagaatgtgtgaacgttcaatgaccaaacatagaaggagtattctaatatactgattttgcagattaagcaatctacgcaggacccaaactttttatcagataataaagctgagtgtcagaatttggccaaaatgtaccaagaaactacctgagttcttttccaaaggaaacataaaggtaaatatgcagaacttcaaggcagctgtgagcagccaagttgtggagggcctgacaaaagtgagtcagaagggaaaatgttcaaagagaaaaggaggcagcaggtgtacaaggcaaaacacaccttaaaaaatatctttacaggctgggtgcggtagctcatgcctgtaatcccagcactttgggaggccaaggtgggcagatcacgagatccggagatcgagaccatcctggccaacgtggtgaaactccgtctctactaaaaatacaaaaaattagctgggcatggtggggggcacccgtagtcccagctactcgggaggctgaggcagcagaatggcatgaacctgggaggcggagcttgcagcgagcggagatcacgccagtgcactccagcctgggcgacagagcgaaactctgtctcaaaatatatatatatatatatttttctttttacgtcagttgctgattctaagttatgatgcaacttgtaaaatcttgttctgatggcatggcaaacctagggactttggaagatggcagacctgtttcctccaatgaagcagcataccattcttggaaagggaattactttttttttttttgagacacagtctcactctgctgcccaggctgccaggctggagtgcatggcaaaatctgggctcaccgcaacctccacctcctgggttcaagcgattctcctacctcagctgcccaagtaggtgggactacaggcgcgtaccaccatgcccggctaatctttgtatttttagtagagacggagtttcgccatgttggtcaggctggtctcaaaatcctgacctcaggtgatccgcccatctcagcctcccaaagtactgggattacaggcgtgagccaccacgcccagcctagaacattatttttaacccactaattcttggattcttgaacttgtttctatgtacactcaggaacatacagctacaaacggggagtaaccaaagccactgaatatatgcaggagcaacttttttggagtatcaatttaatcaaggattatagtaaaatcagatatacttttgttaaaataaacacaaatatattacaggttgaccatccctaatctgaaaattcaaaaccctccaaaatctgaaactttttgagtgccaacatgacacctcaaatggaaaattccacacgtgacacctttgcttctgatggttctctgaaccatcagaaacactgtttatttcaagaacaaaattattttaaattttgtataaaactggtcggttgtggtagctcatgcctgtaatcctaacactttgggagaccaagatgggaggatcatttgagccctggagttcaaaaccagcctgggcaacatagtgagaccctatctctgaaaaaaaaaaaaaaattaagtccaggtacagtggctcaggcctgtaatcccaacactggaaagccatggcaggtgaatcacttgagctctggagttcaagaccggcctgggcaatgtagcaaaacctatctctaccaaaaacacaaaaaattagccaggcatggtggcatgcacctgtagtcccagctacacaggaagccaaggtgggagaatcacttgagcctggaaggtggaggctacagtgagcagagatggcgctactgcactccaacctgagtaacagaatcagaccccatctcaaacaaacaaaaaaattagctgggcttggcaccgtgcatctgtaccagttagtaccagctacctgggaggctgaggcaggagaatgacttgagcccaggagttctaggctgctgtgagctaggatcacattactgcactccagcctgggcaacagtatgagacatcatctcttaaagaaaaaggtaaaaaaaagaaattatcttcaggctatgtgcataatgtgtacatgaaacatagaatttcatgtttagatttggatcccatctccaagatagtacattatgtacatgcaaacatcccaaaatctgaaaaatctgaaatccaaaaaacttctggtcccaagcatttcggataagggatattcaatgtatacagagcaaaaggcagaattctcactgtttcaagatagaaaaggagtcctcagagagatatgtcctgcttgtaacaaacagctccaaacagccctagaccctgaaaagtactttaaggaaagataaagaggtactggtttagaccatttatagataaatatgcatggctaaaacccctgaatgtaatccttccaggcagaagataaaacctgaaatctaacgtataaattgtcatgggtacaatattataaaagagaccataagttaccgagaacatgactggaattcaggaaatgctaaaggtcctgtcttatctctgtaactcatttacaaagaaatcatgtatgattttctcaactgcaatcttttttgtttctgaattagactgacaaaaattatagaatataatattcaatattttccaccatattccaaattctcactatcacatttaaacacaattttatctaatgaaatgtgtcccaaatgaaccaactttaaccagcatcagaaaaaataaaataaaatagttaaatgaaactgtatcttctttggtataagaagtccttcaggccagacgtggtggctcacatctctaatactagcactttgggaggccgaggccagtggtttgctagaactcaggagttcgagaccagcctgggcaacatggtgaaaacccgtctctactaaaatacaaaaaattagccaggcgtggtggcatgcgcctgtagtcccagctactcgggaggctgaagcaggagaattgcttgaacccagcgggaggtagaggttgcagtgtcagtgagctgagatcgcgccactgcactccagcctgaacgacagagcagactccgtctcaaaaaaaaagaaagaaatccttcagcacagagggtaggaaaaaacaactactcacacttcccagaatacctaccgtggcaataccaaaatatgaccatgcttgttaatatttgggctacggcattaaatgtttataacataacacaaacacttgtaatccaaatgtgaatgattatcttcaattttcagtaaaataagaccctataaaagccctaccattaatacatattcattcataaacatactgagtaccagtggatgttaaacactgtagaatctctaaggaaagaatactcggtcactttataagctatgtggtagtcaagaaaaatcctttctactcattgatacgttaaatgatcaaaaaatccaaagctaaaaaatgatcagagaacaatgaaaaaattttagtggctttatgcttccaattccattttcttctggactcttttctgaagcttgcctaaatcatcccaggaatgctaaaattgggtgttatttatggcataaccaaaatgaaataacaaagtaagtaccccaaataaaactaggagaaaaaatccagggaaccaagcaggcagtaaggatctaaagttctatacttggaacctctaccctgaatgttaaataatagatgttttttaaatagttgactaccaagtgtggtggcatgtgcctgtaatcctagctacttgggaggctgaggtggagagactacttgagcctaggagttctagactagtctggacaaatagcaagaccctgtctcacgggtaggggagcaggggaaggcaaccaagctgggtgtgccatgtgcctctagtcccagctacttgggaggctgagacaggaggagtgcttgaaaccataggccactgtactccagcctaggcaacataggaagaccctatctctaaaacaaacataaacaaaaaggccgggtgtggtggctcacacctgtaatcccagcacttgaggaggctgagttgggaggatcacttgaggtcaggagttcgagaccagcctggccaacatgataaaatttttgtatctttagtctctactaaaaacaaaaattagctgagtgtggtggcaggggcctgtaatcctagctacttgggaggctgaggcataagaatcatttgaacctgggaagtggaggttgcagtgagcggagatcacaccactgcactccagcctgggtaacagagcaagactctatctcaaaaaaacaaacagttatatctttaattattatcttcattcagtaattaggcaattagaatttacaattgctaaatgaatgttcaaagttcaaccaaaattagtccaagatgaagccaagaacacatctcaactcattcaataaagccattattactctgatgccaaaaccagacatagatatcacaagacaactacagaccaatatatcttatgaatacagatgtaaaagtcctcaacaaagcaaaatgaatccagcaacatattaaaaggcttatacaccattgctaagtatgacttaatcccagggattcaaggttggcttaacttctgaaaatcaattaatgtaatacaccatattaataaaggatacaaaccacatgatcatttgaatagatgcagaaaaagcacttaacaaaatccaacatgctttcatgataaaaacactcaacaaagtagaaattgaagaaaacatcttcaatctaataaaaaatacctatgggggaaaaaaagaatacctacaaaaaccccatagctaaaatcatacttaatggagaaagcctgaatgctttctccctcaggtcaagaacaaaacaaggatatccactcttaccactctgtttaacactgcactgaaggttatggccagggcaaataggcaagaaaaagaaataaaaatcactcaggcttaaaaaaaagaaggaaaactacctttatttgcagatgatataatcttgtatatagaaaatcctaagaaaatcccacaaataaactattagagccaataaacacatccaacacagttacaggatacaagctcaatatacaagtagtaatcgtatttctatacacaagcaataagcaatctgaacatgaaaagtttttaaaaattccacttacaatagcatccccccgccaaaaaaaaaagacttagaaagccaagcacgatggctcacacctgtaatcccagcactttgggaggccgaggcaggcggatcacttgaggtcaggagttcaagactagcctagccaacgtggtgaaaccccgtctctactaaaatataaaaattagttgggtgtggtggcaggtgcctgtaatcccagctactcaggaggctgaggcagtggaatcacttgaacccaggaggcggaggttgcaatgagccgagatcacaccactgtactttagcctaggtgacagaatgagacactgtctcaaaaaaaaaaaaaaaaaagacttagaaataaatttaacaaaagcagtgacaatcttatactctgagatatataaaaattacaaaagaagttacagaaatcctaactaaatggaaaggccaggtgtgatggctcacacctgtaatcccagcactttggtagactgaagtgggtgggctgcttgagcgcagaagttcaggatcagactaggcaacatggcaagaactcatctctacaaaaatacaaaaatgagctagatgtggtggcatgcacctgtaatcctagctgcttggggggctgaggagggaagatcacttgagcctagtaggttacagctgcagtgagccatgattgcattactgtacttcactgcagcctggatgacagaacaagactgtgtcccccaaaaaaaaaaaaaaaaaaaaaaggaaagatatcccatgttcatggatgagaatggatcagaagatacaactctgttaaaatggcaatattccctaaattgatctacagaatcaatgtgatcccagcatacccaaaagaaatttgaataggaaaaacaaagttgggggactcacacttcctgatttgaaaacataattcaaagctatggaaatcaagacagtgtggtagtggcataaggataaacatacagatcaatggaatataagtgtgggttcagaaataaacctttacactgacagtcaattgattttatgacaaaaatgccaagacaattcagtggaggaaagaatggtctttttaagccaagtgctgtagctgacacctataatcccagcatttggggaggctgagacaggaggattgcttgaggccaggagtttgagactagccagggcaacaaagcaagacccccatctctacaagaaacaaacaatggtcttttcaacaaaccatgctgggacaactgaatattcacatgcagtagaatgaagctggaccactatatctcacaccatacacaaaaattaattctaattaaatttaaacacggattatagacctaaatgtaacagctaaaacaataaaattcctagaagaaaacaaagctaatcttcatttcatttggtggcctgacatcaaaaccacatgcaacaaaggaaaaaacaagtaaatttggcttcatcagaattataacattttgtacattaaaggacaccatcaagaaattgaaaacacaacccatagatgggagaaaatatttgcaaatcatgtatctcacaagggatttgtatctagtatatttaaagaactcttacaactcaacaataaaaagagaatccaattttaaaatgggcaaaggctgagcatggtggctcacaccagaaggagaggatcccttgaggcaaggattctgagacctgccagagcaatatagcaagaccctgtctctacaaaataaattaataataataaaaaaaaacaattagccaggcatggtggcacacacctgtagtcctagctactcaggagcttgaggcagaaggaacccttgagtccaggagtttgaagttccagaaactatgattgggccgggtgcggtggctcacgcctgtaatcctagcactttgggagtccaaggcgggtggatcatgaggtcaggagttcaagaccaacctggccaagatggtgaaaccccatctctactaaaaatacaaaaattagctgggcgtggtggtgggtgcctctaatcccagctacttgggaggctgaggcagagaatcacttgaacccaggaggcagagattgcagtgagccaagatagtgccactgaactccagcctgggtgacagagcaagactccatctccaaaaaaaaaaaaaaagaaaagaaaactgcgattggccactgcactctagccagagtgacagagcaagacctagcctaaaaaacaatagtgtataaaaataaaattaaaatgtgcagagaatttaaatagacatttctccaaagaagatatatgaatggccaataagcacatgaaaagatctcatcaggttgagcacaggggatcaggcctgtaatcccaacactttgggaggccaaggtgcggggactgcttgagctcaggagtttgagaccagcctgggcaacatggtaaaaccccatctctacaaaaaatacaaaaaggccaggtacagtggctcatgcctttaatcccagcactttgggaggctgaggcgggtggatcacctgatgtcaagagtttgagaccagcctggccaacatggtgaaaccccgtctctactaaaaagacaaaaattagccaggtgtgatggtaggcgcctgtaataccagctactggggaagctgaggcaggagaatcacttgaacctaggaggcggaggttacagtgagccaagatcacaccactgcactccaacctgggtgaaaggcaaaaatccgtctcaaaaaaaaaaaaagtttcaaagataaaacaaaaatcttgttaaagataaatacacgagatgctaaagaaataatctacttcttcaagtcatgctatcaatttgcaccaaaattttcatttcctatgtgtaggtgttgagggtcttgtacccatgataaatgacatacacctgttctgggctgacttttgttccccaaaagagatatatagtactccaaggggctgggcacagtggcacatgcctgtaatcccagcactttggaaggtcaaggccacagcatcgcttgagctcaggaattcaatatcagcctgggcaacatggcaagaccccggctctactaaaaatataaaaaaatagccaggtgtggcagtgcacacctgtagtcccagctacccgggaagctgagatgggaggattgcttgagcctggggtttagggggctggaggttgcagtgatccaagtgccactgcactctagcctggatgacagagggagaccctgtctcaaaaaaaaaaaaaaaaaaaaagatatgtagtactcctaacattcagcacctcagaacctgatcttagagacaggatcttcaggccaggtggcttcccttcctctccgcgtcagtctgtcccacctcagctcagcccaccggagacagagggtgcaggaacctggaggcggaggttgcaggaagccgagatcctgcaactgcactccagcctgggcgacacagcaagactccgtctcaaaaaaaaaaaaaaaaccttacaacaaaatgatgcagcccgggcgcagtggctcacgcctgtaatcccagcactttgggaggccgagtggggcggatcatttgaggtcaggagttcgagaccagcctggccaacatggtgaaatcctatctcaactaaaaaaaaaccaaaaactacagaaattagccaggcgtgatggcgcatgcctgcagtctcagctgcttgggaggctgaggcaggagaattgcttgaacccgggagtcggaggttgcagtgagccaagattgcgccgattgcactccagcctgagtgacaagagcaaaactccatctcaaaaaaaaaagaaaatgcaaagtcacctaagagacagtttaaatacataaaaagctcgatgccaaataaaactggatgggtcacttgataagtgggattgataaaaagcaagacagctgatattatataattcttatttgcttcgatatttactggggaaggtagaggggaaaagctatctaaattactcttaataagcatacaaatctctaatagtgaatcaaatgcatcattaaatatactaaattcctcaaactgatatgtcagatgtcaggtagtcatgaagacccaaaatagtctccatgggttttttgttgttgtttttttgagacagagtctcactctgttgcccaggctggagtgcagtggcaccatctcgactcactgcaacctctgtctcccgggttcaagccattctcccacctcagcctcccaagtagctgggattacaggcatgtgccaccacatttggctgatttttgtatttttagtagagacagggtttcactatgttacccaggctgttctcaaactcctgacctcaagtgattcacccaactcggcctcccaaagtgctgggatttcaggtgtgagccaccacgaccagccccttctctgtgttttaaaggcatttaagtataaattattaaactgcaggacagaacatattagctgacggtcatatgagtgaccttctctaaatgccaggaggatagaatccacttttcctttatcaatattttccttgctcaacttctgacatattaggtactcaataagtatgtgctgaaccaaaacgaacaaaaaaatgctgtcatcaaagtaacttccatctactcaagtaggctgcaacttcaaactgcccaaactagcaaatctctaataaagatgggctcagaagacatatcagcatgaataaccttctgaggaaaagacaacatggattctaaaagtggacatcacaccacaccagttcacccaaattctctgagaaaataaatatgtgtggctgggtgacggtggctcatgcctgtaatcccagcactttgggaggctgaggcgggtggatcatgaggtcaggagatcgagaccatcctagccaacatggtgaaaccccaactctactaaaaatacaaaaattagctgggtgtggtggtgagcacctgtagtcatagctactcgggaggctgaggcaggagaaacgcttgaacccgggaggcggaggttgtagtgagccgagatcgcaccactgcactccagcctgggcaacagagtgagactctgtctcaaaaaaaaaaaaaaaaaaaaaaaaaaaaaagacctgagtggccacaggatgagaacatttactgtagactggacataactgagacacagaaaattataggtagatgctgaggtacttccccaaatgaagaagtaaaaacagaagattgaaaatttttttagaaatgctatatttaacattttaatatattgtacaaaaaatatacagagaattccccattttgcagatgggatgatgagattcctaataatgaaataccacacgagttggaaaaataagggaacggagtgatggaaagggtttctaaatatattaaatgagaaacatttgcaaaaactaagatttatattcagcttagagaatgctttggcaagtataaaagctgtctaaatatgtgaagggttatctagcagaagacaaaccagacttgctctaagcagttcccgtgtagacaaaattgggcccaaagtggcaattccagaagggcacgcttcaactcaagctttctaaccatcagacctaactaaaaaggtggttcttaccttggattacctctaagagcccactgagatatgagtgttaaaaaattacatgcgaggaaatggcaggtatgttacagcatggacaaatgaaaagtaaggcatttacaggaaaaaaaatctaagctatacttaaaagactcatgccttcaagtcaaaaaaggaatttttgaataattatagaatattccctaaagacaatgtgatgttctatgcaaaaaaaaaaaaaaaaaaagggagggagggaggaccaaatcctattaggaaaaaactgtaaatcaagggtacccaatcgtttggcttccctgagccacactggaagaagagctgtcttgggccacacataaaatacactaaagtaacaatagctgatgagctaaaaaagaaaatcttaaaaaaaatctcataatgttttaagaaagtttacagatttgtgttgggccacattcaaagctgtcctgggccgcatgcagcctgtgggccatgggtcggacaagcttgctgtaaatagaacatattttcttatccttctaccaaatcacagtgtagttataactaaaatgcagttctgagtagttatcataaatccagaaagggaaagcaatgctgacaaagatcctggaaggaggtttcactggagattaaattaaaaagtcaagcatcttcagttgagaaacatgaaagcaaaggggcaatgtgatcaaaatcagaaaacgtatcaatatggtaaatactaatttattcaccttttatgcttgaaaagtatttctttatataacagataaaagaaacttgtggattgtgttaccacaatctacaagttaaaaatagattcaagtgctcggataaatgtaggtatattaggtccattcaggtcctacaggatagaagtgctatcagacgtgaggccctaaatttctgaggttaacatcttaacagataacaatgtttcacctgaaaacatcacttggtgccaatttagacagaacaattggttggacagaccccggacagacagactcaaggaggctggttggtatagacttccttccattcttttacctcagtatgtatgtgtgtgtaatatatacatacatattatactagaacatatatacattccttatctttatacacttagaatgctccttatatagctctgcaccctgaatttttcatttatcatttactcaacatcctaagacattaaaaattctttttttttttttagacagagacttgctctgtcaacaggctggagtgcagtggcaccatctcagctcactgcaacctccaactccctggtccaagcaattctcctgcctcagcctcctgagtagctgggatttcaggcacgtgccaccacgcccagctaatttttgtatttttagtagagatggggtttcaccatgttggccaggatggtctcgatctcctgacctcataatccgcccacctcggcctcctgaagtgctggaattacgggcatgagccaccgcacccggccagaaaaattctttcaaatactattccatggttgtaaatgtccatccttaaatataccatgatttattttcctataaatcttgctgctcatttaggtttattctcaattctcactaatatgaataatgttacaatgaacatctttgttcacaaatctttctatgtatcttaatttttcccctttaggataaattcctagatgtgcaattactgaattaaagaacgtttttaattttgccaatatatgttgccaaaatatctttcaaaaaaactaggcccaatgcacactccactagcagtttcagagattgtcccctcaccaccttcgacagcacagtcaactgtaaatctgataggttaaaaaaagagtatgtcatttaatctgcattcctttgattacttatcaggataaaaatgtttctcatatgcttcttggtcatttgtatttcttccttatgaactctgatcatgttctttgccagcaaaacttttctttctcttggccgacaaactttctgtggaaaaccagctgagatggaatcatttaaatatcagcaactgcagctccccctgctgacagataaattaccaccaccatcaagtgcccagtaaaaaaaagtgagctagaaccatacgcttgcctgtcttctgggctgctgctacaaatacaaattatacacggtaataaaaaagaaaatactgtgtatctaaactcatacttaacagagctgtgatggagaaggcaagggggacaagcgttttatttgttttttgttgttgttgttgttgttgttgttttttgagacggagtctcgctctgtggcccaggctggagagtagtggcgtgatctcagctcactgcaagctccgcctgctgggttcacaccattctcctgccacagcctcccgagtagctgggactacaggcacccaacaccacgcccggctaattttttttttttttttttttttagtagagacggggtttcaccatgttagccaggatggtcttgatctcctgacctcatgatgggcccgcctcggcctcccaaagtgctgggattacaggcgtgagccaccgtgcccggcccaaacgttttctaatgtgcaggaactaggcggggtgcagtggctcacacctgtaatcccagtactttgtggaggccgaggtgggtggatcacctgaggtcaggagttcaagaccagcctggccaacatggtgaaaccctgtctctactaaaaatataacaatcagccgggtgtggtggcacgtgcctgtagtccgagatactcaggaggctgaggaacgaggattgcttgaacccaggaggtggaggttgcagtgagccgagactgcgccactgcactccagcctgggcaacagagtgagactccatttaaaaaaaaaaaaactaatatgcaagaactaatgtcacaaacaattctaaaaatcaattccctgccaaatatactacctggcacatataaacatcacagacctaaatattcatttccctatactttaactatgtgaaaacactctaaattaccaaatgacactgggtggtcagcaaactagttctctttttccaaaagcaaaaacaacaaaaacacttttgccctttagcattcaaagaaagagtattaaaaatcttaattcttggcaatccttattccaaagttgcttgcacttatcagactgggaccaatagatccaaagagtaaggccaagactggcaaatgcatgtgactctcagcttttccactgataccctcctaaagatgcatgtcccaagtccagcaatacagtctttaacactcatttactaagtgccatcaagagcaagcagtgatggccgggtatggtggctcacgcctgtaatgccagcactttgggaggctgaggggggtggatcacctgaggtcaggagttcgcaaccagcctgaccaacatggtgacaccctgtctctactaaaaatacaaaaattagctgggcgtggtggcaggcacctgtaatcccagctatttgggaggctgaggcaggagaatcacttcaacctgggaggcagaggttgcagtgagccgagatcgcgccgttgcgctccagcctgggcaacaaagagcgaaattccgtctcaaaaaaaaaagaaacaaaaacagcaagcagtgaggataaaagacaagagcaagtcctcactctcaaagaacctagacactagctgggttcaaagtggagcaaactagcaatcagtacaatagaagtgctaggtctgcatatgcacactcacatgcacacacactaacagtttcagagattgtccccttaccacctttgacagcacagtcaactgcaaatctgataggtaaaaaatagtatgtcatttaatctgcattcctttgattatttatcagaataaaaatgtttctcatatgcttcttggtcatttgtatttctttatgaactctgatcataaagtgataatacctgggtccagaggaagcactcagtgtcagctactgttattactattatcactactgttattttgttttaaggctaatcaagtgaagcagtgggagtggagaaggaacaaagaaatctgtaactggctgtgatcaattaatagtaaacaccaatatacttggaccagccactactgttattaaagactagggggagtaagtttccagaacagggtagagtccatcttaagcagaggtaactgcttgtgtgaagacccagaggcaaagaacaacagggttcacagaaggaactgggcacaagctatctgtactactgcgtacaggatgctcaggaagaagtggagagatgatctggcaaaacatttcaactctaccttcaaagctagttgagccatggtggaagagggagggatatgatcatacgcttgaacatgcattttacaaggatcatgttggcagcgacttggaagagagaaagcagtcaaggagaatgattacaagacaacagaaggtcacgcagccaaaagggcgatgaaggtctggactcaaaaaggagaagtaggatgactaggaaaatattatgagctaggatctcaagaatgtggtgactagaatggcacaagaaggaacccagaggcctctcaaatccctgatttgagtgactggctgggtgacactaccgctcactaagatacgaagataggaagaggttggactggggaagtggataagatcattttaaaatgcccataagatggccagatgcagtggctcacgcctgtaatcccagcactttgggaggctgaggcaggtggatcacctgaggtcaggagttcaagcccagcctggccaacatggtgaaaccccatctctactaaaaatacaaaaactggccggacgtggtggcgcacacctgtaatcccagctacccggaggctgaggcaagagagtcgctggaacctgggaggcagaggctgccgtgagccgagaccgtgccactgcactccagcctgggggatagagcgagactccgtctcaatagtaataataataataaaaaaataaaataaaatgcccataggacatccaagtagagatgtccaggaagcaactgtgtatatgggattggagatcagaaaactagtcagagctggaaaaacacacatttgcaaatcatcggcatatagacggcaagtgaggcacaagtttatctaaggcattcctcataaactgcacagggtgagaggaagaagggtcaagggaaggcaaatactaatgtttttaggagcaaaagaggaaaaaagtctgcaaagaaaaccaagagtatgggccagacttggtgactcacacactttgggaggccgaggcaggtggatcacctgagatcaggagttcgagaccagcctggccaacatggtgaaacccatctctactaaaactacaaaaattagccagatgtggtggcgggcacctgtaatcccagctactggggaaactgaggcaggagaattgcttgaacccaggagacggaggttgcagtgagccgagatcacgccactgcactccagcctgggcaaaagagcaagactccgtctcaaaaaaaaaaaaaaaaaagtttcaaagataaaacaaaaatcttgttaaagataaatacatgagaagctaaataaataatctacttctttaagtcatgctatcaatttgcaccaaaattttcatttcctatgtgtaggtgtcgagggtctagtacccatgataaatgatatacacctgttctgggctgaattgtgttccccaaaagagatatgtagtactccaggggcctgggcacagtggcgcattcctgtaatcctagcactttgggaggccaaggccacaggatcgcttgagctcaggagttcaatatcagcctgggcaacatggcaagaccccatctctactaaaaatatttaaaaatagccagatgtggtagtgtgcacctgtagtcccagctactcaggaagctgaggtgggaggattacttgagtccaggggttagggggctggaggttgcagtgatccaagtgccactgcactccagcctgaatgacaaagggagaccctgtctcaaaaaaaaaaaaaaaaaaaaagagatatgtagtactcctaacattcagtacctcagaatgtgatcttagagacgggatcttcagaccaggtgcagtggctcacgcctgcaatctcagcactttaagaggccgaggtgggtggaccacttgaggtcaggagttcgagaccagcctggccaatgtggtgaaaccccatctctaccaaaaatgtaaaaattagctaggcacggtggcgagcacctgtaactccagctacttggaaggctaaggcagaagaatcacttgaacctaggaggaggaggttgcagtaagctgagatcaccccactgtactccagcctgggcaacaaagagagactctaaaaaaaaaaaaagagataggatcttcaaagaggtcataaagttaaaatgaggtcatcagagaggactctaatcccaatatgacttgtccttataaaaaaggggaaattgtggacacaaagaaatacacacagggaggctgggcgccgtggctcacgcctgtaatcccagcactttgggaggctgaggtgggcagatcacttaaggtcaggagtttgagaccagcctgggcaacaaggtgcagccctgtctctacaaaaaatacaaaatttaggctgggtgctgtggctcatgcctgtaatcccagcactttgggaggccaaggcaggcagatcacctgaggtcaggagttcaagaccggcctgggcaacatggtgaaaccctgtttctacaaaaaatacaaaaaattacctgggcatggtgacacgtgactgtaatcccagctacttaggaggctaaggaaggagaatcacctgaacctgagaggcagaggttgcagtgaaccgatattatgccactgcactccagcctgggcaacagagcaagactctgtctaaaaaaacaaaagaaatacacacagggagaactctacataaggactggagttatgctgccaccagaagctagaagagaggcttgaaacagatcctgtcccagttgcttcagagaaagcatgcctctgcccttagatttctagcctccagaacagggagacaataaatttctgttatttaagccactcagcatatgtcactctgtggcagcagccttagcaaacagatgtcataagaaaattcgcagctcaggtttactaagtacctaccaggtgctgttctaaacactctgcgtgaataaactcatttaatccttataaagtccactctaggatctaggtactatcattataccctttttacagtgtggacaccaaggttctaagaggttaatgagcttacccagtatcacatagccagagccctctctctcaccactagtgtatgaggagctattattaacagtaattacaataagagctggcgtggtggctcacgcctgtaatcccagcactttgggaggccaaggcgggtggatcacttgaggccaggagtttgagaccagcctggccaacatagtgaaaccccgtctctactaaaaatagaaaaataagccgggcatgctggcatgcgcctgtaatcccagctacttgagaggctgaggcaggagaattgcttgaactcaggagacacaggttgcagtgagccgagatcgtgccactgaactccagcctgggcgacacagcaagactccatctcaaaaaaaaaaaaaattagtaattacaataagaacagtagtagtccactgaaccaaacactgccctatgtcctttacagatataatacaaaagtcctctgaagtaagtgttattatttccagtatgaaggaggaacctgaatctcagagagattaagaaaatcgcccaaagtcacacggttaagagtgctgagattaggccgggcacggtggctcatgcctgtaatcccagcactttgggaggccgaggcgggtggatcacctgaggtcaggagtttaagaccagcctggccaagctggtgaaaccccatctctactaaaaataaaaaaaaaattagctggccatggtgacaggtgcctgtaatcccagctacttgggaggctgaggcaggagaatcacttgaacccaggaagtggaggttgcagtgagccaagatcacctggacaacaaagcgagactcttgtctcataaaaaaaaaaaaaggaagaagaatgctgagattatatctaattgctaacttaaggggatatacaatgaaaacctgtttttactaaaactttaagaacaagttaattttttttttttctttaatgagacaagagacaaggtctggctctatcacccaggctggactgcaggggcgcaatcacagttcactgcaacctccacctcccaggctcgagccatcctcccacctaggcctctcaagtagctgcaactacaggtgcacaccaccatgcctggctaattttcttttgtatttttagtagagatggggttttgccatgttgcccaggctgttctcaaactcgtgtgctccagcgatctgcctgttcagcctcctaaagtgctaggattacaggcgtgagccatcgcgtctggccaagttaaattttttaatgcctgactttgcagttcaatactagaaatatacatctataaattcaaaattcttgaagatcccaagagaacacatgtcctagattatgggcccttttgcgtgtgtatcccctcaaccactgttcaagaactattctctcggctgggcacggtggcccacgcctgtaatcccagcactttgggaggccgagttgggcggatcatgaggtcaggagatcgagaccatcctggctaacacggtgaaactccgtctctactaaaaatacaaaaaattagccgggcgtggtggcgggcgcctgtggtcccagctactcgggaggctgaggcaggagaatgacatgaacccaggaggcacagtttgcagtgagccgagattgcgccactgcactctagcctaggtgacagagtgaggctccgtctcaaaaaaacaaaaacaaaaacaaaaaaactattctctcagttagaacccttgccatttctctgacttccagacacagaaagagaagaaaaggaaggattgagatgctgttctttaaaatttttttttttttttgagacggagtctccctctgtcgcccagactggagtgcagtggcacgatctcggctcactgtaaactccgcctcccgggttcacgccattctcctgcctcagcctcccaagtagctgcaactacaggcgcctgccaccacgcccagctatttttttgtatttttagtagagacggggtttcaccgtgttagccaggatggtctcgatctcctgacctcatgatccgcccgcctcggcctcccaaagtgctgggattacaggcgtgagccactgcgcccagctaaaattttcaattttctatttaatttttaaaatctgatacaaacatcagaaagtgtaaaaagatataatgcaatgagaagtctccttcctactctgtcctctacctgaacaattcctagacctaacaggtaaccagtgccaccattttcttatttattcttctaaaggtttgtgttgttgctgttgtttgagacagagtctcgcttggtcagccaggctggaggacagcggcgtgatctcagctcactgcaagctccgtctcccgggctcaagcaattctcctgcctcagcctcccaagtagctgggattacaggtgtgtgccaccatgccccagctagtttttatattttcagtagagacggggtttcaccatattggccaggctggtctcagactcctgacctcaggtaatccacccaccttggactcccaaagtgctgggattacacgtgtgagccaccatgcccagccctaaagatcttttttttttttttttgcatacatacaccaatgcaaattatctttttctcctgtttttttttttccaaaaaacacaaagggtatcaaatcatacatactgttctgcatcttgctttcatcacttaactgtctgccttgcagatctttctatatcatattaaattatgttttaattctctcgttttgcttgtcaagaacagtttttacttcatttcaccatagttcagtctagcacacaaggcatccagcagccctaagaactacctgaaacaactgatgatggctccatgctacacactaaagaccctgtatcttttctctcctcctcatcttcatttcactcttttctccgactcactcaattctccttcctttccctattcctctcccatctcacccactccttagccctaaccctgacaactagaccctagtaacatcactgacattgcttagtcgtggctagaaatattcaggctttaaaaaggtacagacccctaacacagagaaaaagggataaataataatttccatgagaacttctaattaacgagagtgccttaaattgaggagttttggcttggagttattcttccttgttacttgcctcctctggcattttcatttgtgaagactgagtgagtgtgacgctattttctatacgcatggaaacaagcacatactcagtctaacatttacgcaatgcctgacagaacgacagagttcattctacaataagataattggaaacaaaatataagatctatataaaataaacatttgggctccaaaatatgcactttaattaacctatcatttctttttacttaaattaagtagctccaatctgaaactacatcttagaaatgttttaaggatattcaccaatgaaaaagagaataaagttccctctccccacttttattttccagcccacaaactcaatgctatcctccccgcaaaaaggacctttttttctgaccagacgaacactgtaatttttaaggtttctaagtaataaaaataggaagaaaacattaccccccaaaattggtttacacttagaagatgtttcccactgagcaaaggattggtaaggaacataatattaaggcaaccacctaactgcattcttaagtagtaacaggtggtaactcacgatatggagctgatttcctttctctattcctgccatgccagagacctctagtagaacttctgaggttactgtattacaacccaggttcagagagatttagaggtaaaaccttaaacactggaaatatctttaaaagtagggctttgtgtaccaaatacattcgttaaaacctaggaaactataaaatgaaatccaatgtattgatctcaatccccttgcctgcttcctaaagaggacagaggccaccaacactggtgctcaacacttgctaagtcgaaacactcttacacaggtcctctgattcttaacgggttcagaacttctggttgcattccccatgcaacccctccaactctacagggagaatgctggaaaaactgtgtcactttggcttcctgtatattaatataagcactcttatccagcaatagcagctgaaacataaatgaagatgagaactcagcctacatgacctaagatttcccacaagtccagatatttaggttacacacactgcactattgtctgatttctcctctgcatcaatctggaagtccacagagcagattagcacccaacaatcttaactaagctagtatcctactctgaagaaaggcgaagctggtggagggtttccaagactccttatccttctctgtccttcctcccatcccctccttacgtcttttctgtttgtttttatttaattttttttttaatgtatttttagtcacaagaaaatcaaagaagccacctacttaagtcttaagctctgccctttgcttagtcctaatggagagttctttggccatctatgtacaagagattagaggagccaaagagactggagaaccacatcaatgggagctttttcatctaaaggtcatctgtccacactgtccaaatgaggtttaccctgtgaaataaaacttggtgtaagtgctacctgctgagaaaaatagtatgaaatgtcacacaaaggactggggtgcagcaggaggactctgaaagagtcatacgtgtaaaccagcaggtcttagaatgccctaatatactatatgaagtttcagagtaaacaaatggttaatgacacatcttttgtaacacatgaatcagctactgatttgcaagagtgggacacaccctagtacctatgactctaaagtacctgtttgaaaagtggacctagatgtttgaattgccaacccatcctaagaccggaacataattttacaactatgtaagttgccataatttaaagttaaaaagatcactgcctttcattataatggaagttaatttgagaacttcattaaaacattcacaccgataatcaaagaacagtagagatacaaagtaaaatatagccaatcaatcctaggaagcaaacacaagaggcaagagaaatggcaggtaaaggaagtgaagaatagcaaattcaaaaactacaatattcccaattctaaagaaaaatgaataaaatgaggctggtaatgaaaaaataacacatcttaccttaagaggcatccaagtagcattcatagtgtcaggatataaagacaatactcagaaatgagcaagaagtcttagtaattccctcggttaccaagtataagcaggtaggaaaatcttttgtttcgagaaggtatctgaaagagaggattttcatttagactaaaaaataatcaagacaatgcaaatagtttaagctacctgggcagggattttgaagtactatttgcctcatcgcactaaaaaagtatagaaaatacagtcccctttagaaaagggcaaatgtgtgtctccatatatatgtgtgtagaaacatactttacataaaaagagaaataaatatgtaacacgtattttagataatgtaaaattgcttatcaaacaattagccaaaatcccagagagaataaagtaattttccagggtacttcataaacactaaacgtgatttgttaactaaccgtctaaagaaagacccttgccacatttaattatatttagtaaagtaaaacttctctaatcatcccgactgtcccaagattatgcttaagtttcagagtcaattccacatgaaaagtaaaacctattcttgactgaagtactagaaacaaataaaagacccttcttccccagagatcgttaaaagcagaccgagcaacttaattttgagggtgggaggaaggtaaatttgcctggaggcaggaggatggactaaatgacctctggtaggatcctcgttcaagtcctgggcctgtatacaattccagcttaaccagttactgcttcgcttaaaatggaggcttgcctgcgtagggacaaaaataacagcacccacttcttaaaaataaatgtcgaaaagtacccctttttaaataaaaataaaaaataaacacctctggagtggatgtgttcttgctatgcgtttgtcactgaggcttcgaagacttggcatcactttccttaccgctcaccggattttgggggaggagcggggggcgacagtttgactcttgacccaagtctcaggcggacttcagagccccacaggggcccccaactccagagccagagggagcggagaggcgagagcccgagatcgcacctccccccaccgcggaccccagtcccaaacccacccctcacctccccgcagtggggcgcctccttctgccccattcccattgttagggagggcagagcgcggggtgggctcagggcaggggcgcccgcggccgttgcccggctcgcttcaggaggggcgccccgcgggatgcggcttcccttcctctccgcgtcggtccgtcccacctcggctcggcctggcgccccgaggtccgctccgcgcccccggccgcggccccggcccgccccccgggcagccaggccctcaggccagtcggccggcagccggcgtcccaggcctacgagtgggcgctgggcgggggtccccgtgccccacacacgcgtcccctctcccccagccccgccgcttccagggccctcggcggcgcccgctccccgggccccgcggccccccgcctcccagccgggccgctccctcgagctcgtcgggtcagggacacctcctctacctcaccatcaccctggcccactcgtgcccccacccccaggggcaccagtgccaaaggcagctcccccagccccggacctacctgcacggttcaaccaagcctagaagtgggggcggggaatcttccgccctcctctggcgcccattggcccttcaggggcacatcgtgagcgccattggctgagcaatggtgtccgtcagagcgatggggcgggacagaagggggagagggatgctggtgccttggcgtctctgtctctgtgtatctcgttgtctctgtctctgtctcggcccttggaaacgagaggcttttggctgagaggactagaagggggcctgaggtgggaggaataggaataggaatcctgacagagcgtcacgccagttggccactctgaacgccctacctaagtcccctttaggttctcttctccatcacccccaacccctgcccctcacccctcgaggttctttcatccaggaagcgacgtgatgaaaactccaggccggaaggccatagggagagatgttatatatgtatataaaatatacacataaaaatgtttatatataaactcaaccagatatcagttcactagggcctggaaaggaaagggcacacatctcacagacagggaaggacttgagatagagccggtagaagaaggaatcaaaaatcactctaagagctggcaacagtggttacctcctgggagaggaactgagtgcctagggaaccagtgggcggaagacttacatatctcggcatatcatttgtatccattgatttttgcaccattcatcaagattccaatttaaagaaaaggatttaaatgtttaaataaggtcgcaaaaccaggggacagacaagataattgggcaggaaaattggcgcaacatgcagatttggggaggaatcttagcttttaatatgttcagctcccggtaacagggttttgtaaaacccagtgaaggtgtcccagaggcaactgaagttatggaacttgagagagggtagacaatcaggactagagaagatgcagggtcctctgcctaaagatagtgatctatgacatgctaaaggataaactcccaaagaagggtaataagacacccacagtaaaaggtaggaggacgaaaaagaaggtcagtgaggtaaaagaaacaatattaaagaggcatgaaaattaagggaggaagggtctgtggaaaatagaataataaaactatgagagaggccgggcacggtggctcacacctgtaatcccagcactttgggaggccaaggcgggtggatcacctgaggtcaggagttcgagaccagcctgcgcagcatggtgaaacccgatctctaatagaaatgcaaaaaaaaaattagccaagcgtggtggcgcgcctctgtaatcccagctactggaaaggctgaggtgggagaattgcttgaaccgggaggcggaggctgcagtgagccaagatcgcgccactgcactccagcctgggcgacacagtgagaccctgtttcaaaaaaaaaaaaaaaaaaaaaaaaacaacaaacaaactgtgagagcctcataggtcttacctctttacctctttaggctctggtaaccatgggacaataagaatgaaagccaaggccgggcacggtggctcacgcctgtaatcccagcattttgggaggccaaggtgggcggatcacaaggtcaggagatcaagaccatcctggccaacatggtgaaaccacgggcatggtggcgcatgcctgtaatcccagctactcgggaggctgaggcaggagaattgcttgaaccagggagtcagaggttccagtgagccgatatcacgccactgcactccagcctggatgacagagtgagactccgactcaaaaaaaaaaaaaaaaaaaaaaaaaacaacacctttatcgattaagaatcttttttctgagtttattaattctatttaaatcaaccccagaaaacaccttcaacacagcctctcatttcatatctgtaaaatggggcaaaaaaaaaaatagttcctaccctttagagttgttgtgaagattaaattagtgaatacatatgatggatttttttttcttttttcttttttatgagacacagtctcgctctgtctcccaggctggagtgcagtggcactatctcagctcactgcaagctccgccttccgggttcacgccattctcctgcctcagcctcctgagtagctgggactacaggcgtccgccagcatgcccgactaattttttgttatttttagtagatacggggtttcaccgtgttagccaggatggtctcaatctcctgacctcgtgatccgcccgacttggcctcccaagtgctgggattacaggcatgagccatggcgcccggcctgtgtgatggattttttaagagcctgactggcggggtgaggtggctcatgactgtaatcgcagcactttgagaggctgaggcaggtgaatcacttgaagccaggagttcgagaccagcctgggcaacatggcgagacctcgtctctacaaaaacacacacacaaaaattagctgggtatgatggtgcatgcctgtagtcccagctactcaggagactgaggtgagggtcgcttgagcctgggaggcagaggttgcagtcagccgagatctcaccactgcatttcagcctgggtgacagtgtaagaacctgtcaaaacaacaacaacaaaaaaaacaaaacaacaacaacaaaaaaacgcacgaaaaaaaccacataagctccttgagggcagaaactgtcccctagtcttctatattttatttcacacaatgtacagaagactaaatgaataattgttagctggtttttttttttaaaggggataagatcagttacaatgtctttttcctcagtcaatcacataagtatctaaaatgacattccaaagtaaggacaggagtttaaatcctgaactatggtatctaaagtaaacttgaactttccttatttttaaaaaattttggccgggcgcggtggctcacgcctgtaatcccagcactttgggaagctgaggcgggcagatcacaaggtcaagagatctagaccatccttgccaacatggtgaaaccccatctccactaaaaatacaaaaattagctgggcgtggtggcacggacctgtagtcctagctacttgggaggctgaggcaggagaaccgcttgaacccgggaggaggagactgcagtgagccgagatcacgccactgcactccagactggcgacagactgtctcaaaaaaaaaaaaaaaagaaaaagaaaaaagaaaagaaaaaaattccatacatagaattctgtgtggcattttagagaaaatcatggtgactagagacaccaggtgaaatttttttttttttttttttggtgacacaaccccaggagatcctgtgaacatgtgtcccttgaccaggtgaatttcaggagcttgcactagtcccaggttagctggcaccaggttggccctagtttgagtgccttccacataccaggtactgtgctggagaagtaacatcaaaaaggaaaatcaaatttcatcttcaataagcaatcacaatacactgtgatgagagttagggtgaaggaggttcaggttaccatgggcttatattaggagggcaaattctgtcttcaagtctttttgcttcaacagtagcgtttagatcttgtgggctgggcatggtggctctagcctgaaatcccagcactttgggagggtgaagtgggcagactgcttgagcccaggagttgcagattagcctggcaacatggcgaaaccccgtctctacaaaaaatacaaaagtcagccaggcatagtggtgcctgcctgtagtttcagctacttgggaggctgaggtaggaggatcgcttgaccccaggagttcaaggctgcagtgagctaccatcgagccacttcacttcagcctgggccgcagaataagaccctgtctgaaaaaaaaaatcttgtgatataataacagcttgtgcactcttcgatagctcagctggtagagcagagggctgtagactgcatagataataataacagtttgcgtttttgagtcaaagatgataccccagaatcattatcgaaaataatggttgatccattcacctgtgcctatgactgtgagccacattgtgaccaatctgtgagcaacatgggtgggaatgcagtttggggccatggaactcacttaacaggaagttccaatagcagtggatttaccatgttgcggctgtaggatcttggacaaatatttaatgacctctgtctctcagttctctcaataataaaacatccctccgagagttgctgtaaaggttaacatagggggagtcttgcaaatagtaggtgctaaaatcctgtcttgaaaaaaaaaaaaaaatatatatatatatatatatatatatatatatatgaagagatgagatcttcaattgtacagactgtccctgtacccattcatttgcatttcttttcctttacaataatacatatctatgatttcctttcattcccactgtcatcaatttagttagattactgggcagagatcaccagtggggctagagtaaaatgaaaataaatgtacattgactctaggtattcctaagtaatagcacagtttactgtgttctccctcataaatcctggtagctgaatgttgcctgcttttagcagttacgtttctgctcatctcaccctcaatgttcattaagaaaatagttattgaatggccaggctcactggctcacgcctgtaatctattacaggcgtgagccaccgtacccagccttggttatcatatttctaatttataatagtttttcttgttttcttattgttcattttttatagcatcctgttcttatattatggatatatatcttcaggtctcgctgaagaaataaagaggtgtatgtgtatatatgtgtgtgtgtattatctttatttttattttttgagatggaatcttactctgtcgcccaggctgtagtgcagtggcgcttttgggaggctgaggtggaaggatcacttaaggccaatatttggagaccagccagggcaacataacaagacccccatctctacaaaaaaattaaaaattagctggccatggtggtgagtgcctgtagtctcagctacttgggaggctgaggcaggaggattgcttgagcccaggaggttgaggggggaggtgagccatgattgagccactgcactccagcctaggtgacagagtgagaccccatctctaaaaaaaaagagagagagaaataaaatagttattgagcacctactgtatgtcaggtccaagaccctaaagatgtaaagatgaataaggtggtgaccctgccttccagtttccacaaaggtggggaatatggataaaagcagacaaagccattgccatgggataagggcagagaatagcatgtgcaaattatagaaggtgagggataatataccactttccagaaactgatggttcaatgaggctaaagcatggagttcaagaaaggaaaccagatgagattaactgcaatgtggttctcaaacttaaatgtgcataaaaactggccttgttgactgggcacagtgactcacaccggtaatccaagcactttgggaggtcgaggcgggcggatcgcttgaggtcaggagttcgaaactagcctggccaatgtggtgaaaccccatttctttttttttctttttcttttttttttttttttttttttgagacagagtctcgctgtcgtccaggctggagtgcagtggcgtgatctcggctcaccgcaagctccgcctcctgggttcacgccattctcctacctcagcctcccgagtagctgggactacaggcacccgctaccatgcccggctaatttttttgtatttttagtagagacggggtttcaccatgttagccaggatggtctcgatctcctgacctcgtgatccgtccgccttggcctcccaaagtgctgggattacaggcgtgagccaccgcgcccggcctgaaaccccatttctactaaaaatgcaaaaattagctgggtgtggtggtgcacacctatagtcccagctgctcaggaggttgaggcgggagaatcacttcaacctgggaggtggagatggagtaagccaagatcaagccactgcactccagcctgagtgacacagcgagactctgtctccaaaaaacaaacaaacgaacaaaaaactggccttgtttacatagtctcgcaagctccaagcctagagatcttgatggagcgggtcagagtgctgctgctcggagggctacactctgagaaccaccgatggagaagaagggcggggtcaacttgcagagctgtgctgggaggtgtgtgctgcagccttgagggggtgaagaacctttgagaggttttaagcctgcaagagatgtggtcacatttatattttagaaaaatcaccctgtgtgcaatatgaaaaatgaaacagagagggcaagactggagtcagggagagcagttaggaggctgctgcagaaacccaggcaagaaatcataaagacctgaaataaaacaatgccagtggggaacggggaagagaggccaaatccaaggggtatttaggagccagaattgagagggtgtgatgagtgttgatgggatacaggacaggatcctgagatggcttgcaggtcttcagctttgagtgacccatggaagcgaaggaagatgggaaggagggtgcctatcacacagagagaatgaaggtttgagaggcaagtgtagcttttgacattttgcttttgaaatgtctatgggacatcagaaataatctcaaaagaccacaagtcaggcagggcgcggtggctcacgcttgtaattccagcactttgggaggccgaggtgggcagatcacgaagtcaggagctcaagaccagcctggccaacatggtgaaaccccgtctctactaaaaattcaaaaattagctgggcatggtggcgggcacctgtaatcccagctacttgggaggctgaggcaggagaatcacttgaacctgggaggcggaggttgcaatgagctgggatcgagccatcgcactccagcctgggcaacaagagtaaaactctgcctaaaaaaaaaaaaaaaccatgagtcactggttaacagcctgagcggcagaaatctcacagttctgagtctgaatcctatctagcctggctctgaaactcacaatctggagctggggcttggtgcagtggctcaggcctgtaatcccagcactgtgggaggctgaggcaggtggattgcttgaggccaggagtttgagagcagcctggccaacatggtgaaaccccatctctactaaaaatacagttagccaggcatgatggtgtgcacctgtaatcccagctacttgggaggctgaggcacgacaatcgctggagcccaggaggcagacgttgcagtgagccgagattgtgctactgcactccagcctgggcaacacagcaacactgtctaaaaaaaaaaaaaaaaatgctgggcgcggtggtttacgtctgtaatcccacttttagaggctgaggtgggaggatcacctgaagccaggagctcaagaccagcctggccaacatggtaaaacccgccatcccctccctgccatgccccatctcccccaacactctcccaccctgtctctactaaaaatacaaaaattagccgggtgtggtggcacacacctataatctcagctacatgggaggctgaggcataagaattgcttgagcccggaaggtggaggttgcagtgagccaagatcgcaccactgcactccagcctgggtgacagagcaagactctctcttaaaaaaaaaaaaaaaaagaattttttttttaaatatagagatgggctttctgtgtttcccaggctatactcaagctcctgggctcaagctattctcctgcctctgccttcaaccagcctcaatcctccaattttcttattttttatatttttcaacaccttttaaattctacattctggccagctgcagtggctcatgcctataatccagcactttgagaggttgagatatgagacttgcttgaggccaggagtttgaggcttgcagtaagctagaatggcgccacggcacagcagcttgggagacagagcaagaccttgtctcaaaagaaaaagaatttaaatactacattctaggagatttcttcaaccttcaaattttgtattgaatttttaattttggcttttatttatttattttttttttgagacaggttctcactctgtcacccaggttggaatgcggtggcttgatctcagctcactgcaacctctgcctcctgggttcaagtgattctcctgcctcagcctcctgagtagctgggattgcaggcgtggtccagcatgcccagcttatttttgtattttcagtagagacggggtttcaccatattggccaggttggtctcaaactcctggcctcaagtgatccacatgcctcagcctcccaaggtgctgagattacaggtgtgagccactgcacccagccttggctatcatatttctaatttatgatagtttttcttgctttcttattgttcattttttatagcatcctgttcttatgttatggatatatatcttcaggtctcgctgaagaaataaagaggtgtatgtgtatatgtgtgtgtgtattatttttatttttattttttgagacggagtctcactctgttgcccaggctggagtgcagtggcacaatcccagctggctgcaacctctgcttcccaggttcaactgatcctcccacctcaatctcccaagtagctgggattacaggcacctgtcaccatgcccggctaatttttctttctttgtttcttttttttttttttttttttttttttgagatagagtctctgttgcccaggacggagtgcagtggtgtgatctcggctcactgcaagctccacctcctgggttcaagagattctcctgcctcagcctcccaagtagctgggattacaagcgtgtgccaccacacccagctaatttttgtatttttagtagagatggggtttcaccatgttgtccaggctgatctcaaactcctgacctcaaatgatccaccttcttcagcccgccaaagtgctgggattacatgcatgagccaccacaccagcaaaatttttgtatttttagtagagatagggtttcgccatatgtgtgtgtgttttaagtttttctgttttcatttctcttggcatatatacctcggaatggaattactgggtcatatgggagctctgtgttaaacacttgtgtcatatctaagaaaacttgctaatccaaaggtcataaagatgtatgtctatgttttcctctaaggccaacatggtgaaacactgtctctattaaaaaaataaaaactgggccgggcatggttgctcatgcctgtaatcccagcactttgggaggccaaggtgggtggatcacctgtggtcgggagttcgaggccagcctgatcaacatgcagaaaccccgtctctactaaaaatacaaaaaaattagcagggcatggtggcgcatgcctgtaatctcagctacttgggagctgaggcaggagaatcgcttgaacgcaggaggcagaggttgcggtgagccaagatcgtgccattgcactccagcctgggcaacaagagcaaaactcggtctcaaaaaaaaaaaaaaaaattagttgggcgtggtggcgcgcacctgtagtcccagctactccagaggctgaggcaggagaatggcttgaacccaggaggtggaggttgcagtgagctgagatcatgccactgcactccagcctggcaacagagcaacagagcaagactccatctaaaaacaaaaaaaagagttttctacttttcagtctaacaaatgttttataaacaaaggctttgttatattttgagttaatttttatagataatatgaggtgaggtttcaacttcattctattgtgtgtgggtatccagttgtcccaggaccattgtttgaaaagacttttttttctacactttctctcattgaattgtcttggcatatttgttaaaaatcagttgaccttggctgggcaccatggttcacacctgtaatcccagtattttgggaggccaaggcaagaagaccatttgagcccagaagttcaaaacccgcctgggcaatataggcacactccatttctaaaaataattattaaaaagattagctgggcaggccagacatggtggctcacgcctgtaatcccagcactttgggaggccaatgcaggtggatcacctgaggtcagaagttcaagaccagcctgaccaacatggagaaaccccatttctgctaaaaatacaaaattagtctggagtggtgactcatgcctgtaaatcccagctactagggaggctgaggcagaagaattgcttgaacccagaaggcggaggttgtggtgagccgagattgcgccattgcactccagcctgggcaacaagaatgaaactctgtctcaaaaaaaaaaagattagctgggcgtggtggcacatgcctgtggtcccagtgacttaggaggctgaggcagggggatcgggagacggaggctgcagtgagccttgatcactgcactccagcctgggtgacagagtgagaccctgtctcaaaaaagaaaaaaaatcagttgaccgtaatgtgagcactcatttctggactttcaattctattccattgatctatatgtcagtccttatgccagtgcccaggggctcaactactggtactgtgaattagattttgaatcaagaagcgtgagtcttccaattttgttcttatttttcaagattgttttgtctatttgaagttccttacaatttaatgtgaattttagaatcagcttgtccatttttgcaaaaaaggtagttgggattttgatagagattgtgttgagtctgtagatcaatttgggaggcattgctatgtgaagagtagtaagtgtttcaatccatgaacacacaatgtcttttcatgtatttaagtttaatttctttcaataatgttttgtagtttgcacttccttggttaaattcattcctaagttttttttggtgccattacaaatggaattgttttattaatttcatttttggattgttcatttctagtgtatagaaattcaactgagccaggtgtagtggtgcaccacctgtagtcccagctacttgggaggctgagtcaggaggattgcttgtggccatgtttgaggctatagtgcattataattgtgcctgtaaatgatcactgcattctagcctcggcaacatagtgcagtcttgtctcttaaaaaataaataaataaacaactgatttttgtacgttgatcttgtatcctccaactttgcaaaattaatttattactattaagactttgtggctgggcacggtggctcatgcctgtaatcccagcactttgggaggccaaggcgggcagatcacgaggtcaggagatcgagaccatcctggccaacacggtgaaaccccgtctctactaaaaatacaaaaaattagccaggcgcggtggcaggcacctgtagtcccagctacttgggaggctgaggcaggagaatggtgtgaacccgggtggcagagcttgcagtgagccaagatagcgccactgcagtccagcctgggcaaaagagtgagactccgtctcaaaaaaaaaaaaaaaaaaaagattttgctttattttgtgtttggtgtggatactttaggaaccaaaagataaataaataagaacaaggtctagcactttggtcaaatttattcctaagtgtgtgtttgtaaacgatattgtaaatgaattttcttagtttcattttcagcttgctaattgttactgtatagaaatacaatttatttatttatttactttttttttttttttttgagacagtctcgctctgttacccaggctggagtgcagtggtgtgatctcggctcactgcaacctctgcctcctgggttcaagcaattctcttgcctcagtctcccgaacagctgtgattacaggtgcgtgccgcaacccccagctaatttttgtatttttagtagagatgggttttcaccatgttggtcaggttagtctcaagatgttcttttttttttttttttttatcattttatttatttattttttaatttttatttttttttaaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcctgcctttctattccacaaagccgccattgtcatcctggcccattctcaatgagctgttgggcacacctcccagacggggtggtggccgggcagaggggctcctcacttcccagtaggggcggccgggcagaggcgcccctcacctcccggacggggcggctggccgggcgggggggctgaccccccccccaccggtcaggttagtctcgaactcctgacctcatgatctgctcacctaggcctcccaaagtgctgggattataggcatgagccactgcgccaggccaattttttttatatcactcttacacctgcaactttgctgaatttgtttacttgttctgacggttttgtggattccttagaatttcctacatacaagatcatgtcatatgcaaatacatatggttttatttcttcctttctaatttgtgtggcttttatttctttttcttgctaatttcctggctagaaatttaagtataatgttgaatagaggtggcaagagtgaatatccttgtcttcttcctgatcttaggagaaaaacttatagtctttcatcattaagtattacctgtggggctggatgcgatggctcaagcctataatcacagcactttgggaggccaaggcgggtggatcatttgaggtcaggtgttcaagaccagcctggccaagatggtgaaacccccatctctactaaaaacatctctactaaaaatataaaaacttggcggggtgcagtggctcacacctgtaatctcaccactttaggaggccgaggcgggcagatcacgaggtcaggagatcaagaccatcccggctaacacagtgaaacccatctctactaaaaatacaaaaaaaaaaaaaagaaaattagctaggtgtcgtggcacacgcctgtagtcccagctacttgggaggctgaggcaggagaatcgcttgaacccgggagacagaggttgcagtgagccgagatcacaccactgcgctccagcctgggcgacagagcaagactccatctcaaaaaaaaaaataaacgtaaattagacaggcatggtggtgcgcacctgtagtcctagctactcaggaggctgaggaaggagaattgcttgaacctgggaggcagaggttgcagtgagtcgagagcatgccactgcactccagccagggtgacagagtaagactctgtctcaaaaaaaaaaaaaaggatttatgggaagtaattaaggtcaaatgaggtcataaagctgggcactgatctaatagaattagtgtctttatgagacgagaacccagagagctccctagctttctctctgccacatgaggccacttcaagaaggcaagccaggtaataaagcccacgctgaggtaggaggtggaactggactccagagatggggcttggacaccagaccaaattgatgactagctgaaacagggacagggtgaaagcagctttccataagacacgctcaaccagtgcaccatgtcagcttaccatttccatggcagaacccagagttaccaccccaccgccttttttttgagacggagtctcactctgtcgcccaggctggagtgcagtggcacagtcttggctcactgcaagctccacctcccgggttcaagcgattctcctgccttagcctcccgagtagctgggattacaggcgcctgccaccgcgccaaactgatttttgtatttttagtagagacagtgtttcaccatcttggccaggctggtcttgaacttttgacctcatgatccacctgccttggcctcccaaagtgctggaattacaggcctgagccactgtgctcagcctaccacccctttcaatggcaacaacttgacaacccagaagttatcagcctttttctagaaacgtctgtatagtctgccccttaatttgcatgtaattaaaggtcaatgtaaatatgactgcagaactgccctgagctgctactctggtcacactacctacagggtagccctgctctgcaaggagcagtccctctgctgttgctataggccactgcttcaataaaagttggcatctaggccaggtgcagtgggtaatgcctgtaatcccagcactctaggaggctgaggcgggtggatcatttgaggccaggagtttgagaccagcctggtcaacatggtgaaaccccatctctactaaaaatacaaaaaaattagttgggtgttttggcgcacacctgcactcccagctactcaggaggttgaggcgggagaatcacttgaacccaggaggcagagtctgcagtgagccactgcactccagcctgggtgacagagtgagaccctgtcccgaaaaaaaaaaaagttggcctctaacaccttcggtttgcccttgaattatttcctgggtgaagccaagaaccctctcagtctaagccccagttttgtggcttacctgccctgcatcaacaccagaaacttaaccctttgggaatctcgatcttggactttctagcctctagaaccatgagaaaatgatctgtattattaggctacccagtctatgatattctgttgtagcctggggtgactaagacattgagcctgtatgacttgaattttgttacctgcttggccccttgatggcatttcagtttgtgactcttggtttacgtgatcacgaagccaaaactgtttaggaaggaagcaaaatcaagacagattaaaaataaaaataaaaaataaaaggctgggcaccgtggctcacgccctcccagcacgttgggaggcaaaggtaggcagataacttgaggtcagcagttcaagaccagcctggccaacatgatgaaaccacatctctactaaaactacaaaaattagccaggcgtggtggtgggcacctgtaatcccaggtatttgagagggaggcaggagaatcacttgaacctgggaggtggaggttgcagtgagccgagatcacaccactgcactccagcctgggtgacagagcaagactctctctcaaaaaataaaataaaataaaataaaataaaataaaataaaataaaataaagagccgagcacgctggctcacacctgtaatcccacacttcgggagaaagaggtggcaggattgcttgagcccaggagtttgataccagcctaggtaacatggcaaaatcccatctcaattttaaaaaaattttaaaaaagaataatagggctgggcacgatggctcatgcctgtaatcccagcactttgggaggccaagatggatggatcacctgaggttgggagtttgcgaccagcctgaccaacatggagaaaccccatctccactaaaaatacaatattagcaggtcgtggtggcacatacctgtaatcccagctactcggaaggctgaggcaggagaatcgcttgaacctgggaggtggaggttgtggtgagccaagatcgtgccattgcactccagcttgggcaacaagagtgaaattccatctaaaaaaaaaaaaagaaagaaagaaataaggtattttacataaagattaaaaagaaattaaaaccattatttgaagataatggcttaaacagaaactctgcaaatccttagaataagaaagttcaggccaggtgtagtggcttgtgcctgtaatcccaatgcattgggaggctaaggtcggaggattgcttgagcccaggagtttgagacaagccgggtcaacataatgagatcgcatctctacaaaaaattgaaaaatgagccaggtgtggcagtgcgtgcctgtagtcctggctactcaggaggctgaggtgggaaggtcacttgagcctgaagagttcaaggctacagtgttatgatcatgccactgcactgcactccagcctgggagacagagcaagaccctgagaccctgtctcaaaaaacaaaataaaaaaccctcactatattgaacacaacatcaatgttcaatagccactctccttctccttttctaataaaattccacttttttgtgttccatcccaggaccacgatttatctaaactggtcattctggatcaataagtttggctaaaaataaataatatcgaaattggtcacaggaaatctattcttttttttttttttttttttttttttcagacaaagtctcactctgtcgcccaggctggagtgcagcagcatgatcttggctcactgcaacctctgcctcccgggttcaagcaattctctgcctcagcctcccaagtagctgggattacaggtgcctgccaccacgcctggctagtttttgtatttttagtagagatggggtttcaccatcttggccaggctggtcttgaactcctgaccttgcgttctacctgccttggcttcccaaagtgctgggtctgtcacccaggctggagtgcaatggtgcaatcatggctcactgcagcctcaacctccctgggctcagatgattctcccaccttagcctctcaagtagctgggattaaaggcatatgccaccatgcccagctaatttttctattttttttgtagagacagggcatccctaccttgcccaggctggtcttcaactcctggtttcaaaggatcctcctgcttcagcctcccaaagcactgggtctattattccctttcatattcaaacttaattctgcattttcaaggccttgaattttcaagggcagctttttctgtccctgaacttaatcttcagctcctctcacctcctgggaggttggggggtggggaagaaaagtcccaaccctctaatcctgctttggtcttttgccgccagcccccatcctgaagctaccagtcaatttgtttgcatacaagaagatatcactttggagattctaagtgtatacgaggaaatgaggtcaaagaccaaatatatatatttcactatatcacacttcaaacttttgtttactgtttcccttctcctactctattataaacctttgagggtggggactgtgagttatttatctttatattcccagtgtcaagagtgtttagctataatgggaatgaatctcaaagtttcttgaataaatgacaagaagaatcatagttgcatgaactaaattcattattctcagtccttgaggtaaatgaatatattgatattatgtctgcttactctttttttgcgagagagagaaagaggagggagggagggaaggaaggaaaaaaggaaggaaggcgaaaagagtgaaagaaaagagagagaaaaagagagagaaagaaggaaggggagggaaggaaggaaaagaaggagggaagaagggaaagggagggagaggaagaaaagaaagaagaaggaaggaaagaaagaaagaagaaaaggagggaggaaggaacgaagaaagggaaagaaggagggagggagggaaatgaaggaaagaaagaaaaaagaaagaaagaaaaaagaaaagaaaaggagggaggaaggaaggagggagggaaggatggaagaaagggaaagaaggagggaggaagggacatgaagagaataaagaaagaaagaagaaaagaaaagaaaaaagaaaagaaaagggagggctctgcgggcggcggcggcgcggggagccggttgcaggccgagatgctgcagatggacctgatcgacgcgacgggggacactcccggggccgaggaggacgacgacgaggagcgcgcggcccggcggccgggagcggggccgcccaaggccgagtccggccaggagccggcgtcccgcggccagggccagagccaaggccagagccagggcccgggcagcggggacacgtaccggcccaagcggcccaccacgctcaacctctttccgcaggtgcagttgtctcaggacacactgaataataattctctgggcaaaaagtacagttggcaggatcgggtgtctcgatcatcctcacccctgaagacaggggagcagacaccaccgcatgaacccatttgcctgagcgatgagctgcccccccagagcagccccgcccccaccacagatcgaggcacctccaccaacagcccacgctgctggagctggtgagcctgcggccgtgcttcagagactacagtgacgagagtgactcggccatcgtctacgacaactgtgcctccgtctcctcgccctatgagtcagccatcggagaggaatatgaggaggcctcccggccccagcctcctgcctgcctctccaaggactccacgcctgacgaacccgacgtccatttctccaagaagttcctgaacatcttcatgagtggccgctcccgctcctccagtgccgagtccttcgggctgttctcctgcatcatcaaccgggaggagcaggagcagacccaccggaccatattcaggtttgtgcctcgacacgaagacgaacctgagctggaagtggatgaccctctgctagtggagctccaggctgaagactactggtacgaggcctacaacatgcgcactggtgcccggggcatctttactgcctattacgccatcgaggtcaccaaggagcccgagcacatggcagccctggctaaaaacagtgactgggtggaccagttccgggtgaagttcctgggctcagtccaggttccctatcacaagggcgatgtcgtcctctctgccgctatgcaaaagattgccaccacccgccggctaaccgtgcactttaacccgccctccagctgtgtcctggagatcagcgtgcggggtgtgaagataggtatcaaggccgatgactcccaggaggccaaggggaataaatgtagccactttttccagttaaaaaacatctctttccgcggatatcatccaaagaacaacaagtactttgggttcatcaccaagcacctcgccgaccaccggtttgcctgccacgtctttgtgtctgaagactccaccaaagccctggcagagtccgtggggagagcattccagcagtttcacaagcagtttgtggagtacacctgccccacagaaaatatctacctggagtagccgcgcagccccgccctctgcgtcccccggccctcaggccagtgccaggacagctggctgctgacaggatgtggcactgcttgaggaggggcacctgccaccgccaggggatgaggaagtgggggccgctggctcagggtaggggagggtggggcaatggggagaggcaaatgcagtttattgtaatatatgggattagattcatctatggagggcagagtgggctgcctggggattgggagggacagggcttggggagcaggtctctggcagagaaggatgtccgttccaggagcacacggccctgccccatcctgggccatacctcccctgccagggctcgggtgctctggctcctgccttgatgaagcccatgtcctgccttgatgaagcctgtgccacctgcaagtgcccgccctgcccctgtcccaacacccaccgaagagccctgagctcaggctgagcccagccacctcccaaggactttccagtgaggaaatggcaacacatggaagtgaagtccctgttctcagctctgtcatctgcagggcttctgggtggctcctgccactgacctcactggcatgctagcctgtggcaggcctaggacctcagcggggaggaggagctgctgcaaggccctatcccagcaggagagggaggcttcctgactgacacaggctagccccatcttggtcctgtcaccctggccccaactattaaagtgccatttcctgtcaaaaaaaaaaaaaaagaaaagaaaagaaaagggagggagggagggaggcaggaaggaaggaagagagggagggagggaagggaggaagaaagggaaagaaggagggagggagggaaatagaaagaaagaaggaaagaaaaagaaagaaagaaagagaaataaaataaaaattaaaaaaccataaggttaaagtaaaccctttttcttcatacagattaaaacacatgacttcaaattacagctttgcttcttaatagcttggtgatgtaggacgttatgtaacctctctgtgcctcagtttcctcatttataaaatagggcaataataatatctagcccataaggcattgtgaggattaaatgtgaaatgctgatcacaaatacctagcagcccaatagatactcactgtaataattattatttttataatttctgcaaaagtatggtgatgattcttgggttaacctaaaggcagattttcttttatttcttcctgtttcttttcttttccttgttcactttaaagaattaaaaagaaaattgattccagcattttggaataaaaatttgcatcaaaaagaatttattcattttattgacatacaaataaaatgtcatttgtttattcaataaacatttattaaatgtctggtaaatttcagacatcatgccaggcacagggatgacaatgacaataagatgtggtctctgccctcagggagctgatagtccaggagactgacaagtagacaggtgattacatgcaatgtaacaaaggctatgatgtcatacaagaagacaagtgggagtatgtgatgggagtatggttttgaccagttcctcctcttagatttatccctttttctttggctataaagcaaaagaattggtcctatttttttttcttaactttgcaaattaaaccataaattttaataactttataaagataaaaggcaagcggtcagattcagtggctcacacctataatcccaacactttgggaggccgaggcaggtggataacctgagatcaggagttcgagaccagcctggccaacatcgcgaaaccctgtctctactaaaaatacaaaaattagctaggtgtggtggcaggcacctgtaatcccagctactcaggaggctgaggcaggagaatcgcttgaacctgggaggcggagtttgcagtgagatgagatggagccattgctctccagcctgggctacagagcaagactctgtctcaaaacaaaacaaaacaaaacaaaacaaaaagatgagcaacttgaattatggaggacactagaaatagtgtttcctacagaatcagggcttcctaccaacatagtcacttctagggttttcgacctgaaaagttctgtggcatattgtttctttgctatccacttttttttccctatttttccccctctttctctcctctactttatctcctagagatctaggtagttcccaaaggaataatgctttacggagtctaatgttgatttattaggtaaaaacagaaaatgacttttttttttacccacaagttccataccaaaaaatgaatgtaaacttcttatgcagtttcacacattgaaaatgcaggttattttaattccattgcatttttcagaattctcaatcgcaatcctctgacaactgttgaagatccgtatctctttaaattactggcattaaaatatctgtaagtactatagtactcttgggagtcatgagatgatttatactctttttaaatttttcatcaaagattaagtattttgcatttaggctaaaatgtcataatttaaattttaactgagttattgaaaaacattattggcaaaggaaaggatgtgtaatggtcaagatagccagcaggggaaagagaacagtgttgaagaacccatatagatttggaacatgtagacacatggaggaatattacttaaccaagaaagcaaaggggaaaaggtgttcattattctaaaaaggaagaaaagagtaaataatcaagatgggtgaatgcaatatgaaaatgagaagtaagataatggtaaaaaaaaaaaacagtgtaagacctactcttgaatatcattaatttgatgatgcaaatcaactttaatttctttaataagagctctctggaattttgcggcaaataaactgttgaactggcttgttttatagggaagccaaaattgaagtaatcacatgtccttgaattatctttttaagtacagaattttttactggggttcatatcatgaatgtttcggctttcttcttcagagacgtgggaacaacgcaagtcccacttacaacacttaagaacattctcatgatgaccgttgaactggaaaaactgtaagttatttttttcttagacttattttcaccctgttgcgtttttaggtttgttttattattttcttaagtcaggtttattgagatataattttcatatactaacattcaccctttttaagtgtacaatttgatgagttttgacaaatgtatagttacataaccaccaccacattcccaatataaagcatttctgtcgcctcaaaaaggtccctcgtgtccctttgtagtcaatcacctcctcccaccgtcagcccctgttagctactaatctgatttcctatagttttgccttttccagaatatcttataaatgaaatcatatagcatgtagcctcttgtatttgacttctttcacttagcataattttttcttttttgagatggagtctcactgttgcccaggctgcagtgcagcggcatgacctagactcactgcaacctccacctcccaggttcaagtgattctcctgcctcagcctcctgagtagctgggattacaggcacatgccaccacgcctggctaatttttgtatttttagtagagacgaggtttcaccatgttggccaggctggtttggaagtcctgacctcaagtgatccgcccgccttggcttcccaaagtgctaggattacacgtgtgagccacctcacctggcctcacttatcatattattttttgaaattatgctgccatccatgttgctgcacccatcactacagctggccctccatatctgcaggttcctcatccatggattcaactgaacatggatggagaatacttgaaaaaaatgaaatatataaaataactataagacaataaaaacagtagaaaatttaaaatacagtataattatttacataccatttacactgtattaggtatttaaagtatacctgaggctatatacaaacattatgtcatttcatagaaaagacttcagcatctgtggactttggtgtcggcagggggtcctggagccaatcccctgcagacaccgagggacaactgttcactcctttttattgctcagtagtattccagttgtgtggaaaccccatctctactaaaaatacacaaattagccagatgtggtggcacacacctgtaatctcagctactcaggaggctgaggcacaagaagtgcttgaagctgggaggtggaggttgcagagtctcctttacacttgctgtcctccctccactgccgcctgacacactcctccccagcagtggcctcttcataggcaaatttaaggagcaccttttagtccttgtcctgcttgacttggccctgatgtttgaaattcttgataaatctttcttccggaaacacactctttctatgcttccaggaaatctttttcttggttctccagacaacttcttagactccttgaccaattccttcttgttgccaacaatggaaacaaaccagccctacctaagcaaagcacattaaaactcactagaaagatacaggggagggggcgcccactaaaccactaaagagacaggaggtggggagctgtaggaccaggtttgggaacctgcaagaatcaagaccagagcccctgaaatagcaagaagctggaagcacaggaactgtcagagccagatggctgtcactgcagtcagcgcctctgattgtttgtttttgagatggagtctcgctctgtcgcccaggctggagtgcagtggcatgatctcggctcactgcaacctccacctcccgggttcaagcaattctcctgcctcagcctcccgagtaactgggactacaggagcctgccaccatgcccgactagttctttatatttttaatagagatggggtttcaccatgttcgtctcaaactcctgaccccaggcgatccacttgcctcggcctcccaaagtgctgggattacaggcgtgagccaccatgcctggccagtttttgtatatttagtagagactggttttgccatgttggccaggttggtctcaaactcctgacctcaagtgatccatccacctccgcctcccaaagtgctgggattataggcatgaaccactgtgcccagccacctctgatagttttcatcgtcctcgggccactggctcccaaatcacggttccagacaaaagcttacaagtagtccagctttggccaggctcagtgtgatggttaatactgagtgccaacttgattggattgaaggatacaaaatattgatcttgggtgtgtccgtgagggtgttcccaaaggagattaacatttgagtcagcgggctgagaaaggcagacccacccttaatctgggtgggcacaagctaatcagctgccagcaaggctagaatataagcaggcagaaaaatgtgagagactggcttagcctcccagccaacatcttcctcccgtgctggatgcttcttaccctccaacatcggactccaagttcttcagttttggaactcagactggctctccttgctcctcagcctgcagacggcctattgtgggaccttgtgatcctgtgagttaatacttaataaactcctgtatatattccattaattctgtccctctagagaaccctgactaatacgctcagtgactcacacctgtaatcccagtactttgggaggctcaggcaggaggatggcttgagccccagagtcttcttcttctccttctccttgtccttctcttcccttcccctttctcctcttcctcttccttctcttcctcttcctcttcctctccttcctcttcctcttcttcctcttgtttgtttgagaaaggttctccctctgttgccaaggctggattgtagtggcacaattgtgactcactgcttctcagcctcctgagagcccaggagtttgaggctgcagtgagctatgatcacactaccacactcctgcctgggtgacagagcaagaccctgtctcaaaaaacaaacaaaaaactctggtatgatagaggtgaattgtctgttttatcctgataattctgcttaccttagtcccgtggttctcaactgggccaattttgctccccaagtgacatttggcaatatctgggcagaggtcaaggacgctgcttaacatctttttttttttttttttgagacacagttttgctcttgttgcccaggctggagtgaaatggcacgatctcgcctcactgcaacctctgtctcccgggttcaagcgattctcctgcctcagcctcccgagtagctgggattatgggcatgcaccatcacgcctggctaattttgtatttttagtagagatggggtttctccatgttggtcaggctggtctcaaactcccaaccttaggtgatcagcccacctcagcctcccaaagtgctgggattacaggtgtgagccacctcacctgtcctgcttaacgtcttaaaacacacaggacaattcccccataaaaaatgatgaccagccgaaaatgtcaacagtatcaaggtgaagaaattgccataaaggcttggtaaacagggatggtatgacgacactattgataggccacattaaaatacttagggccatatccattatccctgtttttatgatttcttctttgtccccatgcagtttcaggggcaaaataagggagtaagtcagaggtggttccaaatagacatctgggaatcttagggtgtaatatggccctcatggaggcccttgctgagcttagggcctgattctggaatcctagcattgccaagagaggcaggctggcaggtgagaagacaaataatgggagagcccacatatgttggaattcatttgatggtatctaagctggggtgattgtccccactagcattacatgactatggatccagttatttggagaaatccatttcctccacagggaatatatactacattagaaccaaagatggaatccttagtaaatggaatcatttggcaaaattcagttgtctgaaatttttgcataaaattctcttttttattttcattgagccaaataaataaagtatcaggtatttactggggtcaccattctttgattcattgattttttttttcagacaggatctcgctgtcacccacgttggagtgcagtggcataatctcagttcactgcaacctccacttcctgggcttaagtgattctcccacctcagcctcccaagtagctggaaatacaggcgcgtgccaccatgcctccattttctttctttttttttttttttaattgatcattcttgggtgtttctcgcagagggggatttggcagggtcataggacaatagtggagggaaggtcggcagataaacaagtgaacaaaggtctctggttttcctaggcagaggaccctgcgccttccgcagtctttgtgtccctgggtacttgagattagggagtggtgatgactcttaaggagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtatagaacaaaatgaaaagtctcccatgtctacccgcctctacacagacacggcaaccatccgacttctcagtcctttccccacctttcccccctttctactccacaaaaccgccattgtcatcatggcccgttctcaatgagctgttgggtacacctcccggacggggcggctggccgggcggggggctgacccccccacctccctcccggacggggtggctgccgggcggagacgctcctcaattcccagacggggcgactgccgggcggaggggctcctcacttctcagacagggcggttgccgggcggaggggctcctcacttctcagacagggcggttgccgggcggagggtctcctcacttctcagatggggcggccgggcagagacgctcctcacctcccagatggggtcacggccgggcagaggcgctcctcacatcccagacggggcggcggggcagaggcgctccccacatctcagacgatgggcggccgggcagagacgctcctcacttcctagatgggatggcggccgggcagagacgctcctccctttccagactgggcagccaggcagagacgctcctcacttcccagacggggtggcggccgggcagaggctgcaatctcggcactttgggaggccaaggcaggcggctgggaggtggaggttgtagccagccgagatcacgccactgcactccagcctgggcaccactgagcactgagtgaacgagactccgtctgcaatcccggcacctcgggaggccgaggctggcggatcactcgcggttaggagctggagaccagcccggccaacgcagcgaaaccccgtctccaccaaaaaaatacgaaaaccagtcaggcgtggcggcgcgtgcctgcaatcgcaggcacttggtaggctgaggcaggagaatcaggcagggaggttgcagtgagccgagatggcggcagtacagtccagcatcagagggagaccgtggaaagagagggagagggagaccgtggggagagggagagggagggggaggggagggggagagggagagggagaggtgcattttcttataaacccaatttcctctttagtgcaactctaccatttgaaaggaacctttctattgtaatttacaagctgtgaataaccgctatgtaattctttccaaggattaataaactgagagaggatttgaaccaacagaggtaggggaagattagaagggggatgcaagtggccacagatcttagaggcggccagcagagggcgctgctccaaggtgaaggtcgcaccctgagaggccatccttttttgtaggaccagactggggtgtaaggacagtgcctcatcctcacaacgacagacccgtgttctgggtgtggatttgcctcccttgcctgcgggacttctgctagcactgccgttcctagacttagaccatgctagaatgagtccaggaaccgaggagaggagatgggagtggctcctcccactgtggcccctaataattcacatgaagaatttttgctttccttgccagggacccgggactcagtgggtccagaggtcctagtgccaaaggaagaaatgtgtagatcaggaaatactattatggttttattcaactggaagccgaggctggccatttattgtatttatttatttatttatctatctatttatttatttatttagagacagaatctcactcttgtttcccaggctcccaggctcaagagatcctcctaccttagcctcctgagtagctggtactacagtcgcatgccaccttgcccagctaattttttttttttttgagacgcagtctcattttgttgcccaggctagagtgcagtggcgcggtcttggctcactgcaacctccacctcctgggttgaagcgattctcctgtctcagcctccggagtagctgggattacaggcatgtgccaccgcgcctggcaatttttttttttttagtagaggcggggtttcaccatgttggccaggctggtctcaactcctgaccttgtgatccgcctgcctcagcctcccaaagcactgggattgcagacataagccaccgcgcctgttttttttgttttgttttgttttctgacagagtctctgtcacccaggctggagtgcagtggtgtgatctcagctcactgcaacctctgcctcctgggttcaagcgattctcctgccttagcctcccaagtagctgggattataggcgcacaccactatgcccagctaatttttgtatttttagtagaggtggggtttcaccatgttggccaggctggtctcaaactcccgacttcaggtgatccacccacctcggcctcccaaagtgctgggattataggtgtgagccatcaagcccagccctgcccagctaatttttacactatgggcaagtatgctgcccaagagtgctctggaactcctgggctcaagtgatcttccttcctcggcctctcaatgtgcttggattacaagcatgagccaccttgcccagccgaagctggccatttaaagttcctcatgctgctgaatcaataaggatggaaggcggctactattatgggctaagtgtttgcatcctccccaaattctttttttttttttttttttgagatggagttttgctcttgttgcccaggctagagtgcagtggcgcgatctctgctcactgcaacctccacctttcaggttcaagtgattctcctgcctcagcctaccgagttagctgggattacaggcatacgccaccacacccggctaattttgtatttttagtagagatggggtttctccatgttggtcaggctggtctcaaactcccgacctcaggtaatctgctgacttcagcctcccaaagtgctgggattaccagcatgagccaccgcgcccggcccccaaattgttttttgttttttttttttgagacggagtctcgctctgtcacccaggctggagtgcagtggcatgatcttggctcactgcgagctctgcttcctgggttcacgccattctcctgcctcagcctcccgaatagctgggactacaggcgcccgccaccacgcctggctaattttttgtatttttagtggacacggggtttcaccgtgttagccaggatggtctcgatctcctgacctcgtgatctgcctgcctcagcctcccaaagtgctgggattacaggggtgagccaccacacccggcctcggcccccaaattcttatgttgaagccctcacctccatgtgatggtattagaaggtggggcctttgggacgtaattaggctgacagtgccccatgatgggatgagtgtcttaaaagaaaagaccaggtggtctggctagtggctcacccctgaaatcgcagcactttgggaggccaaggtgggtggatcacttgagatcaggcgtttgagaccagcctgggcaatatggtgaaaagccatctctactaaaaatacaaaaattagctgggcgtggtggcgcaagtctgtaatcccagctacttgggaggctgaggtgggagaatcgcttgaacccaggaggtggaggttgcagtgagcccagatcatgtcattgcactccagcctccaacctggacagagagagcatctggagagtctctgtctcaaaacaaaaagaaaaaaaaaagaagagaccagagagcctttcttctctttgtccaccaagtgaagatatggcaagaaggcagccatctgcaagctaggaaaagagcccttgccagcacccaattgtgctatcaccctgatatgggacttcccagcctccagaactgtgagtaatcaatgtctattgtttaagccacccagtatgtaatactgagctgactaaaaccatcaccgaactagcctctttacatatgattagcaagaggaaaatggctctgttacttaatggaggaaggaggctatgtctgaaagccaaaaattcactggggacacatcttagcaggctcttgaccctaagacctggttaatggaaaagtagagcaacccaataaaaacaagaccaccaagaagtcaggtcttatggaataaagtattgagtgtccctatgaggcacagaacccttcgaaaggggattggaagaagtggtgaagaaggcggctatgattatcaacttagacttcatcgccatttgtagaaggaggcttctaacagctatgttttatgttaattggctcttttctcttcttttttctttcaaccttatattaagagcactggcagaagctagcggttttggcatcctgtaattattagctgtataaccttggccaagtaactcaacctttctgtgcctcagttactcatctgtaaaacagggtaataagtctcaacctcgtacttatgttgttataaagatttaacactaggctgggcatggtggctcacacctgtaatcccagcactttgggaggccgaggagggtggatcacctgaggtcaggagttcaagaccagactggccaacatggcaaaaccctgtctctactaaaaatacaaaaaattagctgggtgtggtggcacgtgattgtaatcccagttactcgggaggctgaggcaggagaattgcttgaactaaacctgggaggcggaggttgcagtgagccaagatcgtgccactgcactctagcccaggcaacagagttagactctgtctcaaaaaaaaaaaaaaaaaaaaagtaacactttgaacaaaaaagaaaaaaataataaaatttaaaaaagatttaacaattgggccaggcatagtggctcatgcctgtaataccagcactttgggagcctgaagagggaggattacttgaacccaggagttccagaccagcctggacaacaaagcaagactttgtttctacttaaaaaaaaaaaaaaaacaccaaagtcaggtgtggtggtacacacctgtgatcccagctacttgggaggctgagatgggaggatcccttgagccttggaggttgaggctgcaatgagccatgatcataccactgcactccagcctaggcgacagagtgaggcccatgtcaaaaaaaaaaaaaatgatccccaacatttagcagcttaaaacaaaaaacatttattatatcacactttctgtgggccaggaatctgggagggacttagctgggtggttctgctcagttctcttgggatgtttcagtcaagcagtggcctggggctgcactcttatctgaagactcaattgggagaaaatatgcattcaaggtcactcattggttgttggcaggctgtagttccttactgaatattggttgaagacttcattggcttactacctggacttctccatagactgcttgaatgtcctccccacatagctagagtgaatgactaaaaaagagagagaacacacacagcccaggtaagagttcagtctttctaagtcattatatgaaagagattcttttttttttgagatggagtctcgctctgtcgccaggctggagtgcagcggcacgatcccagctcactgcaacctctgcctcctgggttcaagtgattctcctgcctcagcctcccaagtagctgggattacaggcgtgtgccactatgcccagctactttctgtatttttaatagagatggggttttaccatgttggccaggatggtcttgatctcttgaccttgtgatccacctgccttggcctcccaaagtgctgggattacaggcgtgagccaccacgcctggccgaaaaagattcttgcacacacatgtttatagtagcactattcacaattgtaaaaatgtggaaccagtccaaatgcccatcaatcaatgagtggctaaagaaactgtggtatagatatacagtggaatactactcagtcataaaaaggaatgaattaatggcatttgcagcaacctggacaggattggagactattattctttttttttttttttttttttttttgagatagagtctcacttggtcacccaggctggagtgcagttgtgcaatcttggctcactgcaagctctgcctcctgggttcacaccattctcctgcctcagcctcccaagtagctgagactacaggcgcctgccaccacgcccggctaattttttttttgtatttttagtagagaccgggtttcaccatgttagcctggatggtctcgatctcctgacctcgtgatccgcccacctcagcctcccaaagtgctgggattacaggcatgagccaccgcacccggcctattttttttttttttttttttttttttttttttttactaaccaggggtttaacataaatacaaccagcatagaaagacccaaaactatacagaaaccaaaaccagaatgccatgtggtggaggcaaagggcagaatttctgacccctttggctcagctgcccttccccacaaataaaaaccaacaaagaggacaaatcaggacaataaagaagattcatgctaagctgtggcagaggggggaaggtatgatcgggtgggggtgggataaggaatggccatggaagataactgggtcaggttggaccctgggctgggagggggagggcaaggcccctcaccacaacttaagccaaacctaagctgcccccaggtgccataggtccctgtcccagcagggaggctgatgggcctgggcccatgcccctccccacctttgggggtcagatagtggccacccaggtttgctgggttggggcctgatacaggctctgcatgcccattcgggctgcctgtggagagagaatggagtcactgtttaaccatgctacctgcctcagccccagcagaccacaggaggttggccccagactcactgagtgcctgcagcagccctacagacacagcatccttggccacctcatgcccatcccggccatctagggtcagcacaacccagatgaggccgctgaagggcaccggatgcccaggaatcaccacctggtaccagaagcggtgccagccagcaggtcctatgcccaaacacttggtgaggaacacagggctgcccagcttcattcgttggcacagcaactgcagggtagcccgagccccttgggaccctaacttgtcccttgccaaggccaactggctgccctctggctgtggggaccgcaaggagggacccacaagctgctggcgaagtcgctgcttcagttctggcttgagccactccacagccacctgctctccacagaggtgtggctgcccttcctccagggcctttttggccatggcagcggtccagtgcgagctgaatttgagcagagcgatctgcccgggcgcaggtccggggctgggcagcagccgcgcctcctgcaggccgggacccagcggctgcagcgcgggcagcagcgcgggcagcagcgcggtgcgggtcagattcggcggcaggcagtcaacgctcagctcacacttcccggtgctgcggcacacgagcagcgggcaggacggccgcagcgggtggttgtgcagcgggcgatggcggcctgcgcgccgcgccgcgagctgcagcgggcatatgcgaagccgcggttcaggccgctgaaggtcatcatcaggcggaactcgtagaggcggcccacgcgctggaacagcaggatagctggtgctcatacacttcctgaggcagccgcccgatgaacacctctgacccagccggcggcgggctgcccacccagcctgggggtggcccgccatacttcctctgcccgttcacctgcaccaggcgatgcctgtctccctgacccacgcctccagcgccgccttcaccctctcacaccacagctcacaatcccgcttggactgcatggctctctattctcttttttttttttttttttttgagacgtagtttcactcttgttctccaggctggagtgcaatggcgggatcttggctcaccgcaacctccgcctcccgggttcaagcgattctcctgcctcagcctcccaagtagctgggattacaggcatgcgccaccatgcctggctaattttgtatttttagtagagacggggtttctccctgttggtcaggctggtctcaaactcccgacctcaggtgatccacccacctcggcctcgcatagtgctgggattacaggcatgagccaccgtgccccgtctatggagactattattctcagcgaagtaactcaggaatggaaaaccaaacatcgtacgttctcactcataaatgggagctaagctaggaggatgcaaaggcataagaatgacacagtggactttggggaatcagggggaaaggatgggaagggggtgagggataaaagactattaattgggtgcagtctatattgcttgggtgatgggtgcacacaaatttcacaaatcaccactaaagaacttacttacgtaaccaaacaccagctgttccccaatatcctatggaaataaaaatttttttttagaaaaagagttcggtctttctgtaacctaatcttggaagtgtatattatcacttcttccataggctatcagtctcccagaccaaccctgctacagggtaggggagactacatggtatgtgaataccagaaagtgggggccactggggactggctatttggaggatggttactacaaactatatttgtaattttttttttcttgagatggagtcttgctctgttgcccaggctggagtgcaatggcacgatctcagctcgctgcaacatccacctcctgcgttcaagtgattctcctgcctcagcctcccgagtagctgggattacaggcacgcaccaccacacccagctaattttttgtatttttaatagagatggggtttctccatgttggtcaggctggtctcaaacgcctgacctcaggtgatctgcccgcctcggcctcccagagtgctgggattacaggcccgagccatggtgcctggctatatttgtaatattttaaccactaaaaaaaaaaaaaagaagaagaagaagaagaaaaagaaacaagtatgggaaaatattaagatctgataaaaccgggttatacttatgcaggtattcattacattattctccataactttttaaatgtttaataataaaagtaaaaatattttccccttaaaaatgtgcagagcatacctcaaataatgttgacaaagaatcctaaagacaattattattattattattttttgagacaggttcttgctctgttgcccaggctggagtgcagtgatgccacctgagctcactgtaaactccgtctcccgagtttaagcaattctcctgtctcagcctcctgagcagctgggactacaggcgagcaccatcatacctggttaatttttatattttcagtagagacggggtttcatcatattgcacaggctggtcttgaactcctggcctcaagtgatccacccaccttggcctcccaaagtgctagcattacaggcatgagccactgcaccgggcctctcaaactcctgacctcaggtgatccacctgccttggcctcccaaagtcctggcattataggcgtgagccactgcgcccggccgatcttccttcctttctcccttcccctcttcttcttcttcttcttcttcttttttaattaatagagatgggattttgccatgttgcttaggctggtttcaaactcctgggctcaagctatctgctcgcttcagcttcccaaagtcctgggattaagggcgtgagccactgcgcctggccccagtaaggatttaaaagctcaggaattattagtcagcttccttttttgttcatcctgttgtttgttcatttcagtctattccctttttataatttccttcttcataaggactatttctccttgtacttttgtgagaattcccgtaacttgtaatcccagctacttgggaggctgaggcaggagaatcacttgaaccgggaggcggaggttgcggtgagccgagatcaagccattgcactccagcctgggcaacaagagcaaaactcggtcttggaaaaaaaaaaaaaagaaaagaaaagaaaaaagaaaggaaggaagatcctcattggacagagcaaaaagcagaattgatggcactgaaaatgaaatcagcagctgatgtacaagttccagaatgtctcctagagtaacaaggaaatccgggtgtggtagtttatgcctgtcatccaagcactttgtgaggccaaggaggttagttagcttgagcccaggagttggagaccagcctggccaacatggtgaaaccccatctctacagaaaatataaaagttagctgggtttggtggtgggtacctgtagtcccagctactctggaggcgaaggagggaggatcacctgagtcccgcgaggtcaaggccacagtgagccttgatagagttttgccactgcactccagcctaagcaacagtgagaccctgtctcaataaacaaacaaacaaacaaataaataattgtagagacagaagataaaatggagcccggtgcagtggctcacgcctgtaatcccagaactttgggaggctgaggtgggcagattacttggcccaggagtttgagaccagtctgcccaacatggtgaaaccccgtctctactaaaaatacaaaaattagccaggcatggtggtgtgtgcctataatcccagctacttgagaggctgagacaggagaatcgattgaacccaggaggtggaggttgcagtgagctgagatcacaccactgcactccagcctgggtgacaaagccagactctgtctcaaaaaaaaaaaaaaaaaaaaaaggctgagcacggtggctcatgcctgtaatcccagcactttgagaggctgagccgggcagatcacctaaggtcgggagtttgagaccagcctgaccaacatggagaaaccccgtctctgccaaaaatacagtattagcaggtcgtggtggcacatgcctgtaatcccagctacctgggaggctgaggcaggagaatcgcttgaacctgggaggtggaggttgcagtgagccgagattgtgccactgcactccagactgggcaacaagagtgagactctgtctcaaaaaaaaaaaaaaaaaaaagagagagagacagggtttcaccaggttggccaggctggtcttggactcctgacctcaagtgatctgcccgcctcagcctcccaaagtgctgggattactggtgtgggccactgcatctggctcccaccatctctattaaaataagataaaataaacataaaataatgaaccgacaaaataataatacaattcattgtaagtaaaatgctatcctgagttctgtgagtcattctggataattcaaattctctagaattaccacctcagctgactttttttttttttttttgtagagaccaggctggtcttgaattcttgagctcaagtgatccgcttccctcagtctcccaaagtgctggaattacatgtgtgagccactgagcctggcctacaaattctttattatacaacacacagtagatgctcaataaatatttgctaagcagaaacatacactcaaaataccagaaattatcaaggaagttgccagttggtctcttgggttcttcctcccgacaggtatacacacctattgtaaagatgaacacattaggctgtgagaaaccaatactgttaaacattccaatcaggtgacaaactccctgggctctggtttatattaccaagcaacctgatgataacttggcttcctgtgtggcttgtttatagaaagagaatgctacccaggctgacgtgagttgcatttctgagttgatttctcactgtaaattaataaactggcattctggctacatagatcagtctctttgaactctttgtaccttccaccattagtgtgatttctaaggctgcaagccagacactgcccaagacccagcactggactctggtgagttcttccagctgttgccaccccaggaggctctgggagcccctgggaaccatccagcttgctctctgtctctacatttcagggtgtgggtttcagggcattcacaacattcctgcaacagaagagttttgggaacacccccagcaggatgtgggtgatttgaatgtatgtcagagatgtggttgtaactgagaaatcttaagcctagtgaattttattccacttgacttaaataaagagcacgtgaaagaaggggatctgaggacatctatgaacagggccccgagggcatgaacttactagtgtttatatgactagtgtttatctgggcctgtctagtctggagaacctgactctggtgtacccaagctttgcagtggctgtagaggtttgctcttttggagggagaagataattcattcctccaacacctgaatgagggtagattaacccacctccttcagctgcaatttggcaaatttctcttctttgatttaatgctcaacggacaaatttcctttcttcttcttcttcttcttcttcttcttcttcttcttcttcttcttcttcttcttcttcttcttcttcctcttcttctttttttctcctcttcttcttcttcttctcctccttctccttcttctccttcttcttttctcttccttctcctcctccttcctcctcctcctcttcctactcttcttcctcttcctctcctcctcctcttcctcctcctcttccttcttcttcttctttctttttttttcggttttgagacagggtctccgtcacccaggctggagtgcagtggcacgatctcggctcactgcaacctccacctcctaggctcaagcgatcctcccacctcagcttcccatgtggctgggaccaaggcgtgagctaccatgcccggctaatttttgtattttttgtagagacagggtctctccatgttgctcaggctggtcttgaactcctgagctcaagagatcctcctgtctcaggctcccaaagtcctgggattacaagcacgagccaccatgcccggcctcaacaggcaaccttctgattaataattagacctctgtgccggccgtcgtggctgatgcctgtaattccagcactttggaaggccaaggcgggtggatggcttgaggtcgggcgtttgagaccagcctggccaacacggtgaaaccccgtctctgctaaatatacaaaaattagcctggcatggtggcgtatgcctgtaatcccagctacttgggaggctgaggcacgagaatcgcttgaacccgggaggcagaggttacagtgagctgtcatatataatgaaacagttttactaaacttaggaagcagtgacttggtgtctctagaaattgcctaacatacacattccaggatacattctctgtcatctggaatctcctcccttccacaaacccacgctgtcttaagcactattttcctatttgttgttgacctaatctagaaaaaagcggccatcactctttctcccccactcagtccctcagtcccgaaacacccttattctccgcacttgtcaccccaccctctgctgcccccaccgcagcgcgcaaacgcacacgagtttaaagtttaggctgtgatgctatcctcgcccgcagatcacaggacagacattctcggggacaactttgcgaggccatgtgctcgtcccccttaggaaggaagagggagaaatccctgcggctcggttttgttccaatggtctgctcagcgagtgattcccgtttccccaaaggctgcccctcattagcatgaacggggacgcgggtgtggagaaggggttagaggagagaaagcaagcaaaagcccaggctcacttttagagcctgggaaccctgtctgcaaaaatgacagctagagctttctggctcctctgtttaatcgtcggatcatcccccgaagctccggtggagagaaaaagtaagatcggtgtagtgcggagccctgggagcggagcggggatctggggagggggcgcccaggcctcagccgccggccgacaaccgggccaccttccgtgaggccgcacacgctcccacaggcccgcgcctggcgcaagccgagaaccgcgcgtcgccgcgccgcgggcccgcgacggaggaagccccgagacgcgcgcgctcacgggccctacgcttccccgccgcccggccgcgcgcgcgcgccgccgagggccccgccggccctgcccaccccaaccggccgcgcgccgttgtgccggcccccggctcgccgcccgcgccgccgccgcgcctcagcttcagattcggcctcagtcagccgcgcagggacgcggagcccggcgccgagctctgcgcttgcgcttgccgggcgggcatggacgggcgagaggcgttctgcaagcgcgaaatcggtgagcccggccgccgcgccgccgccccgcgagcctttccgagtcccggagaatcctgcacgcgagatcccagggcgcccgacccatgcgggccgtttcgctgttgctaaaaaccaacgcccagggactgggagaggaactggggttcccaaactgttttttggaagcagcgatgaacgggatagtgcatgacgtggacgtgctgggcgcgggcatctggctggtgaccctgctggtggatcgggacgggctgtacaagatgaaccgcctgtacctcactcacccccgacgtcttcttcttccgagtccacatgttagtcctggactcctccagctgcaataaaccgtgtccagagtttaaacctggtattgaaactgagctgaatgacgctgcatatgtactttataccaccgtttgtaacgtgggtgccacagcccgggctgtgggtcgtccagtctttttttgggacggatgggggacagtattgtaacatgattaggatttagacgacaggtattatttccgccactgtgatttaagcaccgtcagccccacccccacgggtgagaacggcagctgttggcacaaagcgggctgtcaataaatagatgttgacaaatggagtgagcgaccaccaaacaccattgccagaagggactgtacagaactgagtttagaaaagctgcttttttgggggagtgtgtggagggttggtagcggggaatacccactcccacatcttttttttttttttttttttttttttagacagagtctcgctctgttgcccaggctggagtgcaatggcgccatctcagctcactgcaacctccgtcccccaggttcaagccattctcctgccctcagcctcccaagtagctgggattacaggctgagccactgcgcccagccccactcccacatctttctaggcatgtgctctgggaaatcctgatacaatgtgataaggacctttgttctgtaatgtgggctggttacgtattgctttcccttccccacaccccgtgctactttttgtatttttagtacagatggggtttcaccatgttggctaggctggtctcaaactcctgacctcaagtaatctgcccgcctcggcctcccaaagtgctaggattaaaggcgtgagccactgcactggcctggttgggttggttatcttctaaaggtcgctagactgtttccaccttgcctgtagactaaatatcagtttcaacttgtgcagcaagatagtagattgcagcttaggtatttcttaaaggccttatattttctgtttcatggcatttaaaagacgctatgaattaatgttctggttattttgtccaggcagcaggtatattgtgatgggccacatctaccataagagagggcagcttcctacagctctgctccaggtcctgagaggccatctctgtccaggggatggactgctgaggagcagcagcagctatgtgaaaaggtttaacccaaaaagggaagggcaaattcaaggtgcaattcatacccaatgcatttgaaacaaccatcctggcatttctggatcacaagagacatcggcaacaagacatgaaaggtctatcttcatgtaatgggtcctcctttagaagagagcccaaagctactctatgaatgacctgcatagttacaactgtaatctcgaaggtgtcactttgttatttacaagatgcttcttaaatgggctgctcctgagctcagtgtcaaggtgattcaactgttgtgccagacagtgatttacacagctcagataactgacctgtctagttaacagatcactgcttcatgtttttaaatattttaatttaatacattctttagtagaaatagtccacaaaacattttcctgaatttaaatacacaacttttatatcatgtatcaaacctgattttatattcaaacctgatttatattcaaaacttatatgtgaagattaaattcttcacataacagtaagcgcactagtcaaaagacatttacctatgaaacgtcatttagatcaaacacaagggtcaaagcccaggacaaggattaaaattttacacttaaaaagtaccaagccgggcgcggtggctcacacctgtaatcccagcactttgagaggccgaggcgggtggatcacctgaggtccggagttcgagaccaggctgaccaacatggaaaaaccctgtctctactaaaaatacaaaaattagccgggtgtggtggcacatgcctgtaatcccagctgagggaggctgaggcaggagaatcacttgaacccaggaggcagaggttgtggtgagccgagatcgcgccagcctgggcaacaagagcaaaactccgtctcaaaaacaaacaaagtgtacaaaagggccagtgtgcggatgggtggattaaaaaaataaattttaaaaaagtgccaaagggcttacttcaggcaaaagtgttcctgatgtaccaaagagtaagatatagtttattttcatgcctccctgctcctaataatgtatgttttgtgctgaactggcagctatcccaatgtgaactgtattctgagtgtatctgatatcatttttctattaagaccaagtataatgtttgcttgtaaagcaataaatcttgctttgaaattagaccttggatgcacctgtttatttttgttttgttttgttttagcctttgagccctaaaggtttgagaaaaagcctttctcaaattcattccccaaaccttggaaccaatattaaccaatgacagctcacaagcaagtgaattctaaacatttttcagttggttttaaaaaggtttaatcactagctaaattaaatattgattttatacctgagtccacaaagacatgagagtattttttcagaagataaggctgtacttcagtttataagaagtacggtgaacagagacaccactaatgcatagatgaagatgactgcctaaagagagacaggggaaggaatttcactggagagagagcagcctatttggcctcacggtgatgcactcaggaaggtcagaatgtgtcctgacgctgtccatggcacccagtagtagcactgtacacataaaggacatccaggacgggacgctagggaatcacaggagccaagaggcaacagcctaacattacaatacctgatactattatttgttccaattatggggcagacaggtaataaagagttgagaggttctgagtgttctatggtaaagcactactgagagatttctagagtattttccaaaaatgagttttgtccaaatttattataaattttactagaattgctttttgggagtcagatgcattattgcatgatagaattatagctaatgaagagcttctgagctagttttctttaagataaaaaaaattaactcaggcataactcaggccagtcaaatcaaagttgaatttttaaatgtcaaaaggctaggccgggagctgtgactcacacctgtaatcccagcactttgggagaccaaggcgggtggatcacaaggtcaggagtttgagaccagcctggccaacatagcgaaactctgtctctactaaaaatacaaaaattagctgggcatggtggtgcatgcctgtaatcccagctattggggggcaggaggatcgcttgaacctagtaggcagaggttgcagtgagccgagatcatgccactgccctccagcctgggcaacagagcgagactctgtctgaaacaacaacaaaaagtatatctatatggctaatttctttagttgaatttggttcaaattggatcaagtggtataatcttctaagaaaagtcttttagtatctcactccaagtatctagaaataccttagaatgtttcaaattattaaaaatacttctcggttggctcttccctccacctcctcaagtacttcattattttatccatggaatatccccattctcacattaagggcaagaaatctgagacctatggtaatagtttcttttttttttttttttttgagaaggagtttcgctcttgttgcctaggctggagtgtaatggcatgatgtcagctcaccgcaacctctccctcctgggttcaagtgattctcctgctctagcctcccaagtagctgggattacaggcatgcgccactttacctagctaatttttttttttttttttttttgtatttttagtagagatggggtttctccatgtttgtcaggctggtttcaaactcccaacctcaggtgatccacctgccttggcctcccaaagtgctgggattatacgtgtgagccaccacgcccagccgtatcatgatagtttcaatcaggaagagtgaaagctgtaataaccatgtaactttgtctaactaagtgtgcagagatctgaaagtccaccaggttggctctttaacataaagaagtagagagtttgcctaaaggaattagcagaaatagggaaataacttttatttgcagatcccaggaaggtagattacaaacaacagcaaatcttagtgtctctaaataacactctaggccatttggaatataaaaaggtaattattttacttcagaaaatatctccaaaagttcactttttttttgagacagagtcttgctgtgtcgctcaggctggagtgcagtggcacaatctcagctcactacaacctctgcctccccagttcaagccatcctcccacctcagcctcctgagtagctgggactacaggtgtgtgccacttgtccagctaaattgttgtatttttagtagaaacagggtttcaccatgttggtcaggcaggtctctaactcctgaccttgtgatctgcccgcttcagcctcccagagtgctgggattataggcgtgagccaccatgcccagccacaattttatttaaacctcctgtagaatttggataggagaataaaagctttaccaataggaaaatacttttcatgaaatggtttcaaggattgtgaacttggcaggtgaagcataacagttattgaaaatacttttagccaaggaaatctactgatgcaaattaaatatatttacaagcccaaggcctgtggtagaaacatcctaagagtatcacaaatgtacagtttactgcctggattattgaaagcaaaatagctgtgttatatagatcttaatagcagaagctttcaaagattactcacagaaaagcagctttcagaactcattatgttctaaaaaatgtatgtttttctttcttttttattttttttgagatgaagtctcactcttgtcccccaggctggagtgcaatggcgtgatcacggctcactgcaacctccgcctcccaggttcaagtgattctcctgcctcagcctccctagtagctgggatttcaggtgcctgccaccatgcctggctaatttttgtacttttagtagagatggggtttcaccatgttggccaggttggtctcaaattcctgacctcaggtgatcccccctgcctcggcctcccaaagtgctggggttacaggcgtgggccaccacacctggccaggaatgtgtgtttttcaaaaattacttttgaaagactaaagccctatagttgataaaactataaaatgtctttatgtatttgtatggtgatagaaactgtaaaacactttataccattaaatacacatgaaattaatatcttcctggtctcaggatttccataaaatttaccctttttaatttggcaatgctaacagctacagaagacatattaccaccaaccaaccgttgcttcattagaaactgcaccaaatccaatgtcaaaaacattactttatttttctagtatgaaatgtcctattacatacaaaagaattgctgtttagaatttgccacaatttgttgaaaacatagcaatctattgcctacaggtaggaaagttcttgctgcaacaaattttaaatgattaagcccatatatatttctatatatatgaataaatagtgcagaaatactgtgacgtgatgagatgcagaataattttataattcattaaaatgtagaattcttgcatcagcacagtgcatacaatatgtaactttttttaaaaagtaaaaggacaaaataatccatatttaagtatttccatcttaatattttaagcaaaaatgttttcatgttttcatattgagtgattagtctctttagtttgtaaacataggtttaagtgacatcttcatgtacaaaaaggaatgggcttcattagataaaattaagccagaataacctgtacacctgagcctgtaataagaaagaattgggaactgtagcaacatctttcttttaagaaaccaaggtctgggaaaggttttgcatagcagggaaacgttgaaaggaaggaaacttttaaaagcaataattagataaattccagaagttgataggacaaagctaatatgagttagaataaaatctagtagaatttttgcaaagctgcataatccagctatggcagattttatagaagctattaccacaatgcagtaatacaatgtgtaagaacattgaaaggaagaacatgcaaaatacatcttcctcattttcttcctactgcttacactacttttccttacatggaagaaacaaacaaaccaacaagcaaaaaacaaacccaatcaacaaataacacagaggatgagatcatctaacaaaaaatgtccttcatacaatataagtagctgtctgtaattggtaatttgcccagtatcacagaatgtacagatgaaggcaatgtgtatcttgtcgcattacctttttcgttagtatgatcaactgatgcgacaggattagcacccctgaagattcttctctgacgtgatgacaattgactgggaatgataaaacgaggggccactgctgtccaggagaattccaggtacaattagattcttttgcctttcatgaccttgcagccctccctccccacagaggcttacagataatcattagcacacattcaaagacacctctgtctgtgggagaaaaactatctccatttattttgtttcacatacatccatagttgaattttaatacaaaaagaaaaattagaatctgacaaatgtttacaaagaagataccttcaaatagattttactcatttcaacctggtgtggagtaattgacaaattgtactgttatattcaagtcaccagagtctgtagtccaggaccacttagcccaacctttatgcaagcttgattttaatctaccatgaacaataaactcattgttgattcgcagttgtgtgtgtgtgcacatgtgtacatagcagctcctttcatagaaagaaaagacatctagaggttgtcttgtacttttacgtacaggaatcattgataagatatggatggattatatgtaaccgtggctggattttataagaaaaaataattagttgacaaatgagggcagcaataaaaaagcatcttttttgcaacaataaataaatacagtcaaaagttttctttgagactctaaaccagcttcttcactgaagagcagacgtggcatttccatggagttatacttgaccccacagtatcattgtttcttgctttctttttcttttttttttttaataaacaaaattttctcgcttctgccacaataataaaaccatttgatcttgacaagataatggtgtcgttgacttttcttttttctttttcttttcttcctttttttgtttttgaaacggagttttgttcttgtcacccaggctggagtgcaatggctcaatctcggctcaatacaacctctgcctcccgggttccagcgattctcctgcctcagcctcccaagtagctgggattacaggcataggccaccatgcacagctaattttgtatttttggtagagacggggtttctccatattggtcaggctggtctcgaactcccgacctcagatgatccgcccgccttggcctcccaaagtgctgggattacaggcgtgagccaccgcacctggcaactttgcttttttcttgtccattggacaaaattggccaataatataattggactgttatgaccaataaaaacaaagtttaggtcaagtcttgtcaggatagcctcactaaaaagatctggctccttaatttaaaatagttcaggcaacaagattcttgctgtgttttatgttaggttaacatgctgaactttaggaagctgtagactgcagtttgttgttgtgagacctacagagtatagaaaaagggaacaattgagcacctttcatttttgaaaatgatgctttatgcggatgccaaagtaaataaatctggaagaagcagccatgttctttcattcacccttggcaagcgaatagaaaagaacgattaagaaatttttaacctataataataaaacttttcactgtacactaagcataatagctcactggaaaaagccaatatttaaaatatgtatgtatatatatttgtctaataaagattacaacattttcaggcaactggacaaatagagacatttacagaagcattaccattgtggtgaaaggtgcgtgtgtgtgtgtatgtgtgtgtttatttacacggatgaggggaatataaagggaaaaattatgctaaaacaaaagaaaaagcaattttaaaatcatatttttctattaaagtccagaaagtctcccagtttcacacagttttattcacaattttttttttttttgagacgaagtctcgcttttgtccccaggctgtagtgcaaaggcgcgatcttggctcactgcaacctctgcctcccagattcaagcgattctcctgcctcagcctcccgagtagctgggattacaggtgcctgccaccacacccggctaatttttgtactttttgtagagacgaggtttcaccatgttggccaggctggtcgcaaactcctgacctcaggtgatccgcccgcctcggcctcccaaagtgctgggattacaagtgtgagccaccaaggctggcctcacaacttttgtcagtaaaccaaattactgtacagttaccaggactaagtcaaaggactttatattgcaatagcagataaatttatattgcaatagcagataaatacagtattccaatagtttacaatttttaaatacattgtttcacgtggctgctagaataaattttttaccactatacatcgttaacattaaaaaattatattagctaacctgactttttggggggcaattttggattacgtaatcacaaggtacaataaaacagtgaccccaacatccagttctgattccagttaaaaatttagactaaagatatcacaatccgtaagaaaagaaagaatatggatggtataaatgatgaattataacaaagtgcagtaatgaaaacaatgtgcaaacaatgctggagatcataaattacaatgggaaaatatggcaaaggaaattctggaaacccataataaaatcaagtttcaataactggctagttatgtttcattctaccttaaatctggaaagcaatagaaattccctaaaaatgcaacagcaagttgtctttatacaattctttgcattgtaatttttttctttttttctttttttttttttttttgatttgtttgttttgagacagggtctcactctgtagcccagtctggagtgcagtggcacaatcatggctcactgcagcctcaacctccagggctcaggtgatcctcctacctcagcctcctgggtagctgggactacaggcacgtgccaccatgctcagctaattttttgtattttttgtagagatggggtttccccatgttgcccaggctggtctcaaactcctgggctcaagtgagctgcctgccttggcttctcaaagtgttgagatcacaggtgtgagccactgcacacagcctaatttgtttatttaagcagaattgagcaaacgtctccattcagctcccatgtgctttattgaaaattatgtcaacttcagtatattaaaaagctacataaaataaccaggtggcaagaagacatcctaagtggcccctacactatgcgggcc

SEQ ID NO: 1824 - DNA, 190699 bp, Homo sapiens
ctaacccatccttcaaagtgcttattacgttctaatactgcggcaaagaaaaacaatgtaaataggtaaatgttatgtactacattagaaggtattaaatgctagagagaacaaaatataggatagtgaggggattaagaagtggaaatggtggggttggtcgtgacggctcatgcctgtaattccagcactttgggaagccaatggaggaggactgcttgaggccaggagttcaggaccagcctgggcgacgtggcaaaaccctgtctccacaaaaacaataataataaaaattagcctggtgtaatatcacacctgtagttccagatattcaggaggatcacttaagcccaggagagagagagagatacaagtgggagggggtactacaggcgcataccaccacgcctggctagttttttgtatttttagtagagaaggggtttcaccatgttgccaaggctggttgcaaactcttggggccaagagatctacccgccctggcctcccaaagtgccgggttgcaggcatgagccactgtgcccctgcttgaatgtttatttgaagacagaatcaaccagctatgccaatgtgcttacaagataggagggaaaagagtcagagacactgccaaggtttctagcttccacaaccagaagaatggaactcttcttcatttgttcagaggacatttgaatacacattagttttaattaaacctatttttgaaaatatgtgctcaagtgttacactgaagcaaccaacaatcatccatacactgtccattgcccccaagatatgtaagttcactatggcattcaaaaccaaacactggatcctctaatttaatactgtacctcacaccaaaaaggatgaaaacagctaaaaagaggctgagcaaataaaaagcatccaagtaggtaagagtcattcatgcaggtagcatctattgagtggctaccacgtgcaaggtagtgtgaaaacacagtaataaaataaaaacagattctaccataaggagcttatgttcatctagccttgaacagacaaagagacaaagtattatgacagtactataacagaagttgagagaaggtgatgtcagagcagaaaagagcctaactgaagagactgatgaaagtgaggctttacagaggaggtctacataattacttaacattccccaaaatatatttaatatattttgagctatacttattcattaactatacacttaatgactttgcccttttctgtatacaatgtttcatatgccacaataacacttatttcggataaagtttactcatgtttaataaccatgaaaagaaaggttagcattagctgagaaaacttcataatgttctactccacacctgtcatgctaccccaacatgggcttccctaacattccaggtttaaactgggtcagtgttgaatagctgtgccattagcctggtggcaataaacttagggctgctgtactatgaaatagcaaccggtagaagccgaagaaaaaggtcaagagtctccttttccttcgccatgtcccgagtcagagccaggatcatgcttaggctgcacaggcctagaaaactccaagagtgaagcaagcttctgctttacacaaggaccaaaggaactggaatgggtcacagttacatgcagccttaatacctcctaagtgactcctctgtggatgaaccctctctcaactgtatttgcaatacagctaacaggcaatttcacatacttccttacatcactctatcaggtcaatcttccctatgcatctcaagacaaaccagtgaccccactgcagaccagttccacaagaatcaccctgggctacctggaaaagataagttgtctaaagtgctttaaaaaaccctattaagatgagaacttcaacagctttatgaaaattttgaagagaaaggtgttataagcttctgcagttcccattcaactccttccctattcaaaagtttcaatgctcttccacctcccatcctcaataacatttccatcctcagctacagctgtgtaatctcaaagagtagtcagaagaggagattttaaaaaacaacgtaagagtcaagccagtgcttctgggaggccaaggcaaggaggatcacttgaggtcaagagtttgagaccagcctggacaacacagcgagaccccatcctttaaaataaaaaaaaccctttaacaattagctaagcatggtgggacttgcctatggtcccagctacttgtacttgcaaggctaaggtaggaggatagcttgagcccaggagtttcaggttacaaagaactatgatctggccattgcacctcagcctgggcaacagagcaagaccctgcctcttaaaaactgcttagtccctattctttcccctcatttaccaggtgtgaaatttcaacaaacatgtttcagtgaaatgatgaaaaggacacaacagcaaagtatgttagaaaaaaaatgctttggaatcagataaaaagtcctgagtttaaatttagctctgccttttacaagcctctgaagatttattctgatcattaaacgaacatacatgagtaaacctttaattagtatacactcaaggtacgtatattgttttcgtttctccttctaaagcatggaagagtttctttttaaaaaacaagctgacaaactatgaaaattaaaagagtacaacagcatgcagaagtagtacagaggagttcctagaagttatattctttctccagagagcaatattattcccaaaagggactctactcacttcacagcttggaaggtaatacctaccttctgacagaacagaaactggtgtctggatcctagaatcacctagcagtagtcacaaatactttttttttttttggtaatacgccacttaaataaaattaatgttaataagcaacaaagtaaatccttaaaaagaaaagccccaccatccctccaatctcccacccgaagacaaattataactcaacagcctatcaccaagattcagcctatcacctaggttcatctcaaaaaaaaaaaaaagacctgtgcaacccaggaagtgctgggaaatcttggtgcagcatggaaaatatgaacaccaacccacttaaccaaaacacataggaaaaactttcttccatttcagtaactaaaaaaaaaacccaagcacttaaagtgattactaacttgagcaatagctctgcactcacttggatgtgtaaccatgaacaaactacttgactgctctgatcttccattgtttatcttgaaaatcgtgaatgagagtaaaatgcttagcacagtgcctgacatatcacaagtgctcaaaaacttctattaattatagtgttacataaagactaaatgcatgtgaatatatcattgggggaaaattccatggcttgttagagcaagttgaatattgtctcttccaaatttatgttcacccagaacctgtgactatgaccttgtttagaaaaagggtctttgcagatgtaatcaagttatgaagagccatttagtgtgggctctaaattcaatatgactggtgtcctcctgacatggaaatctacacagatgcaaagagaaagatggtcatatgaagatggaggcagcaactgcagtgatgtagctacaggccaagaacaccaaggactagcacaatatcagaagctggaaaaagacaaggaaggattcttccctagagcctccatagagaccatggcccttttgacaccataatttcagacttctggcctccagaacggtgagagaacacatttctgattttttaagccatcccatttgtgatagtttgttatgacagtctaggaaactaatccatttgttgaaaaagaaatgtataaatacgacacgtaaagctgtgaattttcttgatgcattacttattggaactatcaacctagttttattcttcctatcggaactctgagaagtaaaagattatctatgatgttgtattttacagaccaagaatctgaagctcagaaatgttaagtgacttttcttctcaaggttcatgtaagcagctggtagcaaagccacgattagaaacaaaaatttaccaagtccaagtatggtgcttaatacaatacgctttgaatgatgaaactcttggataagcaacatacattcatgtgccaaatagcattatggtcaatgacagaccacatatacaatgatggtcttataagattttaatacagctgaagaatacctgttttagcacaaagcactactcctgtgtttgtggtgatgctggtgtaaagaaacctacagtgctgctattagaagtataccacatacaattatgtacactaagaatataatagctgataataaaagctatgttactgttacacttatttcttatgataataaaaagtgttatgtatttactatactatacttttaatcgttattttagagagtacttctactcattaaaagaagtgaactgtgaaacagcctccagcaggtccttctgttggcactgtcacaggcaatgaaagctccgtgtgtgttgttggccctgaaaacctaacagtgtaacaagatgtgaaggtggaagacagtaataccgacaaacctgaccccatgtgggcctacgttcatgtgtgtgtttgtgtcttagtttttagcaaaacagtttaaaaaataaaactttcattttaaaatggaaagttttaaagatagaaaaaagcttgtagaataaggtgtgaagaaaatatttttgtacaattacaatgtatttgtgttttaggctaagtgttattacaaaagagtcaaaaagttttaaaaacttaaaagtttataaagcaaaaagttatagtaagctaaggttaatttattattgaaaaaaatatttaaaataaatgtagtgtagcctcggtgtacagtatttataaagtttatagtagtgtacagtcatgtcccaggcttttcaatttcagttacccttcacccaccgactcacccagagcaacttccagtcctgcaagctccattcatggtaagtgccctatacaggtgtaccatttttatcttttctactacatttttactgtattttttctatgtttaggtatgtttaaatacataaatctttaccactaattgcctacagtattcagtatagtagcatgatgtactggtttataccctaggagcaataggctatataccatattgtctaagtgaatagcaggccataccacctcagcttgtatgtattaagtatgtatatatgtaagtatgtatgtatgtatgtatatgagacagagactcgctctgctttgcccaggctggagtgcagtgtcgcgatctcagctcactgcaccctgtctcccaggttcaagtgattctcctgtctcagcctcccgagtagctgggattacaggcacccgccaccacacctggctaatttttttgtatttttcatagagacaggggtttcaccatgttggccaggctagtctcgaactcctcacctcaggtgacccacccaccttggactcccatgcctcggcctcccaaagtgctgagattacaggcgtgagccactgcgcacggccctcagcttgaatttaagtgcactttatgatgttcacgcaccaatgaaatcacctaacaacacatttctcagtttcccttttgttaagcaatgtgtgatggtatatacaaaactccagattattttccagatatttagaaatacttttcagatattttgatattttgaaagtttctgaaaattgctctgtcattacttctgagtgatgagctgaagaataaagcatgaaccaaatgaggtgagtatcttcttatacacagctagtgagactataaactgacactgccaaaatacttctctgaagaatgcattaagaacataaaagagcattcatacctttgactgagataaagatatttatcatggcatatttaatttaaataacaaatgtaacttaaatagtcaacaaagaaagccaatagcatgcagccattaaaaatgttttccaaaaaccaactgggaaatattcagggcacatacgtaacatgactgtatttgaacaaattacttatgtgctaggaaaatgtaccataatgttggtagcgagataattttgagctgttgggttgttttttttttttttggggggggggggagggtgggtgtcttttatacttctatgtcatttcagtttcctgagaattgatacacagtatttcatcaattctaagaggtactctccccacatgtcaacaacttttaaatcaagatgcattttacaatttctgttatgccctggtttaactgaaataatttctttgtcgtacttaaaacaatggtacatcttacaatcaatagcatcttaagttctatgaaatgtagcagttttataacaaggaactaagatgatataacatatacacatatataaacccacatatatatttatgaatgtatataaaaagatgaagcagcacttatgactactattatactaatctcagttgttactaagagactctagttctcaaatatagaaaatcccacttaactactggctataaaaacctagaaacagacactgaagaggtgtctctgatagagaaagactgtgtttttctcctcagtacaggcatatccagtcacctcctagttattcttagtcatcattccagttcaagttctacaaatctcactttaaaatttcctttgtgaagacttgggaaagcaaaatatgcaccaaatctagaatgtttattagttttgttccagctaatttttaaataagtaaatcaggatttaatttgtatgctaccctaagggaacaaactagtaagaataaaaaagtgagccctctggactgtgtcctcaattaaagtatgctctattgaacttttagggggagggggaatatatatatatatatgtatctccaatctggaaagaagctataagtccgcagtgacatttttagaataaaagtttaaatgattagatagcccacagaactttcacttcaaaccctgatcattctgttcattttatcagttgatcaaccttcaacttttggcctactaatttaatggatactgttcacaggaaagccattttcttaaggctttgactagtactaaggtcaaaaaggcattttgacccttatttttagtagcaatagactttttctagacatgggtctacataaagatagagctcagccacaccaagctaatataaaaaatactttgcaagaatgtaagcttcatgaaggtaggatttttgagaacactgctgagacacagtaagcacttaaaataatggtacatcttaccatcagtagcatcttaagttctatgaaatgtggcagttttataacagggaactaacaaatataaatctaacaaatatgacagttaacatcaatggcttgcttgcattattcagtctgttttccttgtttcctgttagctcagatacccacacagttttgttctaaatacacgttcagttaaacattatattctaatagtgttttcctttttatgagacaggcctttcttagttgtccaggctggagtgtggtggcacaatcttggctcactgcaacctccacttcgtgggctcaagcgatactcccacttcagcctcctaagtagctgggactacaggcacatgctatcatgctcaactaatttttgtaatttttgtaaagacaaggtctcactatgttgcccaggctggtctcgaactcctgagctcaaatgatcctcctgccttggcctcccaaagtgctgggatcacaagagtgagccaccacgcgcagccacatcaggttcttaaattaaaccactatatcaggtcattaaaccatttactttgcaatagttaagaagagggttatgggggttacgaggtgggaggggatgtgagaaaagcgatattgatagttttcggcagcatttaaaaacatcagatacttatcccttaccttattagcacgtatctgtttgtaaatgtctgtttgctgacgaattcgatattccaagtcagaaacatgagcctgaagccagttccagcggctgacaatagctgcccggtctgcagcccatttccattctgacctgcgtctcctaaaaggaaataaactgagtgaaatccaagagtagcagtaatatctataccagattggggggtggggagtggaatttaacttttaaaggcccttgcagagactaactctagtgtcaagaaaaacccaagagagagacaagacacctcccgctcatcaggatgcacatggatataaacttccaaataggtatttcccaaattaagtggaactgcgttctagcatcctgatcctgtggcacacagtttctctgaaatccctttaatttctctgggacaataaaattattgtccatgccaaaataaaacatacattaagaataatctatacaggaaatccaactgacactaagaattattaaaactaataaagaattcagcaaaagtgttcagtaaagaatatttaaaaactaataaagtagaaaatatcattaagtaccattcataacaccaacaaaactaatgatatattaaatatctttacagagaaaataacgcctgaaagcatgaagatctatacaaatggtaggacacatttttttaggatggcgattctcatgaacatctataaattcaaagaaattccaatcaaattgcctacagtatttttaataaaagctgagaaacagatctaaaagttcacatggaataaaggaccaacagcaagaaatttgcaagaaggcatgatgcaaatacacattaccagacagccagatttgctgcaaaactatagagagcctcaaaacgtagaactagatacataaaagataacgggaaatttttaaaaaatcagatcagtgcagaaacgatcaaactactcaataaatagtactaaactggccagttctttaaaggaaaaagtaaaattagttcccttcttcatgatataattacaaaattttggcatttcaaattgctaaatatgaacagccaaacttaaaagaatatcttcgggacttagagcagggagcatttcttagataatacacaaagatttcacctacttttcaacatacaatagaaaatctaataaagttaaaaggccaactacattttggtggaagatatctaacacatataactgacgattaaacatcagaatatgtaacagaactctcagaaataggataaaagaaaaaaagacaatcttaacagaaataggaaattcacataaaaggcaaataataaatatataaaaatgtgtcatctcgttaaaatttggttaaaatataaatattaggtaaaacattaagatgctgtttgaaatctggatgggaaaacgcacagtctcataaagccaacaggtggtgagaaatggaaaagagcaattaatatattgctggtaacagttaaaattggaaccaccatttttgaaaaataatttgaaaatacttagcgaggtgtaaaatgtgcatacccaaccatcatgatactgtattttttttttttttttcctgagaggcagggtctcacactctatcattgaggctggattgtggtggtgcaatcacagctcactgtaacctagagttcctttgcttaagctatcctcccacctcagtctcccaagcagctaggatcaggagcatactacatacctggcttttttttctttttttttttttttttgagatggagtttctttcactctggttgcccaggctggagtgcaatggcgcaatcttggctcaccaccaaccttcgcctcccaggttcaagcgattctcctgcctcagcctcccgagcagctgggattacaggcatgcgccaccatgcccggctaattttgtatttttagtagacacggggtttctccatgttggtcaggctggtctcaaactcccaacctcaggggatccgcccacctcgacctcccaaagtgctgggattacaggcacgagccactgcacccagccctgactaacttttttttgagacggagtcttgctctgtcgcccgggctggagtccagtggcatgatctcggctcactgcaagctccgcctcccgggtttacgccattctcctgcctcagcctccggagtaactgggactacaggcgcccaccaccacgcctggctaatttttgtatttttagtagagacggggtttcactgtgttagccaggatggtctcgatctcctgacctcatgatccacccacctcagcctcccaaagtgctgggattacaggcgtgagccactgagcctagccccactggctaatttttaataaaaaatgttgtggagatggggtcttgctatggtgtccaggttgttctctaactcctgacctttagcctcccaaagacacgagccactatgcccagccatgaaattctgtttctgagaacataaactacacattcctctgcataaggaaacaggttcactggaggagagtctgtaatagataaaaactaattatattctaattctgctgaacttggtaaataaactataatttattcatttaatagttctatagtaataaaaataaacgacatctgtatgtatcaacatgattaaatctaagaacacaatgttgaatgaaacaactacaaaaaaactaaacaagattaagtacacacaagtagtgaaggaatttgatgaaatactatctagcaatttatttactgtatgtatcaacatgacctaatctcaacaatggggaatgcaaaagctgcacaaaaataaacaaataaacattaataaggattgttaccaatacagataactgatgaatatattttaaaatgcctaaaactgacatacaacaaatttacaatcaagctcctcattatctctggaaaggggatggagaagttggattttagctctacctataatgtttgacttctcatgtaaaaaaacaaagatggaaatgtgacaacattaacattgtttaaatattacactggggatacatggtgtctactatattctgtaatctaaatatttcataatctaccacaaaactattttcccagaaagcagcagcagtcacacagccctcagccccacttcccatcaggatacacacactcactgctaaaacttatgactataggtgaacttgaacacagtctcccataggggcaaaatacaaaatgtcaaaaataaaaaagaacaaatctgaccacgacagagtaagacatgaattaatacttaatcataccataataattaagaccaagggtagtaatggtattttaacttttgtatggaccaaacataaaccattcaaaccaaccactgtgataattatcaattatgtctcttcttttagaaagaaaacattttacagttccctaattttgatggaaccacttcaagataaaaagatacttttaaagtacagttatctgcttcaatgttggctgcaggtctagctctaccctaaatccaggaaatgatctcaagagatcaataagaaactagggatcattcttgaacaacaaaaatgccccctacccacaaagagacaaaactagttaaccctcgtattttattcccacctttccttacttttcaaggcttaccacctttctatcctgcaaaatcttttggatttatagattcctttcattcctaaaactaccaccacaccaggtccccatctatcaccactgggcaaccccaacagcctccttagctgctcttcccaacaccagtcaatcatactacttttcctcaatcaactcccctcacacctttttcatcctggcattctaatgtttaaggaaccatgcagctcctttgaaaatacaaaaggaaaagaaaattacttaaaacattttagttcgcaagaactttgataaatacactttttcttggatattaatgaaggtcttatgtcccctacacaggtatttacctaaataacaatacaaagcgagcctcctgataatatgttttggataatatggttaataaactaattaaagaaaggcaagacagcactaaggaatactaacaattcccaatttatgaacaagtttcattttacaagtgtatctgtgatgtgatggtttagaactcgaagtgatttccaggagaaagttgttacaacattattcttccataatgctgctcaaactctcatcatctccaatgaaaaatggaaaaccacaactcaagcgtccaagaagtatcttgtgttcaaaataccagcaatatgagcagaaagctaaactgttattaagcatgagaggtgtacagttaacaagtctggataagatatgaagatgttaccatactccagtggcagagcagagcaccactaaacagtaacacaagaataagagcttcacatcttttgttccttaacaaatacaagcggccgggcgcggtggctcacgcttgtaatcccagcactttgggaggccgaggcaggcggatcacgaggtcaggagatcgagaccatcctggctaacacggtgaaaccccgtctctactaaaaatacaaaaaaattagccgggcgtgatggcgggcgcctgtagtcccagctactcgggaggctgaggcaggagaatggcgtgaacccggaaggcggagcttgcagtgagccgagattgcgccactgcactctcgcctgggccacagagcgagactccgtctcaaaaaaaaaaaaaacaaaacaaaaaaaaaacaaatacaagctatataaactcagcttatcagaggtaaagatagacttcctcctcaatattcgaagtgtaaatttatcactctgacaatttacagctcaaaacaagggacacacattgaacattagggacatgtttaatgttataccatacagacttcaggaaagaacacaggactaaggttgcagaataatactttaaatacaatgaggacttggtttctaatatagtcattatcaataatgaagaaaatcacgtggattctaacactgatgagtcaactcattcctgatgcttgtttctgtgctattagtgaaataactgttttaactatgtgcctgagtaggacactagaatgccttagaacgtttgattttaccgtgtgctttatcctagtccatacaaaaacatgtactatatatactgtagttatcacctgagtgggaattcttttcaactcgtattttgctcattgcttttataaactttttattggtaaaaatggctttgtcaccatgtgctatacaaaaattcattaaaatgttacatgatgaattactttttggttacctaaatgcagtatcaatatttgcttttgtgacaccacatgaatagtacaccttaatgttaaccagctatgtgctagtattggtttacataagaaatatttgttgtatataaatatttcattagctatgaacttgtactttaatcgttctttttacacagttagactattaccacagagaattgagaatgctctgttgactctaagaacatagatctttcctgtgtttgtttcacactgcttttgagctaggtagtgagtacctgtgaatggttttttgttgttttcttcatgtgactcaacaattttaagacttctcattggtgaaatctatggtgaaaccccatctctactaaaaataaaaaaaattagccagacgtagtcgcgcacgcctgtaatcccagctacataggaggctgaggcaggagaattgcttgaatccaggaggtgacggaggctgccgtgggcccagaccacacgccactgcccttcagcctgtacaacagagtgagactccctctccccaaaaaaaaaaaaaaaaagcgccctctataaacacacttaaaccatacagtaaaagtaattaatttttttccttgcaaattcagggttcagcttacatgttggctaaaaattaatttttgtttttagttctttaaagttattaatagtcaatgggtttaaaagggattatcaatagatcaactcttttgtatttattagataagtagcaccaaaagctagacattgaaccacatggaacaccacatgttgactaccaggcctagtgcctctaattaagtcacctaattctattctaagatgggaaatttgtatgtcaatccagtagaacagggctggtggattatgcttctcttccctgatgtattaacataaatttttttaaatctcattaaggcaacaaacatgccagaaaaacccgaatggtggtaatttcaactttgattctgatttcagtcccatctcgattctttccttttaatgaaacaaaggttctattagccaactaaagtaaaatgactgttcacagtgagctacacagtgctacattcacactggtagataaattgacaaaggattatgtgctacttccaagtgtgcaggaaatcctgagacatctaagttctgaaatctccaggttatttagataacttttaaaaaccaaaagattcaaataaaactgagatcatcccagagcgtacaattgccagattaacagttttcagggtaagagttagggtcactgtggggcaggaatgagaaatcttgaaattgctgagtcacatgaaaaaaacaaaaacaaaaaaccactcacaagtactcactacctagctcaaaagcagtgtgaaacagagggaagatcaggagacaagttctcacttttacttactttatgtgatcctaaacatataaattgacctctgcaaataagaacaacatctgcttcacaaagttgtgatagccatacaatgatgtaatcctaactgcaacctaaaatgtatgtattagataagaataacaatttagtcagctgggcacggtggctcaggcctgtaatcccagcactttgggaggccgaggcaggcagatcacaagataaggagtctgagatcagcctgactaacatagtgaaaccccgtctctactaaaaatacaaaaaaaaattagccgggcttagtagcacgcgcctgtaatcccagctactcaggaggctgaggcaggagaatcgcttgaacccgggaggcagaggttacagtgagtcgagatcgtgccactgctctccagcctgggggacagagcaagactctgtctacaaaaaaaaaaaaaaaaaaaaaaaagaaataacaatttagtcattataaccatggatttaaattccgtatcaaaaaggtacaaaaaaggaagaaaaacagaataagattaaagaaaaacctctcagataaattcaggaaacaagtgttttcagttagcaacaagccatattctgagagtttcttgagctttgaactttagagtcatctaaaagttccactctaaacagaaaaatcaaagtagtctattagaatagacattgcattatcagtgacattaccaccaaatttaaaaagatggaggggataaagcacaaggagaaaaagaagagaaccaaactgtccagagttaaatatcccacattttagttgtaaagtaaaacccaggaaaaaactcggatacatacttcgtcttaacccattctcatctgtcacatgacctaggttgtgtcagctttctacagatatctgtagtaatgtggaacaaatgtaccagagccaatacttttttttttgagatggaatctcgctctgtcacccaggctggagtgcagaggcacgatctcagctcactgcaacctctgcctctcgggttcaagtgattttcctgcctcagcctcctgagtagctgggattacaggtgcctgtcaccatgcctggctaatttttgtgtttttagtagagatggggttttgccgtgttggccaggctggtctcgaactcctgacctcaaatgatccgtctgcctcagcctcccaaagtgctgcagttacaggtgtgagccacagcacccagccccagagccaattctacctaaactgccaattcatcctgacagacccttgaaattgaacacagcacttttgtcttactacttcaactagattacctctaatatttaaatgaaatttgtgtagttttggtagtttatttcagccaagcatttagcccaccatgaactcactctatccttcttccttccatttaacaaatatttaagcaactattagttaccaagaattagactaggttagggatgcaaaaacaagaactgtggctaaagtttacaatttaatggggcagatagatgttaataatcaaataatcatataaaatatacgataagagatcctaactatgtcagatttagactgggggatctagaaagacttgtgatataaatatttaaacagacctccaaagcataaaataggacttggatgcacaaactggtagggcttggggatgtggagcagaagacattaggtggaactgtggtgtgtcacaaagaaacgacatgtatacaatggttatgtggttagaactccaacagtgaacaacgaaaagaattcattcaacttgacaatggatacaggtaggcagggccaggtcacacagaacctggcaatccatgttaatcttataaaacaatataagcaatcctcatctttcctcatgctcttttatttatctcagaccctgtttgaatgaaaatttacaaatacaagctaaaagataataaactcccacaaaaccatcaaccaatttcaactatcaacttttggcgaatcctacctcatctataacatctatctcccatccctatgaattatttttaagccaattcccaacatcacatcatcacctctaaatatttcggtatgtttccaaaatgtaaggtcttttaagaatatataccagtatattttataatctaaaaaacaataattccttaatgttaaatatccagttactggttaaatttcctggattgtctcagttttctccaaatcagagtcaaataagatccacacaattcatttacttaatacatcacaagctcgtaacacgctcctcctcattttctttcctcacaatctgtggaagagacagcactatctgtcctttagaatttcctccattgtggattttactgactgtgcctttaacacaaagcccatacttctaaacttgataatttgacacctctaggctggccgtgctggctcatgcctgtaatctcagcactttgggaggctgaggtgggtagagcatttgagatcaggagttcaagaccagcctgaccaacatggtgaaacactgtctctactaaaaatacaaaaaaattggccaggcgtggtggcctgggcctgtagttccagctgcacgggaggctgaggcaggagaattgcttgaacccaggaggcagaggttgcagtgagccaagatcacgccactgcactctagcctgggcgacagagtgagactctgtctcaaaaataaacaaacaaacaaacaacctttagtagtttgatacatttcattttctgtaggtcagctgataaattttttttgtacattaaatttttacatgtttaagattgagatatgttttaaaatacactcaatcttttaaaaatcatttaaggtactttaaactcctttcaatacccgtcagtcagatttttcatcaaacatggtaaacatatacatattatatactctgcctagcacaataaaagaaatgtaattgtttgtcataccctatgcaaatttccaaccagaaaatacccagaagcatcttctaacactaaaacccacgtctctccaggaaagtttttccttgtgcatcgtacctcacaattcactctttgtcctcttcaagcttagttggatcctcttattttgttatttgtatgtgctattatttccaagtcatgtcatatatataactggtctccaactagattatccatgcctccttatgggaactaccatgtgttttaactgtaagacaatttttaatgatgtctgtgcacatgtagtttacaagtaaatttgcaaaaaatataaacaatatgagagagttttagctgatgccttatcctgtttaattctcaaatgtttatattttaaaaacacttaactgaagtattctaatggaggaaaaaatggcatgacaaagaagtatggaaatggcttacagttcttgactggctgtaggactgaacatggaatttgagcatgaagattttgagcaaaatactaggctacttactgtgtcttttttcttttttttttagacaaagttttgttcttatcgcctaggctggagtgcaatggtgcgatctcggctcactgcaacctccgcttcccaggttcaagcgaatctcctgcctcagcctcccaagtagctgggattacaggtgcccgtcaccacgcctcgctaattttttgtatttttagtagaaacaaggtttcacttggacaggctggtctcaaactcctgacctcaggtgatccacccacctcggcttcccaaagtgctggaattacaggcgtgagcaaccgcacatggcctactgtgtcttctttagagaataagactgttatgtttcaagaataaagcaaatgacaaatagtgaaaggctctcagttattcaaagtactgccattccagagcagctcctccagagtgaattaattttctgtctacttttcttcctttcaaaagttaaactgaggttagaatgttcaaattctgtatgtgatactaatttctctttcaaagagattgcttgaggccgagcatggtggctcaggcctgtaatcccagcactttgggaggctgaggcgggcagatgacttgaggtcaggagttcaagaccagcctgaccaacatggtgaaaccccgtctctactaaaaatacgaaaattagtagggaatgtggtgggtgcctgtaattccagctacttgggaggctgaggcagaagaattacttgaaccctagagacagacgctgcagtgagtgagatcacgccattgcactccagaccaggtgacaagagtgaaaccctgtctcaaaaaaacaaaaacaaaaaaccccaaaatgatcactcgagctcaggacttcgagaccagcctgggcaacaggtgaaaccccatgtctctacaaaaaaatacaaaaattagccgggaatggtggtgcaagcctaaggtcccagctactcagtaggctgaggagggaggatcgcttgagcctgggaggtcaaggctgcagtgagtcgagactgcgccactgtactccagcctgggcagcacagcaagaccttcacacacacacacacacacacacacacacacacacacacacacacacacacacacaccccagaagggtgaaggagcagaaaagtacagtgtattgaggcagggtccccctttcatccctactaccccagtcccacatattccacagggagaacttgcctccggctatctctagaagaatgagagaattttaatactaaatccaacagaaaaacatcttctttctcactttgaaaatacggtttattggaaaagagtatggtgtctggagtcagtgaacactgagttccaaatcctggccccaccacttagctagctattatcattgagcccccagtcagctactgagaaatcaaacaagttccaacgcacaatctccaggaataatgctccaactttagtaagtctaagaattgcctgagagagttaagtctcacgtacctttatgaagaaaaagcctcttagttattatgtaagatatctatgagaccatactttttttgttttgttttgtttttgagatggagtctcgctctttcgcccaggctggagtacagtggtgcgatctcggctcactgcaacctctgcctcacgggttcaagcaattctcctgcctcagcctcccgagtagctgggattacaggcgtccaccaccacacctggctaatttttgtatttttagtagagacggggtttcaccatgttggccaggctggtctcaaactcctgacctcaggtgatctacccacctcggtctcccaaagtgctgggaatacaggtgtgagccaatgcgcccagctgagaccatattttcagaaatagtccttaaagacactgaggtttagcaacagaacccatcttcaagaaaatgagttgaaccaaaaattaatttgttaataaacttaccagttcttaaaaataaatgtggtaaaaaggaacaaaacaaacaaaaaagtgaataaatagaagaaaccctggtacaggcaaggtggtgtagactctattctttctcccagctcatccctgttctaagcacaattataaatcctgcaaataacacaagaggcaatcaaaggaaaactctgaaagatagaaaagggaaggcaaactagttaaaggccccaggactaaaggaacaacacagtgacaaaagcatctaataaacactatccaaccgaaagaaggtaacccaagtttggcatttcctggcttccaagagagcaacaaagagcatctcagacaggctcattccctgcctccatataagggaagtatttccttcaataccagggaagcactgcagcaacagcaagggggatggatcaggaggtctgctaataataggaagccagaggaaacgttattgccccatttctctatttctttttacggcaaatactcattattctaatttgtctcttctcactgtttctttaacacagggtttcaacccactattgcaccaaagctgctggtcaaggtcaccaatgacctccactgtactaaatccaatttccacatttcagtccttaccacccttgatccatcaccagtatccaacaaaggtgattactccctccttcaaatactttctccacttctctttcaagacatactaacctggcttttctattgtctttttgaattccttgtaagactgcatatgcgaaatcactaaatcttctttcctatacttcctttctaggtgatcttacccaaactcatggctttaagtatccaactatgtttctgactcccaaattcctacctcgagctgaaatcgctcccctcaactccagattcctgtttctacctgcctactcaacacttctatttgaatgtctaaaaagtgtctcaaactttacatgatcaaaatgaagttgatactttcccctccccaactcctatatgccatcccaaacctgcttcaactagatggatctgttcaggtcaaaaacctccatgtaatccttaatttcaaccccccaccacctctatctctctcataaacacactcaattggcaaatcttattggcactgtcttcaaatatatccagtattcagccacttcttgccacttcattgttagtactttggttgaatctttctagatgagtccaagagcctctaaatgggcttctagctctcacccttgaccactttcaggatattatcatgaacatagcagccagcctaatattgtataaaaggataagttcgatcatgtcactcctctacccaaaacctagcctagttgtttaccatctctaaaaacccaagtcctgacaacgaccctgtaaggcctcaaacagagagcctctatcacccaatccctgctacctctctggcctcatctcctgttctcctcctggctcattccattccagtcactgctgtttgctgaacatgttaggcaagctgtcacccacaggaccttttatttgctattcctaaagcagatatcctcactttcttcaggtcatttccttacatgacactttattaaggctttcccttaactgtcctataaaattgcaacccctctccaaataccccctacacacctttctttcccgcttcctggctttattaatagaaccttcatgaaaattatttttaattatctatctttcttactgtctgtttcccccactagaatcatatccggaaaacagagatttttgtcttgttcaccataatatctctgggtgcttggaacaatgcctagcaaatggcaggtactcaaatatttgttcaaagggaaggaaggaagcaggaagagagagggaatgagggtaacaggctggaactatgatcctaacttttccttacaaaagattaaaaccaaagtaattccagactgaagctaaccccttttctcatctggtgccaacagacctcataaaactaactctggcctcctcataaaactaactctggcctctaatgctgaaagcgagtcaagcaattatagtccacactcttagtccaagtatacacaaaccagagaaaataaagctatattacaaagtgaaaactactaacaagatatttgagagctcttctttttttggagataggatcttgcactgtcacccgggctgaagggcagtgatgcaatcatagctcactatagcctcaatcacctgagctcaagcaaccactctcacctcagtctctgcagtagctgggacctcagatgtgcaccaccacgcccagctaattttattttttcatagaaatggagcctcacgatgttgcccaggctggtctcaaactcctaggctcaggtgattctcctgcctcagccttccaaaatgttgggattacaggtgtgagccactgcacccagtctaatcccaaccatacacaacttgaatggaaacttgctgagggtactatagatgttccagagtaaaaacgtttccgcttttacacatggtaaaatacaaaattctcacatctcaatttctatgcttttgcaaaccacttactaacagaatcgtgaattatatgatacgtgtaagatagttaagttttattggcagatttcgattctgccacatcaaattgaaaaatattctgtcatgttcatcattatatattatataaatttgcctccctcaaaaaccacacccccaccaaaaaaaaacccttaagaaataatttttaatgacatagacctcaaaggtcgagctagttttcagttaaagaatgactgagggcacaaaggtggacatttttaccatcctaaaaattggaagatatcactcccagggtggctgtgtgatttcaatgacataacatttttaaagtctagcattccattataagtgctcagtaaatgggaagttgctgctgctcttacaagcttctgactaccatacctggttgaactaactcagttaccacaaggtactctatgcccttacatctaatgacaaatatttgttttgaaaaacgtatactccttaaacacacttgagaaacaggaaccagagacccaagtacattttgttctgaatcaaattccagcatgcacagcaaagtgcatgtagaggggtgagagggtgactagggagactgcttcaatgggagattattctgcagtagtgccttaactgtagaacagtgatgatgataaactcatcctaaatttaggactactgacaggaacaagtgaccacagtaactgttcatcttaagtcgtaaaaagctttctggcaatactcatcttcaaaaaaacctagcatgtaggaaaaatcttttatgtgtttgaataagggtaatatagttaaagctaaaggcttagatttttaactggtctaatgagagaaagcacagtagtcatataataagaaggtttatgttttacttcattttactagtgtttcctcatgagaattaagtaacagaaattataggaatcacaaatgaagtgcttactccatgcaaaacactggtctggcacattacagatattaattcacgaaatcctcattaaaaccctgtcaagtgggtattatgatcatcactgccccatttttataataaggaaactaagacaataaggctaagtaacttgtctaaggtcacaccactaacaagcagagccaagacttgacataggtgctctgggccagagtttttgttaacagttggaatatacaaatttacaagtattactgccaaatcaattttctcaaaaataagtcaaagtggaggaaggggggagatgaccctctgaattcactaaggttctgtgaaaagatgctgaaacaaataaaaagagtatttgattgtcaaatatatgctatttagaaatactaatggaaaagaatactgtgggcaagaaaagaatcacaagtatttgtgctgagttctgaaaggagagaaataaggttggggtgggaggtggggaaagcaggtcaagcatggaatagagcatgaataaaaatgcacagtcagaaaagtaaaaagctatgtcctagatacaaagcagtagtaataggtagaaatagtattacaaaaacagcagtgtcactaggtatcaggcactcaatgcataactaaagagaacataaaaataattaaaactatagtgaaacaaataacaagaacatgtcatattcctggttgtgataactacctatcataattgtagtttttttcccttaaattattaagttggagcagttattttacgtctgatgcatttcttaagcggttttaaagaagggcatagaatatgtgatgataaatttgacacaataatttgagttcatgtgaatgagtgttcaaacattgccaagaaaacactgaaagataatttttaaagatggagtttcgctctgtcgtccaggctggagtgcgatggcgtgatctcggcttactgcaacctccgcctcccgggcaagccattctcctgcctcagcctcgcaggtagctaggactacaggcatgtgctgccaagcccagctaattttttgtatttttagtagagatagggtttcaccatgttggccaggctggtctcaaactcctgacctcagatgatccccctgcctccacctcccaaagtgctgggattacaggcatgatccaccgtgcccaaccgaaagagaatattaaggaagactctgcccaaccaattattaaaattgccattatacaacaagtataatcaatagatacggatggtatttgaactagactagacaaagagatcagcagaccacaaaatacaacatatacatccaagtatacatggcaacgtaatatgcaaagatgacatctcaattctcagaggaaagaacattgtatttaattgttgatattgatataaccaactacacatttgggaagaaaggagagggaattcctatcttacactacacacaaaaataaatctaaagtgtgttaaagactttagcataatcactgcattgggaggcattcttaaagaacagaagaaaagcagaaaccagaaaagtttattttttggaaaattaattaaaaattctcatgctctctgatccacttttcaagattcgatcccacagaaacgagagcaccaatacaataatgtttactatcaaggtaactgaaagcaactgtatttcccaaaggagaatggctgagtatattattgtacacctctatagggagtgttatataatcattaagaatgaagacaggcacggtggctcacacctataatcccagggctttgggagcccaaggtgggtggattgcctgaggtcaggagttcaagaccagcctgaccaacatggtgaaaccccatctctactaaaaaataaaaaaattagccaggcatggtggggtgcacctgtagtcctagctactcaggaggctgaggtaagaaaatcgcttgaacccaggaggtgaaggttgcagtgagccaagatcaagtcattgcactccagcctgggtgaaaagagtgaaactctgtctcaaaaaaaaaaaaaaaaaaaaaaaaaagaatccagaccgggagtggtggctcacgcttgtaatctcagccctttgggaggctgaggcgagcggatcacctgaggtcaggaattcgagaccggcgtggccaacatggtgaaaccccatctctactaaaaatacaaaaattagccggacatggtggtgtgtgcctgtagtatcagctactcaggaggctgaggtgggagaatcgcttgaacctgggaggcagaggttgtagtgagccaagatcacactactgcattccatcctgggtgagagtgagacattgtctccaaaaaacaaaacaaaacaaaacaaaaaactgggcagataaattttttttttttttgagatggagtgtcactcttgttgcccaggctggagtgcaatggcacaatcttggctcactacaacctccgcctcccaagttcaagtgattctcctgccttagcctctcgagtaggtgggattacaggcatgcgccatcacgccgggctaattttgtatttttggtagagacagggtttctccatgttggtcagggtggtcttgaactcccgacctcaggtgacccgcccaccttggcctcccaaagtgttgggattacaggcgtgagccaccaggcccggccgggacagataattttagacatcaatttaagtgggaagaagactacaaagaatacaaagaaactagcaatgcctgaagacattttttgttgtcacaactgggggtggggggatggtacttggtagaggccagagatgccgctaaccatactacaacacaggacagtttcctacaagaaaatgtcagtagagctgacactaagaaaccttgctgtatatgaaccactgataagaataaaatcttagctttccaaggtcaatcttgccttttagccccatcatggccccacgtgtttgcaggttctttggctaagccaccaaatagctgttatggtctgttaacaatcaaatgaatggcaagggagaagtttaagccatgacccagcatttaaaaaataatggaaaagaatacaacagaaaactaagagtatgcagcatgcagagtatgtggggaaagtaatttttgttaaagttaggcatatgcaagcctttgtgtctctcaaatttacctgtaggtataagtggggcaaactgtttatcgcacggtagatcatgctcaaagaaagtcattcaagatactcctcagttctctcatccaaaaaactcatgagttggactaaaaaaaaaaacaaaaaaacctacgaggcactttctttataaaatgttaatgaatttatgatcatctgcatgaagtctaccctgtatgtacagatgtaacctacatgggagggggtacagtccttataggtagacacctgaaaggctcaattcatttcagatgtttcaagaaaattccttagtcaataacattcacatagactttgtaagatcttgattaagccatgaggccaaatctaaatctaaatcacccactcagaaagtgccaaaaaccttaaaaccaaaagaaacattagagattatctatctctaagcatctcaatttttaaatgagtaaaatgagcccaaaatggggcccaaaggattaaatgatttgcccagagtcataagccaagtcagactgtcaaaccgttaaagcaaactgataagaaaaagatgctcagggccaggcatgttggctcacgcctgtaatcccagcacaatgggaggccgagtagggcagatcacaaggtcacgagttctagaccagcgtggccaatacggtgaaaccccgtctctactaaaaatacaaaaattagctgggcatggtggcaggcgcctgttgtcccagctactcgggaggctgaggcaggagaatcgcttgaacccaggaggcggaggttgcagtgagccaagatcgcgccattgcactccagcctgggcaacagcgagactccctctcaaacaaaaacaaaaaaactaaaacatctaactgaatcaggctgcttaagtatcaaaataatcttaaatatctgaagaggaagaaggataaagattccctaacatgcagaactaaaactagaaaaactttattctaatgttcttagactactatcaaattctccctaggacttctacattgctgataacagcttacaatatttttcccagtttagttaagaccacatgtcagtattttattacaatctttcaagcaagaaagaaggtctctgatatactaatttaaagacatatacactcttgatagagctatattaggaaatggcaatggctaattcgtaaactagatttttaaaaaatgacaatatcttgtttaaagttattagactatgacagtcatctgagtggggaggtaactagttccccagcagaagccttaatcccattaaggtttatcagacaagtgtataacagaaatgttcatttcttctcagaaggaggttatgaattatatcacacggattctgtttagatgaggtttagaacaatttttctttttaacagtttctccttttgatttagacactctctaaagatctgtccagatttaggtccatttcactgaaattttgtactaaagtccacgaatttttttcattttttctttggcaaacaggtatttttgtaaacccaagttttatttatttatttattttgagatggagtttcgctcttgtcatgcaggcaggagtgcaatgcacaatcttggctcactgcaacctccacctcctgagttcaagcgattctcctgcctcagcctcccgtgtagctgggattacacgcgcctgccaccacacccagctaatttttttatttttagtagagatgggattttgccatgttggccaggctggtctcacactgctgacctcaggtgatccacccatctcagcctcccatagtactgggactacagacgtgagccaccgtgtccagcctgtaaagcaagaatttttaaagagcaaaaagaaagtgcagattttctgtctccttactacagatgagaaaatagtataaagctatcgagagtgtcaacagttctatattacccccgtccccacccccactgtactgctcctgaaagctaaacagaaatcccaaggaaagtatacattcaaggaacgaagataactttagatatgtattacatgatgcatatacgggttttcagtgaactatatgtgatttcaaactaaattaaaaacaaggctttactatgacattatgaatgaaaaacagtttatttataggatactttgactctactcaaaaagtatgcttaaacaatccaacaactttaggaaagccaaccgataaatctttgcaatcaggcagaaatactaaggcatttaaaaaacatacccagaccgcttttaacatttaccccagagatctctaggctcatcacagagggtaaccacaaaatgcttaagctgcatacagacatcaggcaaatgccacataactgctggacagtaagttatcaccacagtagttaccaatgtgacaaagcagaggataaggagcattcagagttggaaactacggtggaaacgtttccatttatggcacattttctgattggttttataactcatgttactaactatagaatcatagacgagaagaatccccggaaccaagcctcttataaataagtcaactgacctgaaaaacttacgacagagtgaaaactagacccaacttcaaactgagataggattttatacttcacaaaaattaaagttagttatttagattttattagaaatagctcagcacgtaaagtcctcaaaggaaacagacatacagtcaaaaaaaaccattactgcggggcgcagtggctcacgcctgtaatcccagcactttgggaggccaaggcaggcggatcacgaggtcagaggatcaagaccatcctggctaacacggtgaaaccccgtctctactaaaaacacaaaaaattagccgggcgtggtggtgcgtgcctgtactcccatctactaggcatgctgaggcaggagaatggtgtgaactcgggacacggagcttgcagtgagccgagatggcaccaatgcactccagcctgggcaacagagcgcgactccgtctcaaaaaacaaaaaccaacaacaacaaaacattattaaactataataatgttttctatcaagacacaaaatattaaaagtagatcaggaaggaataataagtcaattcattatcaaccttgtgactcttctgtccagcctcttccagaggttccctttacttttaagtgcaatgcaatctttaaccttaactctaaaaactcatttagagtcctccaatttcttatcagttttccaatacagctcaagaacttttccatcagtgaataaaagttgcattacttttccctttcacagcttgttggcagggaattattttaaatgtacaacaaaaatctataaatctgtagcttccaaaagagtgtttgaaaatatattttaaatggcaaaataatctcagtaatcaacagtaatactgaagtaatgtttgaaaattacatttttagaaagtataaagttacatttattacaagtgaagaaaaaaatttttatgagggaatgtttttaaaaagggttacaaattctttgacacttctcccaatgagaggcagatttctgtcaattccccctcaaatctgagggagcttgtgaccactttggtcaacagaatatggtggatgtggtactagatgactttccaggacaggttataaatgggtatgcagcttcaactgagcacagagacttcatgttaagagatattataaccctgagaattccatgctgaacagccatgtgcacacagtacttgacgaagcaacccagccaagcaaagctttctagccattccttaaaagctgccagacttatgggtgaagaaactatctcacaaatttgtgtatggactctccttccagtaacgtaaattccaagagagtaggaattcgtctttgttttattcactgatgtatccacaccattttaatagtttccttttatgtatgcagtaagcattcaataaaggtctgttaaatagatattagtgatggtggcagtggcaggtggagaaggggatatcctattcatgaatagttcacagcagtaaccatgtgcatgcctcgcaaagcagccaaagattttcagagagtctatctaattccaatgaaaagcccaggcttttaaaacggtattttacaaagactgatggatctgactaaagaaatttaaaacttctatcattcaaaaaccataaaaattaaaacataaataaataaaaagctagggaaaacaatttgcattttaattatgcttttaaaatgcaaaaaaaccctttcaaataactcaaaaagacacaaagatttacagatttctttatataaaaaagtgacaaataaatacaaaagaaatacactactaaatcaaccaaataaaataatccaagaatgtcttttttgtttattaaattggaaattctttaaaaactactatctgttaggcttcagaacactgctgacaaaacagcagtttcattctggagaacataacatttctcaaaagccttaaaactgtcattatcccatgaccactccccactacccccaccccagaaaaagtccacatctagaaatttaacctaaggtaataatctgtgatatgaagcaagctttacacacaatgtttttaaactcttagataaaagagcactaactgagggtcatgttcccgacgttagttttatttgcttgtagttgggttttctttggccttcacaagtgtgtcaaaaaaaattcagtaagttgccagcattttaaaatctattgcacacaaacacaagatctgccagcactgggtctgcaagcctcttaatgactattagctaaacagtagccaatcccttcagatgtggcacatgatacacagttcaaaatcatccctaatctgaaagcttggttcatttacattagatgctttatcttctaaagttatctcagttggaagccctacactagagatcaaactttaagcatgcagggcttgctaaacgctgattggtgggccccacccccagagtttccgactcaggacatctgaaatggggtcccagaatttacatttctagcagatttctaggtgatggtccaaagactacactttgatggtctagagaccacattttgatgaactttccttgctgaagccagagagaggcctagcatcctttgaattacacaattacaggatacttaaacaatattggagattccattaatgggggagggaggcaaggaagagtagaaaagccgacggataaacaaccaatagtcagtgcactgcttccctctatcagaggtggaaaaccattgccctacactaaatttaagaataatcctagattaagttgctagtccaaattttctattctacattctttctcatgggccttatccatttctcaaggtttaatgacctcttctacacttcatggataaaataacaggggtaaacaaaaattgtggtaaaagatcccacgtagctccaatattttatgactaacaaatgtgtatcaccagccttaatattttctactgaatttgctttctccagctggatcctatacatagcagcttttgctgaatgcttcctttgttccgggcattgtgctacaacattacatgacttttcatcatttcatcataataacaactctatgaaacggtgcctactatccccatactacagatggagaaaaagaggtcatttgtcaaggggttaggtcatttgtcagagaagcaagcacaggtaaaatctacatctgtatacgggtaatctggctccagagtcctcaattttctttttctttttttttttttgagatggggagtctcgctcagttgcccaggcgcaatcttggttcactgcaacctccgcttcccaggttcaactgatctcgtacctcagcctcccgggtagctggaattacaggtgcacgccaccacgtccagctaatttttgtatttttagtaaagacgaggtttcaccatgttggccaggctgctctcaaactcctgacctcaagagagctgcccacctcggcctcccaaagcgctggggatacaggcgtgagccaccacacccggcccagagtcctgaattttaaccactacacttcatctaaaattcaacttgtacaaattccaatctttcatctaaaactagctcttcctctaaacttgcctactgtcaatgttttcaccttcctgctcaggctgccaggctccaaatcactaagttcctaccataattaagtccttctacatttcacatctgtctttttctttttatttcaattgacctaaatgtccttattcacccttcacctggcctctaaaatgcctagtatttctgcttctagtcttacacccaacggtgctcctcactcattgcctatgggtcaaaggccagcttatttaacatcaaattcaatttaagaccttacctacctcttggatccatttctgtggttccacaaacagattaaaaattatacttaaaacacaccaacacacatgcagagctttatttctgaagaagaagagagaggggtggaaaggaaaaaacttaagaaacaatgttcaatctgaaagtatcacttctaagtggaaggctacaagggataattaatagctaccaaaactgaacactgaaacatcacatccctctttcatggagccatgtaagttaaaaaagaatcttaaactgttgaggtatatcaacatagacaaaatctgaatgccaaagtgagtttcactctaggatcaggttatctggcagctcctgaaacaggacagtttcaggaaccctgtacaaacctcagtgaaatgaaataacttcaagctgtttgttacaggggactcttgtgtcttttagtctaagtaaaagcagcaattttctacaatatatttatataagctgtgcatttccatgaaagaaaggaggtctactgtggatatatgcttggtatgaaattatgtcagaaacaagtgggagcgaggggcaagtcaacatgctgtcactaaataaaagacagacccccagaaatgacctcaacaatcaaagaaaacatgatagtgtaagttaacatgattaattttttaaattaatagactatattttaaagtaatttgaggtttaatgaactgagtagacagcagagtacccatataccctcccttccatttcctttgcacatttattatacttaatgagccaatacttgcatattcttattaaccaaagtccatttacatcaaggttcgctttgttttgaattttgacaaatgtaaaacatgtacttaccacgaaattttacaatatgcaataccaaaaaatacagctagattcaaagagagaatgtttcagcatctcattatctttatcacagtaacataaactgaactccgatcttctcccctgctcccacctagttttcccagtcttcccatctcagtaaagagcaataccttccatccacttgctcagaccaaaaattccttcctcttttataacccatacatccagcccatcagcaaatcctacctgctctaacttcaaaatatatccagaattgaaccttaattctcacactttaccaccaccactggaacccaagacaccattctctcactaggttattatagtagccccctaactcttttttttttttttgcttctgtccacaaactaatcagatcatgtcactcctctactcaaagcaggaactggcattctaccttagagcaagagctacaatcctcacaacaggcctactaggttccacacaacctgtctccacctacctcagttcccttttctgtctatgacttcacctcctgtgtcctcttcaccacttgctgttgaagctacactggtttgcttgccggattacttcaggcagtctctgtccttaaagttttggcactggctgttctttttgtccaaaatatcttccacaaatgctcacacagctgacttcacatcctgacacaaatatcactttcatagttaggcctttttccctgatgaccctatttatcactgcattgttttcccctgtactccttatccctcttacctgctttatttttttctgcatagcatttgctgcaaccaaatatatattctactttgttattttattgacccccccaccccactagaaaataaatgcagcaactgaggtttctggccttaaaaagcacttagtaattatttgttgaatgaataaactatggtgtacagattctcctcaacttacaatgggggttttgtcccaataaacccatcataatttgaaaatatcataagatgaaaatgcatttaacgcacctaacctactgaacatcaaagcttagctgggcctaccttaacgtgctcagaacacatacattatcctacagctgggcaaaatcatctaacacaaagcctattttataacaaagcatgaataactcatttactgaagactgtactgaaagtgaaaacaacggctgtgggtactcaaagtacagtttccagttttcacacgataataaagttgaaaaaccataatttgaactatagtaagttggggaccatctgtcaaggttcctaaaggtgacatacaggtgctagcaactacagtctaaaaaaataaagccccaattctcaacaaatcagtaactgattctggaaacacagaagttcctttgactctcttaaaggcttcaagcccctctatcagaaaaaaatgtctacagtttgaggagactagcctgctgccttcgggatgtccccatctgttttctagccactaacacagccacaaagcataccacacttaggaacagatctatgggtaggacacaagcatatttaggctgctatcataaagataaagatgcattcagccataaatacttaaacaagtattcatactggaaatatgaaacacttttaatcatattcctaacaaaagtaccacgagattaactggctgagaaataatgggggtgatctcctatcgactacaaaagtgggttagaaactgaagtaatctaacctcatcaagcaagtaaagcttcactttactgcactttgcagatgctgttttaaaaaaaaacaaattcaatgtttatggcaaccctgcatcaaacaagtctattagcgtcattcttccaacagcgtgcactcacttcatgtccatgtgacacatttgggtaattctcacaatatttcaaatgttttcattatctgttatgatgatctgtgatcagtgatctctgacactgccattgtaatttctggaggtaccacgaaccgcgcccataaaagatggaaaacttaactgataaaaatgtgtgttctcactactccactgaatggccattcccctgtctctctccctctcctcttgtttccctattccctgaaacacaacaatattgaaattaggccaattagtaactcctcaatggcctttaagtgttcaagtggaagagtctacagctctcgctttaaatcaaaagctagaaatagacacttgcggatgttttctggtaaaatagctgaaagaaaagaattttttttagagacggggcgcagtggctcatgcctgtaatcccaacactttgggaggcggcggcaggcggatcacctgaggtcaagagtttgagaccagcctggccaacatggcgaaaccccctctctactaaaaatacaaaaattatgtgggtgtggcattgcgcacttgtagtcccagctactcaggaggctgaggcaggagaatcacttgagcccgggaggcagaggttgcagtgagccaagatcgtgccaccacactccagcctgggcggcagagcgagactccatctcaaaaaagaaaaagaatatatattttttaaaagctagaagtgattaagcttctgagaaaggtatgttgaaagccaacataggctgaaagtaaggcctcttgtaccagttagcaaacttgtaaatgcaaaagttcttggagaaaatttaaaaagtgctactccagtgaacacacaaatcgtaagcaagagaagcagctttattgctgatatggacaaagttttagtggtctgtatagatcaaaccagccacaacattccattaaactgaaagcctaatccagaacaagaccctaatcctcttcaattccatgaagactgagagaggtgaggaagctgcagaagcaaagtctgaagatgacggaggctgctttacgaagtttaaggaaataagccatctccaataacctaaaagtgcaaggtgaagcaacaagtgctgatggagaagctgtggcaagttatccagaagatctagctaagatcatcgatgaagatggctccattaaacaacatgtcagcaatgtagaaaaaacagcattctattggaagacacaatccaaaacttttgtggctagagagtagaaaggagaaatcctgtcttcaaagagaggagaatgcttgacttcaaagcttcaaaggacagcctctcttgttaggagctaatgcagctggtgattttaaggtgaaggccaatgctccttgaccattctgaaaatctaaggcccttaagaattacactacatcagccaggtgcagtggctcatgcctgtaatcccagcactctgggaggccaaggagggagaactgcttgagcccagtagttggagaccagcctgggcaacacggcaagaccccgtctctataaaataaaataaaaacaaattatgctacatttactctgcctatgctctataaatgaaacaacaaagccaggatgtcagaacatctgttgacagcatgttttactgaatattttaagtccaccattgagacctcatgctcagaaagattcctttcaaaatactgctgctcactgacaatgcaccattgccggagaggtctgaaagagatgtacaaggatataaatcctgttatcatgcctgttaacacaacatccattgtgcagcccacagatcaagcaataatttccacttctaagccttataatttaaaaaatacattctgtaaggctatagctgccatagatagtgattcttctgatgaatctgggcaaagtaaattgaaaattattctggaaaggattcaccattctattgagtcactcatgattcatgggaggagttcaaaatatcaaccccaacaggagtttggaagaagttgactccgactctcatggataatcgagaggttcaagacattgctcgaaaaagtaactgcagatgtgaaaaacacagcaagataaccagaattagaaatagagcctgaagatgtgactgaactgcaatctcgtgataaaactgaaacagatgcaaagttaagttgactctgactctcatggataactgagaggttcaagacacaggtcgaaaaagtaactgcagatgaggaagaaacagcaagataactagaattagaaatcgagaattagaaggaaagaaagggaaggaaagaaagggaagggaagggaagggaggggaggtagggagggagggaggagggagggaggagggagggaggagggagggagggagagagggagggagggagagagggagggagggagggagggaaagaaattgccacagcttccctaaccttcagcagccactaccctggctagtcagcagccatcaacatggagataggaccttccaccagcaaaaaagattatgactcacttcatgaaggctcaggtgatcgctggtatttcttttagcaataaatattttaaaattaaggtagtccactatttattatgacataagcctaccgcatacttaacagactacagtatagtgtaaatgtaacttttatatgcaataggaaacagaaaaagcccatgtctctcactttagtgtgatattcactttattgcagtactgtggtcatctggaaatgaacctgtgatatctctgaggtatggctgtattttcatacaaataaaggcactccccctaaatctagagtctagatcccaaatacatctgtccatatagggggtaccactcccaagaccaaaggggtgtatggctcctatctccagccgtaccaaatcatatatacagtgtaatatctggttactctttattcaggacagctacattcaaaggaaacataaaatgggcagaataaggactccttgctcattaacaaaacaaagccaactcttatgtcagagtacccttttgatcaattagtgtgattatgttcactagtaacagattctaccatcattgttgtccatttcatttccattctcaagctttaaaaccccaaaaggacagaaagagatactacaggctagtattagtaatactaaaaatagttacctcttattgaaacctgaagggcctggtacttgacatatatcattttctaatctttatatgaactcaataaagcaaatattgttatttcaacactattacatattagagactgagcaatctggacaaagtcacacagcttatcagtaccagtaggaattcaaactcaggtctgactcaacagtctgcattcttaaatatacctcaataaagctgttgaaaaagtaaaagtcggccgggcacagtgtaatcccagcacacctcaataaagctgctgaaaaagtaaaagtcggccgggcacagtgtaatcccagcactttgggaggccgagtcaggcggatcacctgaggtcaggagttcgagaccagcctggccaacgtggtgaaatctggtctctactaaaaatacaaaaattagctgggcgtggtgatgggcgcctgtaatcccagctactcgggaagctgagacaggagaatcactcgaacccaggaggcggaggttgcagtgagtcgagatcgcgccattgcactccagcctgggtgacaagagtaactacgtctcaaaaaaaaagtaaaagtctccatctttccactagaccacactgcttttctcaatctttatgacaaacatgtaaggcatattgggttctggataatatgtcaaggagatatactattttggaatattttggcaaataaaggggggctttaaaacatgaaatttttttttcttaataagaactgtaatctatttccccaacttcattattaagtgagttttaggcctaggtcttccagaacagtttcctccaaaacatacagtgtaatatctggttactctttatgtgtgcataagaaatgtcactgtgacaaatgttataaagaaaaaatttgattaccctaaaaacaaatacataaacagcccgcaagtttagctcctaaagtaggaaagaataatgtgaaaatgtttctggctgtaccactcaacaaaaatttgcccgccaataaggaatcctttcttcaaaaattggtcatgatcattagccaaactgtaaccagtaacatccagctggattatggagctaataaagaacaacagaggggatccacaggaaattcaacaggtaacttacaactggctctctcatcagactggcagactgggtctaatccgaggtcagatgacatgggggattatggaagccaataacaatcatatttaaataaatgtcctttacagaacaccaccactttcctcataaaaagttcaaaggactattttcacccctcacaattacagtaaggataagaagcccaagcacagcttgaagcagcaaaattttctgaaaaggaattgaattctgtgttctcttcaggatcttcctttcccaataatgggggtattaaatttcacttataaatcaaactgaaagggaaaaaaagaacaataaaaaatgagctggaaaacctacattcatcatcttcaaaacaacatcaagttagaaacagttttaaagcaatgttacaactcctttagaatctggcaggttttctggtttttaccagatcccgctccggcaacaacaaaaaaagaaacagttttaaacagttttatgggcgtggtggctcacacctgcaatcccaacactttgggaggccaaggcggacagattgcttttcagcacaagagtctgagaccagcctgggcaacatggtaaaattttgcctctataaaaaaataccaaaaaataccaggcatggtggtggcacactcctgtagtcccagctacttgggaggctgaggtgggaggactgcttgagcccaggacagcaagggtgcagtgagccgagattgcaccaatgcactccagcctgggcaacagagccagaccctgtctcaaaaaaaaaaaaagttaaatgctgatgactgaatagaacacaattctctgtaaattcttcaatgtgataaagcatttcctacaccagttaccagtggcagcacctaataagacttgagagcaacttaatacttcaccctcatgtatgtatgaatttaaaatagaacatcacaataactacgaagatacccaaacaccccttccctaatttttttttttggtacaaacaaagtctcgctatattgcccaggtggatctcaaactcctgggctcaagtgatgctcctgcctgggctttccaaagtgctggggttacaagcgtgaaccactgtgcctggtcgcttccctaattcttaacatgtcccacaaaagattctgcttgatcttggcccccactatatcatcactatctctagtaaatagactcaaagcctctgctttctctgtggctctagccacactggcagagaccaaaggagagttcaatgataggccctctcacagaaccttgtgccttaccatacttgtcagttacaattttattcactcgattcaagcattttttggatgcctcatatgtttcaaggtacctttgttacagcagtgaacaaggcaaagcccctaacaggaggaaattcacattccagaggtaagaagagaattaaaaagccaaaaaaaagtgtgtgtatgcatatatatgtgcataagaaatgtcactgtgacaagtgttataaagaaaaaaaacacagtaagaggacagagagtgaagttgtccttgtacagttgacagtcaataacacctcttttaacagtagtagagacctgaacagggtgaagaacagagccaagctgacaggagatctggattaaagctttccaggcagaaggaatcgaaaataggcgggaatatacttagcttgttgagcaaggcaaacagcatggctggagcacagagagccaaaagagaggtgataaagacaacaccaatgaggtaaataaaagcagacagaacttggatcctctagagcctgcagctcacgatatggagtttgaattttagtctacgtgtgacaggaagcctttgaagaactttgaggagggacacggatgtgttatcgacacactataaatgaccagtaacttcagaagcaaggaggccaactgggaggctgcgaaggttgtccaggcaaaggatgataatagcttagactagggtgatggtagcagtcaaatgaggaatgttatttattttcagaatgtaatctgaaggtggagccaagatttgccaatggaatagaatgtagagatgaaaagaaaaaaaaatctattcatctctgcatcccctcagagaatgtacctgaccaccatgaaagcaagggccatgtttgtcctattcaggtccttgaacaaaggaacagtgcagtatgttctagttgaattaataaatgacctgcttctttccctacagaatcacaatattggcatttattttggctggcaaatactggtacgatgtcaagcatagaaattaagcaccttaggagaagaaaagggagttaaataaaaaagagatccatgtttcactgaacttgcaaattcaactcaaagcaccacctgtctgaaaatggaacgtatatatataaaaaaactgctcattaaggaaaataaatcacagtatctcagcaacagtgctttgtcgtgagttacaagattggctacaccatctgacaggattacttaaattgacaaagacctgcctcaccaaacacagctagaggtccttgggtccttgtggtactggtatcaggaatctgataaatcagtcagagtgtggagtgtttttaaaacacagacaaaatatatttagcaagcaaagtctgttaaagggaagattggagatcactttaaaaataattcaaagcctactctaagtatttgcaaaattgtaagattatatttctgtgcttttgaataagattcagattggacagtctcaactctcccttgtgggagagggtaggggtgggggtggacctgttttctactaagaaatttataggactctccaaaaacagaacttagggcagtactccttaatagtgaccatacattagaatcatctagggagggctgggcacagtggctcacacctgtaattctagcactttgggaggccgacacaggcagatcatttgagcccaggacatcaagaccagcccgggcaacatggtgaaatcccatctctactaaaaatacaaaaattagccaggtatggtggcatgtgcctgtagtcccagatgctcaggaggctgagacgggagaatcacttgtgcccagaaaggtagagggtgcagtgagctgagatggtgccactgaactcatgcctgggcaaaagaatgagatcctgtctccaaaaaaaaaaaaaaaaaaaaggaatcaactagggaggcttttaaaacatgaatgctggagacccacaccagataaattaaatcaaaatttaatcgggggtgggtcctgggattttccctttaagtgtttcccacgtgatctgaatgtgcagcccaagttgagaatcaccaatttacagcaataaagtttaaagtagaggatttaaataaaagtcttttaaagaaacaacactttcagaagtcaacaaacttgagccttcatgttaacacgtgggggtcacagtgggcattttggagcacagataaaaggacctgctttggaattgtaaaaggctgtttcatacatacaaacagttcaggaaaggatagaacgaaaacaaaaacaagaaaccttgattaaccccaccacattccttcccaagggcttgaattttttaaccgaacactacaatagcaacaaacctagagagtcagttcaagacggcttctccctgtaatgctgccttagaactctacagaacagcagtcactgctgcacagctaaatacatctccagccaaggaaatctagacatagaagatagaaaataacatcccagtttgtccctcctctttcccctccctcatcacatatcaacagctaactttgaacacatctgtggttcactgtaccacttacaggggtacagaggaatgaaattaccagtcctcactgtaaaataaacacatttctttaagaaattctataaagcacaagaggaaagcaaaaccttagtaaactgacaaatgttcccattctcccagcacatgaagaagactgccacagtctttttcaattacactttgaaaccctctgtcctggttttcaagcacaagctgatcttcacctcattatagatactcaaactgccacccgtcttatttttaaatatcagagaagtgacaaaattctatctatgatcaaggatgtattataaaagagaagaaattttgcctggtttttacatttatttaagtcccttctacaatgaataaaaatggttgttcaaatcaatgggtgaatgggaatacaaataaaatatgggtagcattttaaggcatggtattaaggctaacatgatgtccatctaacatccagtttctgaaaatctgaaatcagaacacaggaccttttcatttcaaatttacattaaagttcagctcactgattaagcatttccctcaataaaattacatttgtcataccttaattgtgcaaaagctgcaaactggtaaaaaacttgaatgccatggcatgattattcaaaaataactggtacaccctatgcctgaaacctgagtgcctactgtgaacctgccaaaatgattacaatgacaacccatcatcttcatcacatgaattactgcaatgtgaacagtattctgctgagcactatacagtaatcaaaagacaagctccacatcctcaagaagcttataaatttgactgaggagatagggctgataggcaagatagcaataaaacacataataagggcctaaatcatgcagtacaaactaagttttgaataccagttcccagcttgcagtctcagacatagatagcaacaccaccaccaccacccttgccaagccaagtaagtaaaaagtaaaatgagtaggctaggcacggcggctcatgcctgtaatcccagcactttgggaggccgaggcaggtggatcacaaactcaagagattgagaccatcctggacaacatggtgaaactctgtctctactaaaaatacaaaaattaactgggcatgacggcgcgtgcctgtaatcccaactactcgggaggctgaggtaggagaatcacttgaacctggaaggcagaggttgcagtgagtcaagatcgtgccattgcactcctgcctgggccaaaacagcaaaactccatctcaaaaaaaaaaaagtaaaatgagtatacaggagtcctaaaaacttgagaaaccaaaggaagcaattcatttggtcaagagaaaggtcagggcagtttcaaccttcccatttatttagctgtgtgactttcaacaatttacccaaccctttaaaggaagatagtacctactaattaccatgagaaccaaatgagatagtgtatataatgcgctttgcacaatgcctggcacatagtctcaaatactgcctattatcattactgttagaaacagtaaaatcctagtgttggcaggggcctttcaataatccaattttccagtcgaatagttctcagggtgtagttaccatcagcatcatttgggaaattgttagaagcccatactctagggctccactccagacccactgaatcataaattatcaaatctgcgcccagtaatctgtgttttaacagcactccaggtaattgtgatgaccattaatgttagagaattgctgccctaattaaaccctctaattttacgtataaagaacatggaggccaggttcagtggctcttgcctgcaatcccgacattttgggaggccgaggtgggagaaccacttgagtccaggagtttgagaccacgtaatatagttagaccctgtctctgaaaagaatacaagaattagctaggcatggtggcatgtgcctatagtcctagctgctcgggaggctgaggcagaaggatcacttgagcctgggaggtcgaggctgcagtgagccatcatcataccactggacttccagcttgggcgacacagcaagaccgtgtctcgaaaaaaacaaaagtaagcagatggaaacctgaagagataaaataacctgctcaaaaccacaatcatggagactgtttgtttagggtccattatatgccaagtaccagggtgaccactttttacatttttaacatcaggtcctcacaacagcccagctgggccccaattaacagaagaaaaactgaggttcaggtgtgagatggatggagtaatttgtcaaaggcggctcaatttttaatgggcaaaattaacattcaaatccaagttgtatgtgatcccaaacccttactgaaaccaggaccactgagtgttctgagggaacgataccaagcacacgcccagacttccccacccaagggcatcgttcttttcattctatcataccaccttagctgcaatgattttaccatgaaacataaccagaaattagcactttaaagcaactctcagaagacaggtggtaaacgattcttcactccaactagaaaggaaaaaatgacaacatactatgaaaaaagctatgaggcaggaaaaagcacacgtcaaggcatggagatacggatatagactaggtaattttgcaaccacataagtgaaagaaaatttgctatccaatcttcctattctctactcccaagagcctagtgcttttgtatagttttcagctcagtaaagtgcctccagatttataaaagctcaatgacaataacaaggtatctttattacaaaatagttgttaaaagtttgattcgaaaaattttaaggaaacctttcaggtaactgaaagtggagggtaggggcgcgactcatgaaggagttttttaaccaaagaaatgatatgatacatttttaaatgaccacttcagttgcaatataaaataacagattttggaggaaaatgtcaatacaaggatatcaattatcaattattaggttactatattggttcaaggagagatgatggtggctgtggagatgagtgaaatcaacagatccaagatatattttagagagtattgtagaagactaggaatgggagtgaccagacaggaatgaagacttctagacttactgcacactgtcatgaggaaggatggggatggaagggtacagtggaataagctgggttttagcagaaggaatcaagagccccattacaaacacattaaatggcctggcgtggtggctcacgcctgtactcccagcactttgggaggctgaggcaggcggatcacctgaggtcaggagtttgagaccagcctgaccaacattgagaaaccttgtctctactaaaaatacaaaactagctgagcgtggtggcaggtgcctgtaatcccagctactggggaggctgaggtgggagaatcgcttggaccctggaggtggaagttgcagtgagctgaggtcgcgccactgcactacagcctgggcaacaagaacaaaactccatctcaaaaaataaaaaataaataaaaataaacacattaaacgtttataatgtatttacaagactaacaatcagataaagtctgaacttcagaaaggagatagagctgacctgaaaatataaattacgaactattgttatatgaatgttacttaaaagacgaggaggccaggtgtggtggctcatgcctgtaatcccagcactttgggaggccgaggcaggtggatcacttgaggtcaggagttcaagaccagcctggccaacatggcgaaaccccacctctaccaaaaaaaaaatacaaaaattaatcgagcacggtggcatgcacctgtcagcccagctactcaggaggctgaggcaggagaatcacttcaatctggaaggcggaagctgcagtgagctaaggtggtgccactgcactccagcctgggcaacagagtgagactcggtctccaaaaaaaaaagggcagaagatggggcggaagaatagagataggaaagaggaggatgttgagaactaaaccctgaggtacttttagtattcaaagtgtaggggggtctggaaatcttgtagagaccagtaggggttggagtatgacatcttccaataatgaattctcgttgctgtccccttatgggtctgggtctacctgatagtctcttctggaagtcggtatcacttgtgcttaatttctactcttttgtgccctctatacagcctctactacaaatcttttttgaagaagcacagggagaaataacttggggaaaaaaaaaagcctatcttttagaaatagattctgaaatatttacagatgaaataatatgttgtacagaattggcttcaaaatagtccaagtaaggggtggtctagataaaaaaaaaaagaacagctctgagtagatgcctgttacagttgggcaatgcacacatgggaaggttcactgcactggtctctctgaatatttcacaataaaacataaaacatagtatggaaggttggcaaacacaagtccatgagaaatctctccatcttacccagattaacgagagatacaaccaaggatccacaggtttgatgcagacattctaaaagattcaattataccaagactttaaaggtgacagatttttttcccctcaactatacatttttttttttttttttttgagacagagtctcaactctgttgcccagactggagtacggagccataatcatggctcatttcagccttgactttactggctcaagcgagcctcccaagtagctgggactacaggcatgccccaccatgcctggcttttttttttttttttttttttttttggtagcgacaggggcctgctatgttgcccaggctggtctcaacctcctgggctcaagcctcagcctcccaaaagtgctggattataggtgtgagccactgcacctggcctatattgctatcttaaaatgtctcagtgacccaacaatttgccaaagagcatgtagagcaaactaggctctattcagcatttccatttcttaatgtatctatttgatttcaataaaatttcatcattttgaagatctctcccattagcttgggaaactacagaaacatgcacataactactgagaaggtatcaagtgttcctacactagtttaaaaaaatcattcaacacccacataaattctgatatgcactaggctgaacagctgttaaccactgagaagctgggcactgcatcctctccctgggtcaaaactctatatgctaatcaaacagggtcatgtatttgggaaaataataatccatggtaaaagtcacaaaaagaccttaattttaaaatgagaattcctaatctatacattctttaaaaaatctagggtatataggttgatgtaccttccttgatcaaaactcttacttctctgaagcctgtcagagtattttcaccacaaggcttggattaggtttcattttacatatgcatgcacatgttcacatacccataatcatccttcttagtagtatatagagacggaccatatcgttaccctcttctgctcaaataaatgtcttcccctacaaatgctaaggagtaaaatgatccagaaaaagtagaaatttggcataatcagcactgacttcctcaacggtaacatacatgacataaacacattaggtagactggatgcccaaaggccaatccaacctcatgtcttcctggcatttctcaggcctttctcgtcacccaccccacctaggttccacgtttccaaaaaagttccatgaagattcaggaaaaaacaaaaagggaggaaaactcattttattaaatttacatcatatccttcttcccagggttcaaaattaaataaaaccaaaagaagaaaaccagaaagacaaaagcacttttgtccaaggtggcaaaacacaagagcaatttaactgccattatgaaccaacttatactaaaatagtatttcctggaatgtgtataaattaaaaaacaaaacaaaatgttcatggttacttttactttcagggttgggaactgaatcccacaaacagcagctaaacctcaaaaaaattgtaattccctaattatttccagattaaaacacttctcttgaacacatgtttctgctgttctttggggtgagtgtagggcacagctggagtacagtataacacagaaacagcaagtgcactaagagcatcaaatccttccccccaaaattgtttatctcttccagactcctattcacacttattcccctgacttaattttaattctgcctcttggccctcttaccttgtccctttctaccctactcacttattctctattcatcctcattctctgaaatgatagtcaaaataatacttcatgctaaagcattttcttaaatatttccagatattccaacttgttatgatctcccacttctttaaaccagaagctattactacttttagagtgcatacctatttctgccccatatttatcacatacaacttacgtatgatttagttagcatcctcaaacttagaaaatgattctcgcagcccagcaaaaatccttactatagcagccaatcaatatctattgaaaaatacatgtaccccctcgatacaattgtcataaaagttttcagtgtgcacttaatttgataatgtcacttccatctttctgttttgaaaactgtttcgccgggcgcggtagctcatgcctgtaatcccagcactttgggaggccaaggcaggctgatcacaaggtcaggagatcgagatcatggtgaaaccccgtctctactaaaaaaaaatacaaaaaattggccaggcgtggtggcgggcgcctgtagtcccagctactcaggaggctgaggcaggagaatggcgtgaacccaggaggtggagcttgcagtgagccaaaatcacgccactgcactcaggtctgggcgacacagcgagactctgtctcaaaaaaaaaaaaaaaagaaaattgtttcataagaatgactcatccttcaaaggaaaaattcagatgaaaaggtgtctgcactatgtagtgtgttaaaatttgttctcaagcctctccagctaccctcaggagtgaacagtggcaaactgcagcttaggctagtgaagtgatctgccctacaccatcaagttagccaagaatagaagccacatttcctgactcctgccttgactcctgatctctttccacacatgcaaatacaagttcagcatcccaaacccaagatccaaaaagttcccaaaataggaaactttctgagtgtcaacatgacactcaaaggtaatgtttattgaagcattttgggtttccagatttgggatgttcaactggtaagtacagctgaccctctgtattcatggattcaatcaatcaaacagcaaaaatatttaaaaaacaatgtctgtactgaatatgtacagactttttcttctcattattccctaagcaatacagtgtaacaactatttacatagcatttacactgtattaggtgttataagtaatctagagatgacaaagcatacaggaggatgtgcataggttatacacaaatactatcccatcttatatcagggatttgagcactgtcagatttggtatccacggaagttcgtggaacaagtcatccaagaatactgaaggataactgtataatgcaaagattccaaaatccaaaacacctctggtcccaaacatttcacatcagagagactccacctgtaatggctttcagttctgtaaatcaacagcacatctagttgtgtgaatacatacgtggctaaggttcaaagtactttaaaagtattaagtccaagacaaagatgagatagtattcctcacctgatccaagggtcacacctgacagtaagaactggagtcaaaggatcatcactgtaacccatcaacataggtacagttcacaatattaggagaagtcatgaagtaacatacatacaggacacacataaatttcacctctaaccaggaatcctgtgatagaattcattaaacctattctcactcaactacccccagtggcttatgaatcaatcctaaaggcatcagacacaagactattaccattacaaatttctaatctgctaagaagtcttgagttttaaggaagaaactagtgccaattcattaaaaaggaaggcagaaaaatggaaaaccagaagtctttcattgctgctctatccccataatctaaaacaatacctaggacatcacaggaaaccaatgtctatttactaatgtctatttacctcttagcctttattaaagtgaactcatagtattgacattattttctcatcctcacagggcatttgaccacattttggaaccaagtttaaaatctttcataggccaaaaaaaaaaaaaaagtatataatgactaacatgctttaaataccatgacaaatataattaaatacttgctctcactgaattcaaaatttttagttccctcaaggtgaagttactcattttccattatttctctctaacatcaatttctccaccagatttcctccacctgtgccactactcacccatctaaatgtgcacatgtgtactcaagcattcaatgaattgcttattatgtactactcagcacgaagaagcagaggaaacccagcctttggagtgatatgaacctgactctacttcttgttttaaccaattactaagccttgtgacctcgggaagtcaatcattatgtctagtactcctgttgcctaactgtaaaaatgtgaaggattattacgtacataaaagcataataccaaaaataggcactaactgattgttagtttccgtccctctcctacaacagcaccctgactttggaaactaaccctccacgaactgaaagcattctcagaatatactgtccttaaaaaaagaggaaggaatgaagggaaagaaaagaaaagaaaaaggagagagggaagggaaaaggcaaaaatttttaaaaatacttttggtcctggtttacaggccaccacaataattcaagtaaattagcataatccagagagacaaaaactttttctattttttactacaccaaaaaagctcataataaaatttcaaagtattaaaaaataaatgaaagtaatcccttcccttcctccatcccaacccatcccatccctcagaaataatcactgttagcactctggtgtgcacatatacacatacacatacatacatatatatttttgttgccaaaattttactgcagatatctggaaaataaagagtagcataaagaagaaaaatatgtaatctatacaaccggaaaaaattttaagctgcaaataagtttccacaactaaatttacattgtaaaacacatgatggggaaaaaaaggtctttacaataaatatggtacaaggacaactgaatatccactatccacaggcaaaataaaattggattcctacctcacaccatacagaaaactaacttaaagtcgatcaaagccctacttaaatgtaagcattgaaactcctggaaaaaagcataggagtaaattcttcatgaacttgggttaggcaatgatttcttatgctgtgacacaaaaagcaaaagaaacaaaaaaaaaacataaattggactatatcaaaatttaaaacttctgtaaataataatcaagaaaatgagaatacaatccacagaatggaagaaaatatctgaaaatcatctatttgacaagacactggtctccagaatatatacaaaaaacacaattcaacaatttttaaaaaccaaataactttagaaatgagcaaaggatctccaaagaagatatacaaatgaccaattaagcacctgaaacgattatcagcatcattagccattagagaaattaaaatcaaaaccacaatgagataccacttcacattgactagcatggctataattaaaaagacaattagaagcattggcaagaatgtggagagaatggaacccacaaatatcgctcatggtaatacaaaatggtaatataaaatggaaaacaggcagttcctcaaaaagttatacacagggctactttatgtgttaaatgctgaggatgcataaaggatcagaaattcagataaagcattcccagaacagtgattgatcctgtttgtttaaaaaaaaaaaaagacaatgtactcaacaattaactaaagtacttgtatttctctttacaaaactaagttatgtaagaactaaacattttaaattgaaaattgtttatctggttctttgaactgaaaatccttttatattcccacctgtgagtgtacacaacaaggtgaagcaaatgcattaaacccagtaggtctcaggacaggaagcatttacactcagaggctatcccacagagcaaaatccacactgaagactaaatcatttcacagaaccctagatttagataaacttggagacaggagagcagctgaagagcccttctctttcctcaaggttgtctacacatctaaatcaacttcactgggggagcataggggctgcttaagggtctaagacaaataaattcttctatgcaatactttacatttatttacaaacggtctatcttacactaagctcaaaatattccactgagctactgcagaaaatctgggtgcgaaataagaaaagacaatcagagagtgtatactcataaaaggaattaaaaagaacaaaatgcccaagaatacagtatcctcacaaaaaataccctaaatgaatctagtaaaaatttggcaacccatattctggaaagatattctttacaagttaacctgtatgtcttatgcaacttccaaagtcccaaagaaagtaatacaaaattaagtggttttgagatactagtcagctttttcggaaagagggttagagaggacttacttccttgtattatgaaacaaaaaacgctctgatgaattaaaagggtagtttctttctttatttctctttttttcagacaagtctcactctgcgtgcccaggctggagtgcagtggcatgaccttggctcactgcaacctccacctaccaggttcaagcgattctccagcctcagcctcccgagcagctgggattacaggtgtgtgccatcacacctggctaatttttttgtattttagtagagccaaggtttcactatattggtaaaagggtagtttccaaaaataaaaacatgtacaaggaaatttaaaattctcctattagtgtctggaaggatgaagaatttctactattttaggttgagaaagaaagctaaaggcaaaagatcaacagacaaaaatttaaacaatttataatttctaacttatccaagtttgactccaatatttttaccaaaggataaatatctctgcttcaaagaatcataaaaacattacaacagcctggcacagtggctcatgcctgtaatcacagcactttgggaggccaaggcaggaggactgcttgagtccaggagtttgagaccagcctgggcaacagagcaaaaccccatctctacaaagaaaaaaaaattttttaataaggggggcataagggtgcactcctgtggtcccagctacttgtgaggaccacttgagtcctggaggttgaagctgcagcaagctacgactatgccactgcactctagcctgggcaacagagcaagactgcagactgtatcaaaacaaaacaaaacaaaacattacaacatatgagaatgttcaacttcactaatactttcccaatgcaaatttaagtaaagatagtattttttatttatcagtttagcaaatatttttaaaggatcctccatgctaattggagtgtggttaaacaaaaaacctgcttgttacactgctggtatgactacaactgggaaccttttggaaagcaacctaacaagatatatctgtagtcttctgaattgttcacactctcttttattcttagattcatacaatataaataaatacaaaaagcaaagcctatgtgcacaaacagcaagcatcagaaagtccatgaaaagaatagtacaagtatatagtaaaggaattaacttatactttgcttttcaaactatgttcaatccaatagatttctaaatatggcaagtttctaaaaatccaactccttaagtacactgtaaagacatttatgcacacagctaaaatatactcaaactaagaagtcctcaaaggccgtaagatacactaaaaatataatacctcccagtgaaataaagggaaaagcagaagtcaggtgagaatatttacatatatgtacccattcagcagttctgtagaagtcattatcttctttgggaggccgaggcaggtggatcacctgaagtcaggagttcaagaccagcctggccaacatggtgaaaccccgtctctactaaatacaccaaaattagccaggtgtggtggcaggcgcctataatcccagctactcagaaagctgaggcaggaaaatcgcttgaacccgcgagacagaggttgcagtgagctgagatcacgccattgtgctccagcctgggcaacaagagcaaaacttcgtctcaaaaaataaataaataaataaataaaaaggccgggcacagtggctcacgcctgtaatcccagcactttgggaggccgagacgggtagatcacgaggtcaggagattgaggccatcctggttaacacggtgaaaccctgtctctagtaaaaatacaaaaaattagccgggcgttgtggcgggcgcctgtagtcccagctactcaggaggctgaggcaggagaatggcgtgaacccaggaggcagagcttgcagtgagccgagatcacgccactgccctccagcctgggcgacagagcgagactccatctcaaaaaaaaaaaaaaaaaaaaaaaaagaagttgttatcttcccagtagaagagatgagaaaatttgaggtccagattggttgagtgatatccgaggaccacagagctagtaaaattatggagctagaacttgaagtctgattccaaatcacatgtttcctatgctaccccaaacaaagggagtattttctacagtggcattacaacagaccaagtaacagcagaggtaaaacaagtttcacatgtctgtggctctttgttttttacaagtttttattactttgtcatgggggggaaaacgaaaaattataattaggtcaaggaaagatataactatactactactatcattctgaaggaagggaaggtataccttctaagtcctgcatagtttaaaaattcccattacttgcgagaccaggtgagactgcacagttctagacttcctatcgtgtgccaaaactctagggataatcaaaaaatgtttgttgaatgaacgctaatttaaaatagaaaaagaaattccagatttcctcctcagtacaagaggcctgcaacaacaaacttctgaaataccagcagtctactaattgcatattcaaatttaaaccacagaaagttgaatcaactctgccaatttctgggactctctaaatgaactcttaatacaaaaatacatactcaggctcagcattttttctaatcatttacaaaagtaaaaggacgtcaggacaagttctggtgaaattttataaacagccatgaattgcagctgtagactgccagatacataacctgtatatgacagggggtaccacgtggaaattagagacatcccccttcaccaaaaagattatatccaggggatactacataataaaaaaaaaatctgaaaaatgtaatgggattaagatcctttagaataggctagtagtgatgattttgctttttcagtcccctcctcacaaacaaatgatgatgacactgcccttagctttctatgtgcaaagacagtattaaccttcccaggccaaacttacgactacaccttttccacacgaaatgcaaggcatttctaactccccagattacctcacattcgttggatgccacacaatagattataaagtatcaagatatatattaatttttaaaagttcaccaggagttggatattctaaactgggtttctgattcttaacagtgagaatgaagtcaagctccttatttggtggttagaggagaggatttggccagaaataattcttttaggattgacagacaagtactacttaagttctatcatctcatccaaaaacttgcttcttatattctgcttttaacccgatctacacaatgaaaagccacggagactagttttgcatgaaagcaaaggacttttctaatatgacttcagagcatgccatgctttaaagtccatgttcaaccacttactatcattttccaactcactctctatgggcccatcccatatttcaactacaggtatacctcctggccctttctatttcataagcttctttggaagacaaatctactgatttatgcaataaactttctacctctacttaaccaatttgataatttaatagctggagataattctaaattccccaaaccttaatcaagaattttggaaaaaaagagctatctagaacagttatcttcctgaaaacactgttgtgctaaactgaaacacagccttttctcaagagctaagcagctacttgggtctacattttaatgcactaaataattttataagatcatgtttgaaaccaaaaaacccaaaaaggattgtcaagctaggtcagcttacaaaaccccttctgttatgaactaggaaatcaaacaacaaaacataagctctaggaaatgagcatggaggtgctccatccatactagcttttccttgtttttttcttgagaggagtgactctctgtcacccaggctggagtgtagtgatgcaatcctggttcactccaacctccacctcctgagttcaagggattctcctgcctcagcctcccgagtagctgggattacaggcgtcgaccatgacactcagctattttttgtatttttagtagagacagggtttcaccatgttggctaggctggtctcaaattcctgacctcaagtgatcctcccaccttggccccctcaaagtgctgggattacaggtgtgagccaccgtgccagcccatactagcttttctgaagcctctttactcattcttttgttctctactctagcagctaaagacatctcctaaagaaacaactagtgtgcctccatacaacccctcagtaagcactcagtattgagactaaactgtgaaaagcactaaaataaatgcatcattcatctatgaccttctgagaataccaccacctcatatttgaatagacgtctagttttcatgagaactttcacgcactcatttgatcctctttaaaaaccacaggaaacagggcaagccatcttatcagctctatttacagagagggaaatcaatttgaaaaggttacatagcttaatcaaggtcacaaagtgactgactggccaagctggtactcagtcttatgatagtccagggctctttcctctacactgatcctaaattgaaaaaaaaaattttttttggactgctcctgcaaggtagggctaccccataggcagagagtagctgaaaaattctgtatgtgtctatcacaagaagttgaggccgggcgcggtggctcacgcctgtaatcccagcactttgggaggccgaagccggcggatcacgaggtcaggagatcgagaccatcccagctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaagaagttgacaggcctaaaaggtttcacatttagatgtttctttttttggaaaaggtgaagatctggctgggcacagtggtgcacatccttaggtagttccagctacacaggaggctgaggcagaagaactgcttgagcccagcctgagcaacacagtgagactccatcactaaaaataagtaaataaataaatcacataaaaaataaaaaattttaaaagggggtaaagagccaatgaattgactaagaaatgtgttgtttcaaatcagaatgaccttgaaaagccatagtacttgcatgcaaaaatatgatccgatttaaaaagtcaatatgcttaaaatacaacagaaaaatcaaccaatatatgtatttcgtattactggtttaaaatttctgaatatgctgtaaagagaaggaggtgaaaaacgtcaaccagactggggtggtggctcatgcctgtaaacccagcactttggaaggccaaggtgggtggatcacttgagttcaggagttcacgaccagtgtgggcaaggtggcaagatcctgtctctacaaaaaatacaaaaattagccagatgtggtagcatgcgcctgtagtgccagctactcgggaggctgagatagaagaattgcttgagactaggaggcagagggtgtagtgggcagagatcataccactaacccctccagcctgggtgacagagtgagactctttaaaaaaaaaaaaaaaaaaaaaaaagagagcgagagagaaagaggcagagagagagagaaagatctcaactgataagatactacataatcacattatctcttgcttgaccaacttaacaaatatttcaaaatgtttataaaaatcaaaatgggtcagcattggaagaagttgtaagtaaaattcaggtgttctccacatgaggcaactgctgttaatagaagactatatgacggtattttctcgaagtttggtacaaagatcaaaaatagaatcacaggcaaaacccttgaaaggcttaggaatctgaatttttaagtactaggttgttgatgaatataaaatttaaagatgtgtatttagggtagaaataaccttgaccttggtagctgtggaacttgtgtggttactcgttctgggccctggttttcccaatggtaaaacagaggaggtagggacacaaacgtcctacttcatagaaaagttataagactttaaaggcgatggtttataaaaagtaattagcacacagttttgacacacactaaataataattagctactatggtggaaattttatttctatttaacacttctgacattagcaaatagtgtaccaaacagacatgctttttacatagttacatgattcttctcaacaaccgctcccccgaaagaaagcagtttttaagagggtcactctcatgatttgaagagaactgggagaggaggaacataaatcagttctgtcacattttaaggattagaatttaaacattaaaaacaattttaatatgttcacatatataactatcacctggttggaccatgacaaaaacccacccctaaccataaacaagggtaacctatcatttatcaaaaacaggaaacgttcctatctctcaagatcagcgctctgaactaattatttaacataaggtcatttttacgagttcacatgctgaatggcttacaattaaaagcctcttctaacccaaatcaccatcctccttcacttacctttttttttttttgagatgggagtctccctctgtcgcccaggctgaagtatagtggcacaatctcagatcactgcaacctctacctcctgggttcaattgattctcctgcctcagcctcctgaacagctgggtacaagcacccaccatgccttgctaatttttttttgtatttttagtagcgacagggtttaaccatgttggccaggctggtctggaacgcctgatctcaagtaatctgcccacctcggtttcccaaagtgctgggattacaagcatgaaccaccgtacctggcctgttgcttacacttaaaaaaaaaaaaaaaaattcctcccctctccctagactcctaacctaatcaagttaccaaattcaaaaaattattttatctcacccattcttgcctctttttttcttttttttttttttttgagacggagtctcgctctatcgcccaggctggagtgcagtggcatgatcttggctcactgcaagctccacctcccgggttcacgccattctcctgcctcagcctcccaagtagctgggactacaggcgcccaccactgcgcccagctgattttttgtatttttagtagagacggtgtttcacgtgttagccaggatggtctcgatctcctgaccttgtgatccgcccgtctcggcctcccaaagtgctgggattacaggcgtaagccactgcgcccagcctgcctctttttttctactagggctatcacaattctggccttcatttcatttgacaggaaggcatgggtttataccctaaccagaacaacaatgaacaggatttctgcctccactcctctaatccaggggttggcaaactttttctgtaaagggccagatggcaaatatttaggctttgcaggccacacagtctccgtctcaactacacaactcttgccattatagtactaaagcagccacagacaatattcaagtgaatgagtatgactgtgttccaataaaactttacttacaaaaacttgccttagactgcatttggcatacagggcatagtctgttgattgtgctaatccaaccaactaatatcaactttcctaaattccatcacagatcatgtgatttctgatttaaaagtcactttccttggctgggcacggtggctcacgcctgtaatgccagcactttgggaggccatggcgggtggatcacgaggtcaggagatcgagaccatcctggctagtagtagagatgatgaaaccccgtctctactaaaaatacaaaaaaaaaaaaaattagccgggtgtggtggcgggcgcctgtaatcccagctactcgggaggctgaggcaggagaatggtgtgaacccaggaggtggagcttgcagtgagctgagatcgcaccactgcaccccagcctgggcaacagtgcgagactccatctcaaaaataaataaataaataaaaaataaaagtcactttccttaccaaaaaaaaaaaaaaaatagaacttaacattccttggcctgatactcaaaggcttcctccatgagtataatcttcattaaccttggtcatttcctttttctcatactagattccaaattgtattccatgattgtggctgcttatactgctctaattccaaacctttgctcaatttgtatacagaatgtcctttcttctttccctctaaacacctacatctcccttgcttcccacactaccacctagaactaaaatccatctatcctctaagaagtctccttccctttacccagaaattcttcttcagcagaacttctatggcacttaatctgtatcttttctgacaatgattgctttgtatcttttaccacagtgaattatatcttagatcccctaagcctgtgggcagaatttatttacaagtcatctctgtatttcccacagcactttacaatcaagagataaaaaaacaggtattattgtttcaaagaaaatattcctacaactaaattcctttacataacatagcactgttaataagaccaagacacacttattctgtattaaaatgttacctaaaaactaatgacactggctcaacaaattaagccttcaaaaattagtctccatcttattacccagagggcagcatggcaaagtgggaaaaggaaaaaaggacaagattgacatcctgattctgccattgttgttaaatttctgcttccttatcttgtgaaacagatgttaccactgcctacctgggaaaactaggaataacgactacagtaaattattatgcattatggcttttataaacagaaatttaagaacagctaagttaactgcaagatccctattctgtcaaaaaaaaaaaaaaaaaacacgagtatcttgtgttcagcattatgaatataaagaataaagacatgagcagtctcataacatagacaagttcagtctactgtagatcctttcacagagaagtaatacaacatactgagtgctaaccttccagctatttctaaaaagatggaagtccaaggttatttctaaattattttaagcataaagctaaatatttaagaatgagttataactgagtttctaccaaattaaaacaacgatgcttacaacagcttacagggctcctgatctcaccttctaccactcattctatacctggatcagcatgcatgctcctgccaccccgggcttactgatgaaaatccaacaaaccgggctcagtcccatcttagggcctttgcaagtgttctctacaccttgaatgctcttcctcaagatcttcacaggtcttgctcacacacttcatacagatctcattcaaactgtcacctcctcagagaggctttccctgaccaccctattaatatagacatctctctcccataaccatcactttcaatctccttaggctctttcctttttatatctctttatagcacttgttaactagccttcggtcattatttacttatctgtcttccctagtaggataaaactccctgaaaactgtaatatcttattggctgctgtactccttgtaactaaaatcatgcctggaacacactgagtacttgatacatattaatttttaaattgatgaataacatttgtgagtgacgaggaatattcatcattgcaacttacataatttcttaaaccagctgcttacaattaaatctagcatgttgaggctactcctagaacaggggttcttaatttggggctttagggaatcattaatacccatgtttctggaaggaaaatctacagcttttctttaaatggtccctaatctgaaaaacatcctagaccagtgatttatgactctggctacatcatggaatctcctggtgaattttaaacatacagatgcttggatcccatcccagagggtgtattttttctcatctgtggtacaaccacaggacttctaaaaaattacccaggtgattctagtgtatagcaaaagttgagaaccatgcaatttgaacacaacaaatgttaactgggtgagagtcctcaaaggtacttacagtgggaagaaaacaaaaattgaaaactatgaattttgagggaattggcattgctggcaaacagatcaatacacaagttcctgaataattctgtatcataaaaacattttaaacaaaaactagtagctctacctccacttaaatactaacctgacattgagattctagagcttactcccagaacacaaataacacctttcacttaaaacaacgtatttcagacaaacattcacttcttaataacttacttataaaaacctaaaactatcaagaaaacaacagaatactttttgaagacgaatcagctatattacaactatgaagctctttgtagttttattcctaaaaatgcctttgaagcaacacatttccaccaattaatgtcctcatttagcctcaactgttacacaggatgacaggccctgaatttaggtgaaactaatactgacaatagacacaaaggggggggggggatttcagagatttatttagatcatgtcaaaagggtttgaaaagagcaggtgtcagactgacacaggtggtaaattgttttctttttgaagtcaaacaagcaaacattgagtaataagcgaattcactgataccaaccgagggtttcataagttactggtttttataccttcatccaagtagcccttttaaaaaagggattagcaagatagagagcaaaacaacaaaatgttaagtatttgtaaaataaataaatccagatgcttaaatccacagtgataaataattttaaattattcctggatacttagaatcacgatgaaactcattccatctatccctttctttctttattcttggctgtatggagatacctgctgacacagaagcaccaggtcatgagcacatctgacataaaacattacaaacttaaagcagtattttttaaaatctaaagggcttagggaagacagccatgctcctagctatgaagcctctgtggcttgacttcctggtcatatcacaaggatttttttttaaagtattattcagttcccttgttgagtaagttaatttactaggaaagtgcaaacaaagacatacatgcaggtacgcagctcatcaacgcattttagttgtggggaaagatcaggcttaggagacacgaataattataaaactattagagctggaagagccctctttaaatttcccttctagaaagatgggcacaaggaaatccttagctttctatgtcgttttactcggtaaaatagtacactcttattagtaactttatcttttatcaaaagcctgtggaaataaatgttctgggattaactagtaaatatataaataaagccacagaaacatattcccaaaatgtgggctggaaatgaaaacagaacagcatgggatacaaaaccccactggctgtttacaaaatgtttcgtgtacatgacttttatgtaataggaacagaacactagtataggaaatgaagactacatggaagggctggctacttggaggtgacggagttaaagatttcatgaaccatcaaaagaccaggtcatttatacactagattatcaaaccagaaaaagtctgagtcccctcattccattacatttgaagaaatgagaagcaccaaaaaaataaagtatcaatacaaagaagagagagaaactaagacaatctgaccctgaaggaatcgcaatgtggagggaaaacccagccctaggagttaattgtctaagtcaggtaagaaaagagtgaaaaagttgaacagcacaacagactatttcatgaacaccagatgcctcgatatgtaagggctttaaataaagagaaaacactctcctcatgagctgctgcttcagtgcctagttcttcactcaactatacccccctctaaatcagatgcagcattttgaaatcgacctcactcccttaaccacacttaatttttggagtagaggttaatgaacacaccaggataaaacgatgtctagtttggcaggagtgggagtacaaaagtaaggggaaaaagacaagaaagaacaaagcactggttcgcacacctctctccaccccagttaagctgtggaaagctgactggcatatccacatgcttaaattatacgttactggcaatgagggaagtggggaaatgctaacattctgatttgtcccttgacaaatgagggaggatattcccccctcagggttgcactttaagaatttctacttgcaatgctcactgcagcctcgacctcccaggctcaagtgatcctcccatctcagcttcccgagtagctgggactacaggtgtgaaccacaacatctagctcatttcttgtggtttattgtacagatgggcgtcaccacgttgcccaggctggtctcgaactccttgagctcaagtgatccccctgcctcagcatcccaaagcactgggattacaggcctaagccaccgtgcccgggctctcaccacaattataaaaagagagagaatgaagggaagggtagaatttcctctttaaaagtggtctgactcaccaaaccatcttcactgcaaagccttaaacagtaccagaatacaggaaaaggatattgtatgcttttcttagagctgggacaaagaaatgagagggtgtggtggggggaaggagtaaacaatcagagcataagtaacccatattatacatggtttatatgatgccatctccaggtttaatctttcccttttattattttatgattattttaatggagatggggtcttgctatgttgaccacactggcctcaaagtcctggcctcctaaagtactgggattacaaggtataagccaccacgagcagcctaatctctcaattttagtttccttaccataaaacagacacaatgcttactatacaattaaaatatgctataaaatagtaagtgaaataactatactaaaaggcattcctggcattcagaaaagttgatggtagcatcctttccccctcaaagataggtacaggaggccctaatccaatagttctcagccagggatttttttttttttttttttttttttgagatggagtcttgctctattgcccaggctgtagtgttgccatctcggctcacagcaacctccacctcccgggttcaagcgattctcctgcctcaacttcccaagtagctgggactacaggcgtgtgcgaccatgcccagctaatttttctatttttagtagagacaggatttcgccatgttggccaggctggtctcgaactcccggcctcaaatgattcgcccacctcggcctcccaaagtgctgagattacaggtgtgaaccgctgctcccagccttggggattattttgaccttaccccaacccccaaaagggcacatataataaagtctggaaaaattttgttgtctcaactagggtgagggaaggtcctactggcatttagggggtagaggccagagacgccatcaggcattcttacagtgcacagaatagcttcccatgacaaataattattagtcccaaaaggttaatggtgcctctgttaagaaaacctgcctaaaaaacattcatttttggaaaaaccacataaacacagaagaggagcataacactctagttcctacagtctattaaaaaaaaaaactatttaaaagatattacaggctaagtgcagtggctcacacctataataccaacactttgggaggctgacacaggaggattacttaagcccaggagtcttcggctgtagtaagctatgatcacgccactgcaccccaacctgggtgatagagtgaaaccctatctctcaaaagaaaacatactctaagaacaatcctttcttgtgatagctattactcaaatgacaaaagctgggggaaataccttgtaaatatcagaaaaaaacttctcctcctaagtagtttaaaaatatgcagataggcgggcacagtggctcacacttgtaatcccaacacttttgggaggccaaggtgggcggatcacctgaggtcaaaagttcaagaccagcctgaccaacatggtgaaaccccatctctactagaaatacaaaattagccgggcatggtagttcatgcctgtaatcccagccacttggaaggctgaggcaagagaatcccttgaacccaggaggcagaggttgcagtgagccgagatggcaccactgtactccagcctgggcgacagaccgagattctgtctcaaaaaaacattaacaaagaatactccagatcatccagaaagtcagtatctgatagtgtttatatggagaactcctgcactggaatgtaaactcctaaccctagatccatctcttctcaggtcttcctatcacctcagcctacagcagtcaatccttccctctaaccactccctcctcctaagatttcagcatttaatgcctgtaccatgtatctaatacttagtacacaatgcctaattcttgttttttaatttttatttaaaatactaaaacgaaacagagacggggtctcgctatgatgcctattctggtctagaactcccgggctcaagggatcctcccaaggaactcggcccacaatgtctaattctaatgcttcctcttttacttgaaagtggaggggaaggctgggagcagtggctcacacctgaaatcccagctactcaggaggctgaggcaggagaatcgcttgaaccagggaggtggaggttgcactgagctgagatcacaccactgtacgccagcctgggtgacagagtgagactctatctccaaaaaaaaaaaaaaaaatcagtcacataaattactcattgaagacaggaaccaagttttcaattcttcttaagtgttttcatcattcctgatctaaccaccagagaagtgtttccttgccctttggtggcaaggttaatcttggtgataaatgatcctgaaaggctagtctccaaataattagaaccttgaaaatgtttatatttttctctgctcggaaaattctggaaccccttttctaggactgccacaaggacacttctgactatcctcaatgatgacacattttagtttccattcagattaccaattatggtaactcccctgatcactgtttaagtactacttattaaaggaacaaacattaagctattgctcttggaaggccagcctgctaggaaacacccaagagcaattctgtaccttatccttccctaaattagtcagccaatcttaccattcaaggatgaaattaaaggcatttatctcatctagtaataccatcagtaaaccatggaagcttaaataatctaacattgctttggacattatggaaatgacaacctcagcacctaataaaatgtaaaaccaaatatatacatatcatgtcaatgtcttgaatgtacaattaccttgaaaatttcaaagtcacctcacatttctcaactcttggacctgagacctgcttactatcaagttatcattgagaacaaattaagaattctcaattgagaggtcacctgttgcactaagcaaaccgcctgcaaatactaaattagcttttctacttacactatcaagtcaaattacttctggtaatgcttgagtgtatttgcatgagatcaatttcatatacagttgggcagaagcaaaatgagtcttaagcaagcttcattctgttttcatcttacaaagaaaagactggcctgtcctcccagccttttgaataaggatcttgaaaaattcactacgcacagggtgtgcccaaagaatacttgctggaaaaatatgctgggagagtgccaatttaaaaagaaaaacattttcgcccagttggaaatctagagaaagaatagttgtagcaattcagctaaaaactctcaagacctgaagaaaattttagaaaaaccccagatctttttgttattggagtaaaattctatgaaaggcaactaaatgaatcaatgaagtattcaactatgctaattttatgcacctaaaaagcagtaactgaaattctgcctttgacatttgacggtgcaaaaagcactaagtaccttatttgttctacataaatgaactttataatctgcaatagtttttaaatcaactgtttctgggaaataatgaaagcattttattttcctttttaaaaaagcaagaataacaaaacttctttattgttttgctttttgggaggaggggttgggggaattgggataaatttttgttttccattagagacttttttttttttttttgagacagtctcgctcagtcgcccagctggagtgcggtggcacgatcgatctcggctcactgcaacatctgcctcccaggttcaagtgattcttgcacctcagccttccaagtagctgggattacgggcatgtgtcaccatgcccagccaatttttgtattttttgttttgtttgtttttgagactgagtctcgctctatcgcccaggctggagtgcagtggagcaatctcagctcactgtaacctccaccacctgggttcaagtgattctcctgcctcagcgtcccgagtagctgggattacaggtgcccgccaccacacccggttcatttttgtatttttagtagagacgaggtttcaccatgttggcaaggctggtctcaaactcctgacctcaagcgatctgcctgccttggcctcacaaagtgctgggattacaggcataagccaccacacccggccaagagacttatttctgaagcataacactccagcaatagcttgattaagctaaaaagatacccatctgttacaggcctttgtcttcagtctctcactacaacacccacccctttccaggtccactcagaaccttacgctcagatttttttttcactgcaataagtgaacacaacaaaaaattacagttactacagggacacactggtcccaggttgcctcatgagaaaagcaggtgagtaggcctgctggagctttgcactaactctatggaccctgtggaaactgcatgcaatgcaggctacatggagggtcaccgggctgctcactatacctcagcaaagcaaaaggcctgcctatgcctatgacaacagcctttcccatcacagcctggtcccaccacaaaacaacaagcaatattcttccaaaaagtacagtcctaattttaaaagtgaggaactcgagcctaggtagacaaaatgtaacaattcttaacagttgtccagaattctttctactctcttactccccttttagtactaataccacaaatgctaagaaaaataacctctagttcatccttcaagttttctggtacttgccaaatcaataaaaataacatgtgaaatgttaatcacaaaccacctactcagacactgaaatgacacaaatacagactaagtagatgaaaaccaatcaggatagtcctcaactattctttcaatatcctttcaagttctatggtaactagatttaccagcaagagttttcttgaggaaaatactaaacacaaagcacatgcttacaattcacctgtaagcacaagttaagaataatggagaaagaacataaaataccttcataactcaaaagagctccttttccagcaactggggaaatagttgtttggggcttttccacataagatataaatcatccctttcgaatgtcaaaaatgtttaatttagccatttgatggggaaaaacctttaatagttcacttctctagagtgtttattacagtaaaggaaaactatttaaacttcccaccatccctcctggtcaatgctggtgtccacccacgtactgtgtggtcagagagctgtctaaaggagttacagcaaacagcaaagctatgtgccttcaggttgctccatttctcaaaatagaatcttttttctgccctctctctatcagttccaggagttatcttctattcagaagatagaacatgtatgaccacaagcaaattatttaacatatctatagtcttgggtctcaactgtaaaacagggtatcatcatcatatggaagatttaaagacaacaaacctaaaccacctaacatacagaaaggtgtgatcaataaatactaattcctttcttttcttccttttttaaaaaaaataacttcaaccacttcctagatgttagtctgccctagcaaaatgtccctcctctacccatccaactttttttaagacaaggtctcactctgctgctcacgctggagtgcggtggtgcaatctcgactcactgcaacctctacctcccaggctcaaagcaatcctcctacctcagcctcccgtgtaagctgggactataggcgcatgccaccacgcctggctacttttttttgtagagaaggggtttcgccatgttacccaggctgctctagaactcctgggctcaagagatctgcccgccttggcctccccaagtgctggaattacaggagagaggcatcacgcccatataacccatccaacttctactccacaaaagaaaatgagtaattttcttttactcatattgtaggcttaaggatgtatctggttaagatacatatggccattatacctttcctcaaaaaatacgtattaccaaattaatgtataatagtcttctgaatataaacataaatgccattattttacatgatggttggtagacctcttttcatcaaccaaatctaatgaacaatttgattctgtttacactaaaaaagctagtgcttatgcccaggagataggtaaagagcctagattattatcttgatctcttattagctgtttgacattaagttacttaaactttccattctgcagtttgagtctgtaaaattaaaattatctatctcattgtactgttggaggattacataaattaatttgtaaaaagctctttataactaaagagctaaaaacaattcaacaaatgtgggctattatttctctaccagaatgtctcaactctgttgtctgcttaggcaaagttggttaaaaacgttgttcccagcagggcacagtggctcacacctgtaatcccagcactttgggaggccgaggtgggctgatcacgaggtcagcagatcgagaccatcctggctaacatgatgaaaccccacctctactaaaaaaaaaaaaaaaaaaaaaaaaaaatacaaaaaattagccgggtgtggtggcagacgcctgcagtcccagctacttgggaggctgaggcaggagaatggcgtgaacctggaagttggagcttgcagtgagcccaggtcatgccactgcactccagcctgggcgacagagcgagactctgtctcaaaaaaaaaaaaaccttgtttcctagctcacccaaatcagttcggtcaaaatcctcctgggttctcaggtttaagactaattcagtcccaaaggccctaaactctgccaccctgtttcttcccaggatacatctcttgtaagtacctgagaaacaaaccggaaatagcaattaaagggagagcaaggaaatggcactacatatacaagggtattcaattccctggcacatgccctctattcttttaggcctaagtaaaacaacttataagaacatgattttaaatgaactatgacacctctctctagttgccattccccaatctccccatttcccccgcccccaaaacaattttctctacaattcctcttacctgagttctgaatataatctacatgattactacaatgctactaaataggctgctagagcaaaccacaacattcacaatttaatagcaaattttcagtatattctgcttgcagagcagaccctacaactttcatcaggcttaaaataatttcaaagcaattttgtctaccatggtacaagaaacctttcttcacacttatagaaatataaaatcaaacaggacacagttgccacaaagccttaactaatgagaatcaaaactggtaagatttattcttatgtttactatatactaaacccccttggtttcaaatctatataaactcaatgttttctttacattggatatgtaagcataattttcccagatgcacaatagaaaattggagaaagataattcactggtaaacatgaaagggcatgaccttaggcatgaatttctacccagcttgcaaaataatctagtccactttggtccatgtttagggaggtggggaaatgaattaaagtaccatccatttataacagaatgtggacccatgctttcccttttctagttaaaactatttgttttatcacactgacagagcctaatcgggggctctacaaaggacactccaggtatacccaacaaaggaaaatatttaaataaaaattaatgaatgcctacctcatctgctccttctccatcttgacatatccatccaatgtagttacccctgccaaacaaaaatctgggaatcacccatggcacctcttcccttttgctcaccacatgcaatcagccacaagccctcatcacccctacttccaataaccaattctcttaaatctttcctgccaaaggctgagtccaccattcagctaactggttagcctaaattcacctctattccccttctccacacaagcggggtctgaaaaatacaaatcatgtaagccatgtcaatggcttcacaataaaaattttaactttatataatcaacaaggccatctgtatgatctggcaactagctacctctctggtctcatttctcactacttgtaaaatacactatactttgctctgttctttgagagtcaagcaccttccatttccaggaccttagcatgtcttgtttcctcaatgagcagcaaagccccttctcacccaccaattccttcttatccttcaggtctcagcttacatgtcacttccttcagaagactcaccatcacatccccatcacatgctgcctagatatatccaatatgcaccctcagatcactctgaactttgttcctgtagcacccacaacaatcataaatatatcatctatgtaattacccgcttaaatattaatctctctctaatctatattccccatgagggcaagacaaggattgtatctttcttaaccactggatccctagcatcccagcatgtagcaggcattcaatgtagagttaatgaatgaattaatcaaatccaaactcctccaatgaaggttttcaggtctctacagagcaactcctcccccatttatagaagattatttggaagcttatttcctcactgttttttattttttcagacacagggtctcactttgtcgcccatgctggagtttagtggcacaatcatagcttacccaagccttgaactcctaggctcaacccatcttcctgtctcaacttcctgagagctgggattacaggctcaagctactgcacccagccatttcctcatttttaacacttgctggaacttgtaaggaatacagaaaccttcatttttaagactctagtaaagaacctggactctcatgagctcttaagattattttgcaaactgagtactgaaatgcttctggtaaccatctattgctgtagtcagccaggcttaaaacttcaatcacctatgatgatccctcccgtcattgcccccacacatcacagttattaagtcccattcaatttacctctacatcatttctggaattatctctttttcttctcacattacatttaccatctgtacctataatactatgtcttcaacatatcccattcccatggtgccaccaaagccctatacctttcaacttgtcttctctgtgtgccctgtgctttctgcctatactgacctctcagtaggtcacaatcaaaagaaaactgtctatcaaaatctttgccaaccttcaaggttcatttctaacatcactaagtgccaggcactgttctaaacattcatctttgtcttactaagttcttcactcccttcactctttaaacttcttgaggatacaaacttagcttattcatctgttatctcttgtgtcttacacatttacttactccataagtacttattatatgactttaacactaccataaaagagtacgttcacttcagagaacaaaaacaacaatcacaaggtggcagaaaacactatagcaactatatctacggtaaatgggtaacacccaaattcctgatgcctaagttcctttcttcagaatcccacaacaagcactaagaatgattttcactacctacgtttcttctcaggaaaaaaatgagaagagaatagaagaaaaaaacacaagttcctacttctgccacttgacgtcatgtgcagattaggagaaaagccaaggggcattaaatcaaaggtgttcaacaaatgaaagtttactcagctctgaagtaaattctgtaagaatacaatgaaattattcccacatttctatcccatacatcaagaaataagataatcactttaatggactatgaaaagtaaatcaaccaaagaaatgaatgaaggcattagaagaaccaaagctttaagtcacaagtcaagaaacctgttttgtttcaacttataccagtgctttgctgggttctttgcctcagcttcccccaatgcaaaaaaatggtgatgagaatagtttcattcatgttatttaaagataaacagtcacatttcaaagtagtttgagacctaaaggtcacgtagggtcagctccctcactttaattagaaaaatggttacattagtcctatagctagtttttagcagaagaagggtttagctgagaagacttgggtatcctggctgatgttcctcccaacccaccactttatgaaatgataaagagtagaaaaatgatagccgggtgtttggtgcatgcctgtagtcccagttactcctgaggctgaggcaggaagatcacttgaacctgggaagcagagactgcaatgagctgacatcacgccactgcactccagcctgagtgacagaacaagactctctctcaaatatatacatacatacaaacatacataaaaagtaaaaaatgacaaagcaatttgattgccactttggcaacatcatctgtgtattcttaataaattcaagtaagagttacttttttttatttttatttttacttatttatttgaaatggagtctcgctctgtcgcccaggctggagtgcagtggtgcgatctcggctcactgcaagctccacctcctgggttctggccattctcctgcctcagcctcccgagtagctgggactacaggggaccgccaccacgcccggctaattttttgaatttttagtagagacggcgtttcaccgtgttagccaggatggtctcaatctcctgaactcgtgatccacccacctcagcctcccaaagtgctgggattacaggtatttttattttttttttgagacacagtttcactctgccacccaggatggagtgcagagctgagatttcagctcactgcaactcctgcctcctgggttcaagtgattctcgtgcttcaacctcccaagtagctgggattaaaggcgtgcaccaccacgcctggctaatttttgaatttttggtagagacggggtttcaccatgttggccaggctggtctccaactcctgacctcaagtgatccacccaccttggcctcccaaagtgctgggattacagacatgagccaccaagccagaccaaaagcaacaatatagaacattccaaagtatctaaaaagcaaaacctataaacacactagtaattcattttaccatgaggtcttcataaactccaagaggataaaattccccaggaggggctaggcacagtggctctcgcctgtaatcccagcacttcggtaggccaaggtgggtggattacctgaggtcgggagttctgagaccagcctgggccacatggtgaaaccccgtctctactaaaaatacaaaaattagccaggcatggtggtgggcgcctgtaatcccagcttactcaggaggctgaggcagaagaattgcttgagcctgggaggtggagattgcagtgagccgagatcatgccactgtaactctagcctgggcgacagagtgagactctgtctcaaaaaaaaaaaaaaagggctgggcacagtgacttacacctgtaatcccagcactgtgggaggccaaggcgggtagatcacctgaggtcaggagttcgagaccagcctgagcaacatggcaaaaccctgcctctactaaaagtacaaaaattagccgggcgtggtgacaggcacctgtaattccagctactcagaaggctgaggcagcagaatcacttgaacccgggagccagaggttgcagtgagccaagatcgcgccactgcactccagcctgggcaacaagagcaacattcggtctccaaaaaaaaaaaaaattcctgagggtgagaaaactcactgcaatcaagaccatccaaaattcaaataagcgctttagtgtcactgaactgcatccatagtctatttttacccaaccctgatctgaaacagacttcaggagactattagacaaaacacaggttagcataaattcaaccagaaataaaaacatgaaaatagggaaacaaaatgaagctattaaaaaggtacaagcttagctctaaatttccagatgtcaataggaaaaaagaaacctagtgaacaattacagcacccaggtaataaaaacagactaaaagcttagacaaacatacaattattcttggctgcacatctttctccctgaggtctttataaagaaggcattgcagaatacagagaatatcctcaacaatatttcagtaatcacaatgaaatgttttatgaggttatttttatactgaacttcaagataagcctagagtaacggttgggagaaaaaaaagaaaaaaaaaatttcggggacagagagaaaaaaagaaaggaaaaaaaaaaaaacttaggagagagagacctacataatgtggtccaggtacccagaacactgctgatttaagagcacaattaagagaatttctggaaaaaaaatattattttaacaagtagttactatatagaagtttataagcacaggacccagaaaatgaaaagcaaatttagcaaaatgtggaatgggtccaggaattaaacaaaattgcagggaaaaaaaaacaactctaagagggaaaaacaaagaatataaaagaaagaagagcaagcacaactcagcaagtacattacatacatatgataattaaatgcttttatttctacatctacaattaagaattaaacattaagatatttacggaagcatgcagcttccttcttaatcccataatcaaggagataaaatttaaattcctgtaccttccacagtgatgaaatatcattgtttagtgacatcatatcaaacacaacgtactgcagaattttcaaagcagttatatttccactgtaccaagaaaggaagatatgtgaaatatttcatgaaaattttccaagaagagtttaaaacaaaaagggtaagagtttttaaaccagacataaaatcagtcaaccataaaaattaatttaaaaaactctctctaaagtctcatttagcaatatagtttactgtcaagcataatacaatgataaacatacaatttgctaaacattcaacaacatagaaaaattaatcattctatagctagcatgtaccaacgacacagaatggatcactgtttctcctctgggaggtgggaaagaaaaaaacaattgaattcttagtgaagaaagggattataatttccacagaactatccacttgtaatttaagcaacatcatttaaaaacagctcattccaacagtctcctctactaaatattttcatcagggctgcctagacgaaacctagcccaccactctatcttgggcaaaagagtaaaatacagaccagctactggaagggtggggggagccaaaattcaccagctgggtcaagttcctgaagaattaactaactacattctaggattcatttctcagcatcaaagaacaactttttcttcttctttttaaattaaagcaatgcctccattctcattgtctggtcaactgctgaaaacctttaaaacactcagaagatcaacaaacacttggctaaataaataccagccttaagagtcaacccggtgatcttgctcaacaagaactttaaagtatttatgctttactggtggttttagtttaaatacaatttttttttttttttgagacggagtttcgctcgttgcctaggctggagggcaatggtgcgatctcagctcaccgcaacctccgcctctcacgttcaagcgattctcctgcctcagcctccagagcagctggatgtagaggcgtgtgccaccacgcccaactaattttgtatttttagtagagacggggtttctccatgttggtcaaactggtctcgaactctcaacctcaagtgatccgcccgcctcagcctcccaaagtgctgggtgggattacaggagtgagccaccgtgcccggccctaaatacaattacaatgtgcaaaaagagcatgtacttcagagtactttcagtacccaaatatgatctaacgcatgaaaattcaactttttaaagtatcagttgatttaattgcaagaggattcaactgatcccaaaatgtttcctaaaagccatcctttggctgttcttatacacttcacacccttccaaaccataaaccattatgtgagaagaatgctcagaactaagtagtgaatgaatggccttaaggtttttccaagtcattaaactatcctacagaataagaaaaattctcaggtacttttatttcattggtttgtaacgcttacctacaacagtaccaaaactcagaaatgttttcaatgcaacgtatcctgaaaacaatacgcttatagtgtctaggtgcttttctgttactcaaaataagtgcatgcaatttaaaatcctttaactacagtgtttattatacctctaagcacaaaatatttaacgttaaccaagatatttttaaagcggtgatttaaacagcaaagttagtggggataatgccatgaatattagcaagctgaattaagctactaatccatttaaagaaagatgggttacggaagaagcaagcctctgaagcatttgctttaaatctaaatacagaagtggacttgagcacagtgaactaacaaatgataatagaactaggtctacaaggaagaaattcagcaaaaattatccatttcttccttcaaaatagaaaaaaaaagtttcatttcagatacaatatccatgcagataatataaacaaaattgggaaaccagaaaatttacttttaaaaatcatagctgtctcaacaaccaaacactccagtgaaaatcttcatcaccttttaatacagtcaaggaaacaccaattcttcccacatattcatctttttcagccttctctagtaagccagcctctagcaaagagaaaatgaaagatctgctagtcaattatcctgcccctcttttccaactcctcatgctctctctcaaatctgatattcctaaggagataaatgcacttatttaacatgtatctttaagtatgttataatatagtactgctttatttaattaagtacatagatgctgaattgggagtgacaggaatgaaacgtctctgtctccaccatgccaatttggagtgccacccataaaaagcttatgtaaaattttctcaaaccaacagatttagaaaaaccagtaagatgaggtgggcggatcacgaggtcaggagtttgaggccagcctggtcgacacggtgaaactcagtctctacttaagaaaagaaaaaagaaaaaaattagcctgacttggtggcgggtacctgtaatcccagctacttagggaggctgaggcccgagaatcacctgaacccaggagccagaggcttcagtgagctgagatcgcactactgcactcctgcactccagcctgggcgacagagcggaactgtctcaaaacaaaacaaaacaaaaaacaacaaaaaaaacaacccagtaagaatttattccaaatacatcaatacatttaactcagcttaacaaatctgcttaaaatgggcttttttttttttttaataggaagagagtcaggttgtgaaactagactgtgcttggaggcgatgtattaaatattctgaagcattttctaattgtcagtccttaaaatgtaagaaaatctcaagtgttaaaattgaagactgggtgtgctctctgctgaaagttcaatcaaaagcaactgtaatttcctacaaaggtaactaggtcaactcagcatttgtccctgcttactggaaacaacaaaatctcaacaatcaggccattaacttatcatgtcctatatatagtttcaaaagaaatctaaattcactcttaaagaggtactagtacaattttacacataagatgtctcctagttatttttcttagacttcaaaaggaaattaccaccatttagactacaacaatacaaccctacagcaaaagtatcttccccttcttcactagcatgtatatgcactcatctacccaacatcagggaaaaaacaaacagaacctagacacctatgtacaaagaatcacattctctccataatggcgattcattcattcttccttgtgccaacatttctcaagaatgctatcatgcatgaggtctactcacaggggtacatgacgctgctcgggatcagctctggtcagttcttcctcttcaatatcagactcccctcctgaactactgtcagtgacatctgaatcaaatgcctgttcactgcacctcaagttggctatgccactagctgtaaatctctccaattcttctgaaattgaattgcttttcagaaagttgctaagtccctctgaagtggtggtctcactggcagcttttctcaaggcagcttcagcctttcgagtcagcatcaactggctccgtggtctcaaggattccaagtttggcagtttgctcaaagtcttctccaaaaatccacccagctgatgttgtatatgcctctcaacctgcttggcttgcacaacctgtaagcgcttttgtaatctgcgggcacggctctcaatgtcagcctgtcgccgcagtaaagctgttatccttgtgtcagaatctaaagcactgaaaagaatggaagacaggggagactttttaccctccaatttgacaccccccaagttagagctggagtctgtaccaggtgataatctactgcttccttgaagtgccggctgttccatggaattgacagaggatttgtttgcagtgctattattgctatacaaagttgtgtgttctacatcaaggcttctatgtggaagagtgcaattggtcataccccccttcaagtccccagattcagatcctcccatttcacccccatgaagagcagatgaagtgagagcccgttttcccccattgagggaagtggaattgtcatgatcagaatgtgttgaacttttagtcaatttcttagccaacccatttacaggtgcttgtggcagagctgtctgaccactcgtattcatggttctaagattttctaaggaaaactccaaaactggctgtctccccaacagctcagctcggagttcataggactgagataagagaggatgagatttaaggactgtctgcttgctgaagaccccttgcaacttcaaagactcctttgagggaacagatgttacatcagagcagagataagatgccaccagtggttgcagctttcccaagtcttccttggtaggattatttcggaaatctaggctgggatcctctgcagcaatggcttttcttttggttccgttggcagcaataaggatgttggcgttgccgttattttcggcactgccaggggacaaggtagaggatgggggagccagtttgaaccggatatggtgtgcttcagctgctgcgtcagtgagagcgggcgccatcgcagccattcagcacagagagacaggaagtccagcctctcccgatgccgaggccgaggccagctccacggccccttactgcctccccagagaacagactagaagagaaaggagaaaagaatattagaaatacaagcacttttaaaaacatgtatatttttaacaaaagcactacttgaggctgttgtctaaactgcctccagaaagaaaacactctggagctaactgtaccacagttattctagagacccaaatatctttcatctgggagaaagggggaggcaaaatccctgcacaagggaaggaagaattgcacccttcttgtcatttgttaccacagattgaaaggtgccaaaacacaagttcgattcagagaaaatcacagattgttaaaattaaatcatctccattaaaaaaaaatctctttaagcttgttgaaataaatggatttaaagcaagacacatcaaactaagcaataattaaacagaaaaaaattagtaaggaattcccgtgttcactaaaaaaagtatgccaaatatcacaggtctgtgcatttttctggccagggaatccagttttcatcagcttctcacttctctagaagtatagattatactacaaagctaactgtaccacatctgtaataccaacttgtttcatcagttttcttttctttcagatcaaagtggtcatcaatatcttctctactggcttcttcctctcagcctaggaatttactcaagtatcttctgccctcagtacagcctctctctcatacttaattgcccaaatatctctctttccctttaccccaaaacttctctaagaatagtataaataactgtctctgcactcttcactcttccataatctggatttcaccccctactgctctggcaaaggtgaccagtaatcttattatcaaatccaatggtcaaacctcagtccccattctatctgacttctctgaagcactggacaataccgaccttcttctaattctttcctgatgtccttgtactatcatcctcttctcttcctcctggacccttaaatgctggtgctgcacaaggtcccttctgccctcttctctctcaacaaccactagtatggtgaggtttcttaaccataagaaaaacttctgagctgcactaatcaagattcctataacctctatgttcctcaagccccctgaagctcagaattcactttctccttccagcacactattccgcatcctgtttcattaccttaagtaatgacactgcttttatttagtaaccaagctaaaaatctcagtcatttgcctctgtttgatcccccttgatctatgtggtctgggagccaaaggaaacatacgtaaagaactaagccagttgttctttaaagtgtggtctctggacttctggggatctcacaggctattttggaggttcgtgaaatcaaaggtattttcatagcaatactagaatattatctgccttttacactgtgttgacatttgcaatcagagtacaaaaacaaaggtgaacaaaactgctggtacattattagcacaaatcaaggaagaggcaccaaactatactaatagtcattatactctccactcagtttttctttttttaagggagttccacttaagatgtccttgatgaacagcaaaaattatgaattatcttgagcctttagtgcattttttaaaaatattctttgtgatgaaagggaaagtatgcataaagcactctgctgctttatgaattctcaggaaaaagcacagtacaactgagttgcaaaatgaactagagctttgttcatggaacacgatttttacttggcagaactactgacaaacattatttgaaacctgcttcactagcagacatttccttgcaaatgaacaaagtgaacctgtcacttcaaggaagaccactgacgatatttgctgccaataataaaatctgaattttttaggcaaagattagtgtttttgaaaacttgtatcaacaatcatgaacttaaacattttcccaatattttatttggtgggtgtggatgtgtgtgtgtgtgtttaacagagtcttgctctgtcgccacgctggagtgcagtggtatgatctcagctcactgtaacctctgcctcctgggttcaagtgattctcctgcctcagcctcccgtgtagctgggactacaggcacgtgccaccacgcctggctaatttttgtatttttagtagagacagggtttcaccatgttggccaggatggtcacaatctcctgacctcatgatccgcccacctcggccttccaaagtgctgggattacaggcctaagctgccacattcggactttctgaatattttaaaagccatttctgatttaacagacttgtgacgatattaatgaacgtgaatttttgattgcatataatgtaatgtgtaacatttggaagatctgcataacccagtgaacgataaaatgtccagtgaatgtcaggaaatcatgcatgggtaaaaagtttaagtgcaagacaaatcatttatttgttgctgttattttgaaacagggtctagctctgtcacccaagctagagtgcagcggcacaatcatggctcactgaagcctcaacctcctgggctcaagtgatcctcctgcatcagcctcctagtagctgggactataggtgtgtgccaccatgcccggctaattttttgaatttttgtagagatggaatttcattttgttgcccaggctgctatcaaactcccagcttcagccttccaaactcctgggattataggcataagccgccatgcccagcctgaattacttattaaatattttttaaatttctcaaagtttataagaaaaacaatttatttgctgttctcaacaaattttaagagttaaaaaagggtcctgagaccaaaatgcttgtgaaatcactggactaagcacccccctccctgccccaaatgagggcaatctccaatttaatcaaaaatgcttatctttggagcaataccaacacaggatggtaggccctacaggaccacagtaagcttctttatagtatgacaatttgaatcattaacataaaaatactcaaataaatgactgagaaaacattattcataaaagcaccaatatacatatgggtcgaatctgtcttattgctgtgtgtgtgtgtgtgtgtgtgtgtgtgtgtgtgtgtgtgtgtgtgtgtgtgtttctgagatgtagtctcgctctgtcgcccaggctggagtgcagtggcgtgatctcggctcactgcaacctccgcctcctgtgttggagtgattctcctgcttcagcctcccgagtagctgggacttcaggcatgtgtcaccatgcccagataatttttgtatttttaatggagatggagtttcaccacgttggccaagctggtctcaaactcctgacctcaggtgatccgcttgcctcagcatcccaaagtgctaggattacaggtgtgatccactgtgcctggcctcatataattattaacaccaaaagtttcttgttccagggttgtattttaaccaacactctttatgaactagattttcagggcttatgtagttttctcctgtgggctttctggcatatggcattctgtgtggcacaaattattctatgttgtcttttcccatttctaactttaaatataatactaattactaatatattattaaacattgtgttacagaccagttgacagtactaattcctgttattaaacattgtgttatagaccagttgacagctggaccaatatagttgttaaaaatattttgagtcacttttataatatgcaaagggtttttcccatggacaaacgaaaatcactaccagataattcccatcaattcaatctcctccccttttgaatgtcaatatgtagttgatatgagcaatgcaaggaggcatattatcagtgccagatgattaatacaacatgtgaagagtaattgtaccctactgcctgacagcactacagtaagacttagcaagggcaggaaacagcttccctctgaggacccaagcaagggcacaaatatgctttatgacttacataaaacttaggaaaacccaggctcactccagcacaaatgaaaaagagggtcataattaacatcacatcacagaaggtgcttaagtagtaaacttctcaaagttattctgagattattcaattctttaaagcttacaactttaagaaaaaatgccggcttaaatcccatctactccagctgggcacagtggctcacgcctgtaatcccagcattttgggaggccgaggcaggcgtatcacctgaggtcaggagttcaagaccagcctggtcaacatggtgaaaccctgtctctactaaaaatacaaaaatcagctgagtgtggcggcgagcgcctgtaatcccagctacctgggaggctgagacatgagaatcacctgaacccaggcagcagaggttgcaattagccaagattgcaccactgcactccagccggggcaacaagagcaagactccatcttaaaaaaaaaaaaaaaaatcccatctactccaagacttctctgaaatgatgtctatgaacttgacattaacatatacacttcaaagacaatagtttatttgatttgcactttatccttggtctcaatatccccataggatacacagcatagtgtagttactaaaacaatcatctaagtaagggggtgggggaggagagagagtgcagagaacaggaaaaagtgaccactttttccgaaaaaattcccattcctaattcctaaatcttgagatttctataccaaagaaataccatttattgacttgacatacctttattgactcgaaatactatgctaagattcaacattactcccaaagatattcataagtaagaggagcactgactcaagtgagcaaatctcagttcccatcctggctccacctcctgtaggttacttaactattctgttctttaagtctcctcatctacaagtaacagagccttcccgacaaggatgctatgatgatgaaataagatactttcaattacttggccacgtacctggagcaaccacccagtattatttgcacttttattacactggaaacaaaaaggaaacatagaaggaatgaatttccatggctttttaatgcacctagtttgcaattagctacaattgccataaaccaccacctaagtttagtactttaatcttttccctgttatgtctagacttacttttaatatttcatgatgttgtttataataaaaagaaaactgaatgccaaaaactcggttaaattattaaatatccatacaatggaatactgtgcaaccctaagtgtggcagagctatatttactaacatagaaaagtgcttgcttcattattaaatgaaaaaaagttacaaaacaaaacacagtatcatctcaattttgctttaaaaagtcattggttaagattcttttgtcttttgtttcttggcttatgtaaagtctccaccataaacatgtattacttctataataaaatggagagaaacaaaaagaaaacaatggaaattcttaaagagccaataactaagtaaaacaaaatcacagtaacattctttttttttttttaagagatggagtctcgctctgtcacccaggctggagagcagtggcgtgatctaagctcactgcaagctccacctcccgggttcacgccattctcctgcctcagcctccccagtagctggaactacaggcgtccgccaccacgcccagctagttttttgtatttttagtagagacagggtttcaccatgttagccaggatggtctccatctcctgacctcgtgatctgcccaccttggcctcccaaagtgctgggattacaggcatgagccaccacgcccggcccatagtaacattcttaaatttaatatacagagcaaaacaatgattcctatcccacttgacccctacaaaattcaaaaagcttcaatctttgacaatgtaaagcagggaaagactgtcaaatttaagcagttcttagagaagctcagggctaaaggaaaaaaaaacgaaaaacaaaaaaaggaagcagttctacacaaacagcacaacagcctatctgataaatcatctttctccaaagaatacaaagccttaaaagctataattaactgattaatcctcataacaacctgggcagtagaattagggctgagattataatttctaatttaccggtggggataaagtcagactgtacattcagaataaaaattcaagccccaaatatcccaatttttagttcattcagttagtaaactataatctgacaaatacagatggagctgctacacctgctgtcactcacacaaattgagattctgcagtaagcttgtacagataaaagaaaaggctacctattcaaggtcatttagctataaaaggttgggctagataatcaatagtttctctctcagtttcaaagaagtattttagggtctggaagatgttaaatgcactcagcaagcaaatacatttcggaaaaacttcccagatggagactcacaacgtattgcatcatactgaatatgcaaatgtttacctttaccaaacttttttaacaagcacctttttccattacatctattaatatcaagcagaaacatcattgtgagaaatacaagttgggataaagttcaaatatgtgacctctagggtcccttcctatgttaattctattattctaaattgcaccatcggtccaaggacaaacttctacctaacacaagtggcacttgggaagcaaaaatatacttctaggatagagtttctcaacctaaccactaactgacatctcacgatgagtaatctatcacagggggctatcctggcagtagcatgtttagcaacatctctgttttccacccactagatgctagtagtgcccttctgaaaattatgacaatcaaaaatgtctccagacatgtcaaatatgggagctggggggttcaacatcacacctcccaacagagaaccatatcctaaagattatacacacacatatatatactctttcaaaagcaaaacgtatccagctgcttcaaatactgtaagtcagaactaactccacacccacaaatgaaaacctcatttattcccagtcaatttccaagacaagactccagatacacaagaataacctggaagcatccaccttgcaaaaatatttagctgcagagaacaaaggggaaggaataggtcatccaggtggccaacaagtattacaaccacacttgcactgaaagcaaaagcaaaaatcagatggggaagaaaagtttgcccataatgtggcttctactaacctcttccttcaccattacctcatttctctacacaaaggacggaaagaaacagcaggaaggatgattagggaagtgtccatgaagttgccgcaattttagctgagacttgaaaattagctaaaatgtcattatgcaaaaggctaggacaagagaatggtaatgtggcattctagtgagaggaaatggcataagaaaaggcaacgctgtgtgggaaaaggcgacattctgaaggttaaaagaaatgaacaatttgggccgggcgcagtgactcatgcctataatcccaggactttgggaggctgaggcgggtagatcacctgagatcaggagaccagcctggccaacatggcgaaaccccatctctactaaaattaccaaaaattagccgggtgtggaggcgcgcacctgtactcccagctacttggaagactgagacaggataattgcttgaacccaggaggcagaggttgcagtgagctgagatcgggccactgcactccagcttgggtaacaagagcgagactccatcttaaaaaaaaaaaaaaattaacaatttgcttaaaacacaaagcatattttaatagaggaaatagtagaatgaaggtggaaaggcagtttgaagccagatccttaacggacagcctttaatagccttaattcagacttaaagacagtagaggggccaggcacagtggctcacgcctgcaatccccgcactttgggaggctgaggcgggtggatcacctgaggtcaggagtttgaaaccagcctggccaacgtggtgaaaacccgcctctaataaaaatacaaaaaaatcagctgggtgtggtggcgggcacctgtaatcccagctgctcgggaagctgtggtaggagaatcgctgaaacctgagcggcagaggttgcagtgagccgagatcgcaccattgcactccagcctgggtgacaaaagtgagactccatctcaaaaaaagaaataaataataaaaataaaaataaaaaatttagccgggcatgatggcaggtgcctgtagtcccagctactagggaggctgaggcatgagaatcacttgaacccaggaggcagaggctgcaatgagctaagattgagccactgcatttcagccagggcgacaaagagaggctctgtctcaaaaacaaaaacaaacaaacaaagacagcagaggccaggtgcagcggctcagacatgtaatcccagcactctgggaggccaaggcaaaaggattgcttgaggccaggagtttgagaccagcctggtcaacatagcgagatcgagtctctgaaaaataaaaagtatatacatatatatatacacacacatatatatgtatatgtatatataaaataatgacagcagagtatcattaaacactttttaaatgggagtgaaacatcagactgtgctttagagagatcagttgggtaggatggattgaaagtaagtaaaaaggcatctatagatggcaaagaccaataaaaaagctaccacaataatccagataggatgcaatgagaacttcaaccagaaaataatagtcaaagtctctaccaaagcttaaatccagaaatgtgaaggggccagtctaacaaaaaggccaaatatatgacaaacaaaaacatgatggcttataaagaatggaaagaaagctctcttttccttcataatttcatctcctttgtgacgaaatccttcttttctcacgaagcttttcaggtttggtatgtcctctctatacttctaacactatcagtctagcccaggtcctcatcagctcctgtctagattatcacaacagcttcctgactagtgcctcagtgccccaaactatcctttacctttttatcatctcactttcctactctgaacaagttcctcacactttttttttttttgagacaaagtctcgctcttgtcccccaggctggagtgcgatggcgcgatctccgctcactgcaacctccgcctcccaggttcaaacgattctcctaccacaacctcccgagcagctgggattaccggtgcctgccaccacagccagctaatttttttgtaattttagtagagatggggtttcaccacgttggccaggctggtttcgaactcctgacctcaggtgatcgacccgcctcggcctcccaaagtgctggaattacaggcatgagccaccacacccagcccctcacacctttttaatgagttcaaattcttcaagatgaaacttaacgtcagggcaagcacatcaattgatacggacccagaactccccacagattcccaactccgtatctttgcctatgttgctacctctacctggaaggtccttcttctactttttttttttgtccccaaacttactaatttttcaatacatagcatctccacaaaaacttcttagactcttccaattcatatcactttcttcctgcttgaattgtataatgcacttaaagtcactgtcattcagttcaaattatctgaattttccctaattgttaactaattctatttccaagacaagcaaaattccttaacagcacccttctttagcgtgctaactttatcgagagcttggtacatagtaagtgctgtaagccctaaatgactggactagagaagtcaaaaaggcctcgtgggggttgccctcaagtgtaagattttactaagaagagaaaaaggaggaaacacgaatcaaaaaattgacacaatcaaaataatgggaaagacgtggggcatgatccacaaaacaacttgcatgaatcaggtggtatatgtacagcttctcaagagaaagagaggaaaagaacagtgatttgtgatgaagtactgcaagctacattatggaatgcactgcaaagtatttattttacatatgaacaaaagtagatttgttgtggaatacaatggggaaggagagacaaaatttttactataaaacaaagagataatgtgtgtcacccacaagaccattatcaatttccttggccaacagggcttcttaactgaaaaagctttatattactaaaggaatcattcctgagtgcaggataggttattacaaatgttgttcactaacattaattagcgttttactatgtcaatcactatgctaagtatcttacatatattctcttaatcttcacaataacaatgtaaggtaagtactactgtcctcattttatagatgctcaaagaagttaagtaatttgcccatgatcacacaactatgaagttgcaggggcaggatccataatgctaaagccgatgcttttaactactacactagatagtttaaggcttaaactgaaacggtcttaactgcctgacagtaaattctgaattttagtctttagaggaaagtcagtcaaagaacaccaactacctactgagtatctccaataaatattaaaatgcctagagtattcaaagcaccacagtaagtacatacaaggatgacaagcagcagtaaagagagacactactgtgtgatttgggggatggaggcaatcctcatacaggctgagaagtaggcggagtcagaaaatgcttttcagaaaaaagaacatccaggctgaaacctaaagaatgagtaggagctgggtgcagtggcaggcgcctgtatttccagttactcaggaggcaggaggatggcttcaggcaaggagttcaaggccagcctaggcaacatagcccccatctaaaaaagccacccaaacaaaaacactaattttttttttttaaatgatggcctaccatggtagctcacacttataagcccagcaccttgggaggccaaggcaggaggatcgcctgagcccaggaggagtttgagactagcctagacaacacactgagacccagtctctaaaaaaataataattagctgggcatagtgggagggtcacttgagcctggcgggtggaggtcgcagtgagctgttatcacgccactgcactccagcctgggttacagagcaagattctgtctcaaaagaaggaaaagaggagaggggaggagagaggagagaggagagaggagacaggggagaggggagaggaggtgagagaagaaaaggagggaaagaaggaaggagggagggaaggaagggaaggagtagggccgggagaggtggctcacgcctgtaattccagcactttgggaggccaaggcaggaagatcacttgaggtcaggagtttgagaccagcctggccaacacagcgaaaccccgtctttgcctgtaatcccagctattcagaaggctgaggtacaagaatcacctgaatctgggaggcagcggctgcagtgagctgagatggcaccactgcactccagcgtaggcgacagaatgagactgtctccaaaaaaacaaaaagaaagaaatgagtagaattcagcattgcctatacaactacttcaagcatcccatattcaaaacccattccctgccccaacaccaaatccaaaacttcctcctgctcctcaacattgtctatttgagttaatcatgacctcaaatcaccaacttactttttaccataaatatttaatttaaacatctactaaatgccagatacaagatagtaaaatataaattaggtgtgaaggtagcctagcttgataaagtactgtatttcacctgaaggggtcaaggaaggcttctagaaaagatgacatactgactgaattttgaaaggtgaggtggtgcacagagggtgagggttggcaacacacagaatgacaggcacattcattccatccttggtgccaatgccctagtgcagaacctcattatgtactatagtaattcaggcagtaataatctcccaactattcttccttcttcctgtctcagcaagcctctaatctagcgtccactaccaaaatgattattagaaagggaagaaaaaaggaaaggagggggtaaacctaaatctaaccatttaaaatctttcactgactctagagtaaggatgagtccaaattccccacacaccattatctgtcccctttttacattagacctcatctccagcctgtcctcactgcagccacctgaaacatatgtttcctggctcttctatgcccctgcacctttactcatgctactctttcacggttcagctcaaggttacatgctctttcaagtattccccattactcccaggttgaggtggggtccctccctctaggctcttacctgcacccccatgacaccctggctattgctcatggtacaatataaactcacaattttgtcttgtctctttcttccccagagtatgtacttttttttttttttttttttgaaacagagcctctcattgtcacccgggctggagtgcagcggcacaatattggctcactgcaacctccacctcctgagttcaagcgtttctcctgcctcagcctcctgagtagctgggattacaggcacccgccaccacatctagctaattttttgtcttttttagtagagacagggttccaccatgttggcctggcctgacctcgtgattcgccagcctcggcctcccaaagtgctgagattacaggcatgagccgccacgcctggccaactatgtacttcttaaaaaaggagggttatagcttgttttatctctgtcccctacaagcagcacaatgcctggcagacagcagaccaacacacgttaagcaacctgagcattctatgctaaacccatcagatgaagatccattaggacgttaatggggatgtctgaagtgatcaaccacctaacaagaagaggcatcaactgaacctaggataggcttcacccactacaagttccagttatttacttgaccaagcacctgtacccagactaggaaactttttaactacactttttaagctattattaaatgtggttacacagcattataaaggtaatagccatcaaaatcacaaatgtaattgctcaaacttttacccagcaactgcacttctagaaatctattcaacagaaatattctcataggtactcaaagatgtatacacaatgctttcactgaagaactggaatacaaaaaaaaaaccctaattaaaaagatcaagccatataacaagtatgatcccattaaacatatatatatacacatatatatacacacacatatatacacacacacacacacacacacacacacacacacacacacacggataggctaggccccatggctcatgcctgtaataccagctactctagaagtcaaggtgggaggactgcttgagcccaggaattcaagaccagcctagacaacatagcaagataccatctcaagaaaacttttttttctgaaggatgtctatatatcaaactattaatggtgttaatcctacttctatgctagcactgaattcaaatttcctaccactctttagctgacaaaagacagaggaaaaaaaaatcatactttttatcatatctctttccaacaagccctaatggttggtgtaagtgctcctgaacaatcctaaaatcagcgacttctggaagattttaagaattctaaaggaggccgggcgcggtggctcatgcctgtaataccagcactttgggaggccgagacgggtggatcacaaggtcaggagatcgagaccatcctggctaacacagtgaaaccccgtctctactaaaatgcaaaaaaaaaaaaaaattagctgagcatgatggcgggcacctgtagttccagctactcgggaggctgaggcaggagaatggcatgaacccaggaggcagagcttgcagtgagctgagatcccgccactgcacctccagcctggggcacagagcgagactgtgtctcaaaaaaaaaaaaaaagaattctaaaggaaacaggttattctgggagggtccatggccaaattcctgagttcccactgaaacctaccttatacctttagagaaaagtcaattaatgacttttaaaagtacatttttccaatgccaataaaatgttaagtcaatactaatatccatttttcattctcttgggaggcaaggggtaaggagtaaatcactaagtgcaaaaaaatacagtccaattttttggagacatgcttaaggtcttcaaagagcttcagttctccatggtaacatatggagagtttaatgaaactttcctgacagttcaacttatcagactggtatttcttttttcttttttttgagacgaagtctctctctgtcgcccaggctggagtgcagtggtgcgatctcggctcactacaacctccgcctccaggttcaagcaattctcctgcctcagcctcttgagtagctgggactacaggcatgcgccaccatgtccagctaatttttgctgtttttttttttagtagagacagggtttcaccatgttaagccaggctggtctcaaactcctgacctcaggtgatccgcctcggcctcccaaggtgctgggattacaggcatgagccaccacacccagcccaggctggtatttctatgaagtgtctctcctatactagaaaccagaaactagctacagtacttagctttgagcctctttcccttcacaccctctggtggaggtgctaacaaacagtcacaaaggccaaataacaagcagcaagaggaaagtctagatatgagttcttagcaatttttggtttaacatcctaacaacaaaattgttattcctcttttttattccctaatacttaccttccaactgaatttaaccaagtctaaccttaagctctcccctttttaaaaaggaattaaaaggtgagggactccattaagtttgatgtcactcaagcaactttttccaaataagagcagaatctgctgtaattaaaattcagagtaagatctcattttggattcctggttcaggttacaagaaccagagtttttaaaataacatttagataaaactgcactcaatctacctccactttgcatttcctgaccctcaaaatcttggaaagaaactttaattctaaaaaaattacagccaggaaaaaaaagggtaagttcacagtcagcaacaataaaatacacagctaaataatttcctggtagagggctttcaaatgttaacactgtggaagcagcttaaaatcttggaaaagcaaggcttgcagaaagtaacatttattaaacaactattttgccgcattgtgctactaaatggggaaggtctactctatttaaaaggtctcttccaccttaaagggactctttgcataaaggtttaaaatcttcatataaaatgtttgatttttttctttcagactgcccaaactcatttgtttttgattcataaacatgagctgtgttttctactttggtcaagtcagtttccgcactctattttagctttacctttattctaccaaagacaagaaaatgcttaataaaaaaaaatatatattgcagctctttttggagtccaagtattttggtaaatcacaccttttggcttattttctcctatgtattttgttctacatcctaaaaggcacatggcttaaaaaagaaacaaataataatagttaccccctgccatactagtcatctcctatgacccacaatcctcccctcaatctgcaagtgacacccaaggatatcacttacctcctatatcttctgatagccttcaaacgctggtgaactctagtacagtggatatttgtcttttctaattcatactgtcttctacagccatagtgtggttcaactgagttttgatctcacatttcagggaatgggaagtactgatgagggaaacttatcttgtcatataaactattgttctgcacaacttttagtatgcccagaggtatatacgcaacttatcagcatagaaactgtaatttaaacatacatcttcagaagcaacatgagaactaaaaaagtcttaaaacagacttccaagaaacagttatgaagtccaattttaggaaaaagacatgatccaagtgttctttgcactgacacagtaggcaagccaggtgtctggggccattttacttaagaacctgccctgtactcctttcttaaggtaagtaagtaaagaggcactaaggtaaaatacgcttcccaagacatagactaatcaaatcactcaaggcaggaacatttaaaatgaagaaagagtacaacgaaagctgctttaaaactctaaataagacaagcaaggggccaggcccggtggctcacgcttataatcctagcactttgggaggctgaggtgggtggatcacctgaggtccggagttcaacaccagcctggccaacatggcaaaaccccatctatactaaaaatagaaaaaaattagccaggcgtggtggtgggcacctgtaatgccagctacgcaggaggctgaggtaggagaatcgctagaaccctaggggtggaggttgcagtgagccaagatcgcgccactgcactccagcctgggcaacagagcaaagattgtctcaaaaaaaaaaaaaaaaaaaaaaaaaaaaaaaaaaagacaagcaaggttatatgctcccgttgctcaacctactcaggaggctaaggcaggaagatcacttgagccccggagttcaggcactctaaactgtagcgcacaatgattacatctgtgcacgccaacctgggaatcacagcgagaccccgagacctcgtctctaaaatgaaaaagaaacaaaatctctaaaccactcaataagatttactctggggcaatcaacagacaaccacttattcagtttaccctagtccctcccctctaaactcaaggaatggaacggagaggtcctttgttggggggtggagagggacaataaaactatatacatctatctagcaagaaagtcgcttatttctgtgtcttaatggactcaccaagaagaaaaaaatagcccctacccatctccccacaagctgaaaaaacataaaaggaatacgcattactctttaaacatggcgtttactatgtttagaaaatccagtgtggattagtttggtgttttatagcacattttaaaaattgcttgtctaggctaagcgtagtggttcatgcctgtaattccggcacttctgggaggccgaggcaggtggatcacttgaggtcaggagttcgagaccagcctggccaacatggtgaaacccccgtctctactaaaaatacaaaacttagctgggcatggtggcacacgcctgtagtcccaatggcacatgcctgtagtccctgctacccaggcggctgaggcacgagaatcgcttgaacctgggaggcggagactgcaatgagctgagatagcaccactgcactccagcatgggcgacagaacgagaccctgcctcaaaaaaaaaaaaaaaaaaaattgcttgcctgatataacaaggtaactaagctttactcgcaaaggggcctaatcagaacctctcaatactaaaataccttctcaaacaaccacaacacccctatgtttacagagtacacaaatcaggtcataacgaacagaacaaacctaaaacttcttattcactttaaaatgcaattaaaacctgtggtcaactcaatcctctacagaagacgcagagacactggttacaatgtagcattactagagatggaagagtagccttagtgacagtgaagaaaaaagtttagtatagttacttcactttcttctcaccttgatatgagttcacaagtgaactaaggcctactcattttctaacttccagaattttcctcaacaggaaacactcacgtaacaaagagtgctctgcaggtttaaccagagaaataacatgtgtaggcaggaagaaagaaaatcagacaaaaatttaacatctcacgttggtaaagcaccaaagtcaaatacgaatgttctgaacgtggctttcagaaaagatgcaagaaaacttctaaaatacttcacttcagtggactcatatagatggaaagaccgaaaatcccaccctaccataaaggctctaataattcttaactgatcattcttttaactggtcacaatcacagacactggtatatactcaaatgaggtggccatcagtgacaaccatcttcaccataatatagacattaagaacctttgtaacatttaatgtttccctccaagtagttcaaaaaataaaaagtcaatcacctcaaattatgaggtactaacaaatacaccaaatatgctaaaggtcgaaggaacggcacactttgttgcataaacctagtggaaatccaattcagaatttcatgactgaaggtagttattccacatttataatacattttttaaattcccaagggatgagcatttttaccttgccttatttttagaactacacatcacactgcacatatcacatgacatgatgtaactgttagcaaagaaaatggtccaaaccattgacaatgtacatggtaaatcaggatcaatgcatactcaagaaccacatttcgtatttactttaaaaaaaaagtttcttaattcaaaatgttttttcaaattgaaaaaatgtctagtaacctatgtagaaaaaaccagaaatgtacttcgtattttataaaataggagtttacccaattatgggaaaaactgatataaagaaacagataaaggaataacatacttctaaaactacaggattaaaagtaaaaattttctagatcaacaccgaaatgctaataaatacacttagcattaggcacaaaacaattactactcaaaagtattcactgttgataggttaaaaaaatagttttaactgacaacgcctgtagacaattgaaattttctaaattggtcagacagcatgctagaaaaggaaccaagtagagcctataggaaaggggaaagggaaaacacacccacttaagcctttgtaaatagtggtcctttaactgacccaaaaagcagagaaaacagaaattacagaccatcctgacaaatggaaaacatattctaacgtactagtttccatacttgaaaggactttcaaaatgaagttcagtagcaatctataactatatcatgattatgcaaggcaaagattatgtaattttatcgtttattttaaaatgttctccgactctaaaactaaaacaagtaaaacgttttgatctctccaaagcgaaaaggaaaggttcctctgagctgcaatttaaaaatataaacacacaccccaaaacaaacaaaaaaacacaatgattgctagccacgtgacaaaggagatggcaacaccaggattgtgaatggaggggagggaggcgaggctggaggaagagagatttctcggaactttggggaccgcggcagtcggtctgccgaccctaggagcactaaactccagcccctacgagttgtgcttctaacaccctcaagtacagttttattaataagtcacagaaaatgctccagtgacctccaggataaaggggggtgggggggaccgaggaaaaggaaagagagcaatttaaagtggcgccatcatgtcaccccttctcccctaaagcaatcagtaagcaatagttaagtagcacgtttctctataaatccacattgggattccaacattggaaaacgaggatttttaagtaagacacgggagtagcgctgtttatcgtatggaaaacaaactatttgctaagaatcaaaagaccgtcagccggaaaacaggcccccaaaaaggcagttaagattccaactcacttaaaagcaaataaatccctcttcctctttagtttaaaaaaaaaaaaagtccgcctgagggagactacatctgaaaacgtaagtgacctgaatttacaggcaacaaaaataataaatgaaacaatcagagttgtgatacaaaccgtgcaacgcgccaagatgtgtgtttcgagcagagaaaggccttttgcagtcaagagaagttcaaggcgagagccagagtttgtttggggggttcttttacgggaataaatcatgttcttcaggccgcctttttaaatagaacgccaaaggaaaagctggcgaacgaggcggcagctcctggggaagggcccccgcacacccccgcccttggggcgactcccagcccggacccgcagcagggaagcccggagaggccatttaaagttccgggggatttttctaccctgccctgcctttctagttacaactaacaaagagagagagaaatgggagccacagggagagcgaggagaaggagaaagggcagcaggaggaggaggagaggagcagcagcagcacctaccacgtgatggaggagcgtagcccgggcggattcagccccacaaaatgggcgcagtttgcaaacagccccccggcctgggcgccgagggccagcggcgggcgggggcgcgcgacggcggctccggcccgggcccgccgctctcctccccccgacgcccggagccgccctgactttccgggcgggggggcgaggcagagggggaggggaaggcggcggcggggagcggctgctttttcttctctttcgggccctttcccggccttgctccgcaccgacggggcccgagcacggctggagaccgcagcccggccgggagggcgggcgggcgggggcagagagtgaaaccgcccccccgccccgcacaaacaagcaccgccgtctgcagcccgaacccgcacccaggccgccacccccggccgcctctttccagccggggagcgcgcttcagccgccccccgcgccgccgcggcgagacgagtcggcttcgctacggtgctcggttctcccgccggctcggcgagcggtggcggcggtggcggcggcactgggaaaatggcggccgagctccttttccctccccccctttaatctgaagcggagggagaatggagcgagcgagcaagcgggcgagcgccggggacacggggaggagggacagcagcgcctccgccggctgcggctgcggcggcgaagggccgctccaccccggcgcgccgccagggggcgcccgccgcgccgcccccgcgggccgccaggaggcgcggccgccgccgcctcagtcatggctcctcgccgtggccgatgtttttgtacctccatctgcggaggccgcggcgcccggccccagctgccccggacgtgcggcgacggcacgcagcactgcggcagggggaagccagccctcgctgcggccgaggtgagtctaacctgaggcactgacgccgtcacatgccctccgtgctggggccggcggtgcggctcgccagttgaggggcagggcgggccggcgccgcggagcgagaggacgtgagcgaggaactgtttgcactgtgtagtaaagagggtaaggccgtcggcaccacactattccaaggctaaccctgcagaaagctccctgaccagtgaagcggcttccgccgcccgccctttgtccctagcagccagcctccgtatactgcagcacggctgggcactagccccagcaccgcgctccgcagccaccagagttgggcggggtggggagggtgcacgtagtcactgcgcaggccccagccagggcccgcgccgggccagcccgggaagggacagccgggagccagaggggaagtgatggccccgccggcgccgggcccgctgggaactgtagttttcgtgaagaaacacgcgtcttgttttgggtgtcatggcttggcagatccgccaaaacaggcaaatggcattacacaatgagtatttatgcttcctgccgccaccaaaaggaagttcactgccatgctaaaagtttaacaaagaactccataaagaaacacaagtctcacaacaaaaagccaacttcccacctcgttaccagagttggtttaaagtggtggcaccttatcatttctcatgaccagtttatcagtacagaactttatattgtccccaaaataggacctttaaaataatggaacctttcctagacttaaagaattcataaacataatgtaatacaaagtgtcacacaaagtgtaattctaccaccctttaaagttgccaaaagatgagtggagtatcttgagatttaaaagactaatctaggattcatcaaaactggcttaaatgactgaagaaaaaatcgttcaaatcattaaatcatcaaattcggcagataagaagggtatgtatgctctactaccaaaaaggaagacgcaaaatgcttcacacttttttgtggcttaccagaaccaatatccggcattatacgtcacttctgcttatcaaaaaacaccctcacagtcgttacagaacggttttagtcttcccacaaagttacactaactcacctgcccctgcaacatctgcacctaggtttctgcgaatttccatttgtactcctaaaatcacactctcaagcatagtcatagttctcaaataccaaaggcaggcagtttggagtcatagggtcaaattacacaaagaataaactaatatttgtatacacatccaaaagaggtctttagtcttggatttttaatttacaaccctggggaaaaactttgacttttttattgtacacacatacacacataaatagtaattccacaaaatacagtagaagggtattggaccaacagatggcgaactagagccccaatctgaggctcctgaaatctaaattagcagaatgaaaaataccaaataaggcaaagccctttgcagcgtatacttaaatattaaattcagacacaccataacaaaataatcttactgctgctccaaatttttaagactgaactgtcagatttaattaggcaaccaaataagcaagattatatgaaatatatttttctaatggattaggagaaaactggaaaatgctcatttttaaaaccatgtatttgggggaactataaattccagtttcccctttctctcattgcttagtgcaagagtcaagagttcacagggtttatggcacttaaatcagtcaacctgttgtatattcttatctaaaatcagacatctttcttattaggcatccacttgtacttttatttttttgacagggtcctgctcggttgcccaggctagagtgcagtggtgcaatcaaactcactgcagcctcccaggctcaggcgatcctacctcagcctcttgagtagctggcactacaggcatatgccaccatgcccagctgttatttttttcactcctttttgttttggtagatacagagtctccctatgttgcccaggctggtctcgaactcctggactcgagtgctggcattacaggcatgagccaccacacaaaaatcttatgaagagaaacaaattttcttaaatttccccccaaaaaatagtggatgtccaaaaggctgattgaaaacacctacatacaaaataaaacaaacaaacaaaaaaagatttaaagaaaaaggcctggtgcagcagctcactcctgtaatcccagcactttgggagggtgaggtgggaggatcacttgagctccggagttagagaccagcctgggcaacagagtgagaccctatctctacaaacaaaattttaaattagccaagtgtggtagcatgtgcttacagtcccagctactccagaagctgaggggattgcttgagcctgggaggtcaaggctgcagtgagtcatgatcatgccattgtagtccaacctgggcaacagagcgagaccatctcaaaatgaaaagtgataaaaaaataaaaacaccaacatatttcaaatcactcttggaatagtcatgttgactctccaatatccactctattctgattagttttaacccattctctttgccaatgattggttaggaatggccatgagatgtgagtagaagccccctggacagcctccaaaagagaactgtgagaaaaggttcttcaatcctaaaaatgatggaggaaaaaacagtccctcttcctcagacagtgacacctcaaactgctacagtcacctttgcagcaagcctgaagatgccaccaacatcaaagggaatagagagttggtccttggtgatagcattaagccactgtatcaaccaatcctgacaatttgtatgacttctggatttccagccacattacaacaatgtaacaataaacatttattaattgcttaagccaatttgagttaggttccttatataataaatgaagtcaaaaaacaatgattgagttctaatgttttttagtatttgtatcttactttatgattacagtattttatataactaatcttattatttcttcctcagaaaagacattccatggccaggcatggtggctcacacctataatcccagcactttgagaggccaatgtgagagtattgcttgagcccaggagtttgagaacagcccagggaaaacagcaaaacttcatctcttcaaaaaataaataataaaaaaatttagccgggggtggtggcatacacctgtagtccaagctactcagaggctcaggcaggaggatcacttgagcccaggaggtcaaggctgcagtgaaccatgatcacgccactgcaaaccagcctgggcaacagagcaacaccccgtctccaaaaaaagaaaaagaaaggaagggaggaaggaaagaaagaaaaaaggaaaaggtgttccctcttacacacagctctgtatccatccatctttgtctgtgttctctctacctagaaaaagaggaccatccctcattaccaccattccttgttaattcctctctccaatccacctacaactcatgttatcctcttatattccaccacaccactgttatcgtctactcacttcacttgacaataatgtaggctgggcgtggtggctcatgcctgtaatcccagcactctggaaggccaaggcaggcagatcacctgaggccaggaattcgagaccagcctggccaacatggtgaaaccccgcctctactaaaaatacaaaaagtagccaagcatggtggtgcacgcctgtagttccagctactcgggaggctgaggcatgagaatcacttgagcccggaaggcagaggttgcagtgagccaagatcacaccactgcactccagcctacgcgacagaaggagactgtgtctcaaaaaaagaaccaataatgtacagagttggcactacattacccttggttaaatgctgtctgtaattcctctgagtttgttttcatataccagtcttgccacctcaagccagcctgaaagcccttgcaggcaggaactgtggttgttctaatttaagatctgtaactcatctatagataataaacgtattccaaaaaggcactctctaccttccctgccacagaccttctaaacaagccagaaattcctaaacagaataatctcacaaattcagtacctcgtatgtccaaactaatctcaaaaggacaatgaataactttttttgcacttaagaaaaagcaattattatatattaactcaggacaagttctaaagcctaggccatttagtttcaaaagcacaggggcccatttttttggttacttacctaggacctagcccagggcctggcacaaaagagacacatcataagaactgactgaataaatgaaaaaggtagagtgtagtacttaagcacacaggacctaggtagcccgattctaatcctgcctccctcacttattctttgtgttactttgggcaaagtacgtattctgctctgtaaaatggagatagtaataccacctacctcttaagtttaactattattattagtgaatgaagctattttccacagttctaaactttaaaggttaaaatctgagtgaagcaaaaatcagcacctctttcctaattcaaacttcaaacacctatctacttaggacttggacctactttaattaaaaaaaaaaaaaaaaaaaaaaaaaaagcctggatgtggtgactcacacctgtaattctagcactttgggagaccgaagcaagtggatcacctgaggcctggagtctgagaccagcctgggcaacatggtgaaaccctgtctcaactaaaaatacaaaaattagcctggcattgtggcacatgcctatagtcctagctacttgggaggctgaggcaggagaatcgcttgaacccacaaggtggaggatgcagtgagccaagatcgcaccactgcactccaacctgagtgacagagcgggactctgtttcaaaaacaaaatccctgtctagactctagcaaacaatgttttcattcatgaacttagataacactatatataaaaatacttttagctccctaaaaacatattctgagaatgattatttacaatcataaatctaatgccacattaaatacttcaaatacatttaattcaacaaaaatctagtgagtacctattaagctcaagaatttattctagatatcacagaaatgaacacataaacctatgtaaaaacccatattaaaattataaaagaaacatctttaagctgaaactgaggcatgttctcacattaatatttaaccagctaaatattaaatagccagagtcaactaaaccaaagttaagaaatttaagtcaaaaaatttaggatgtagaaggaatatgttcagccgccacattttattagtgtgaaaatgaggccaacagaaagaagccagttaagagattgccaaagcgtcaaagctggaatcagggtctctcagtcttcaattctcacttttcccacttctaattcaccagtgctactcaattggtgaactggatgtgcaaacatgctaaaggcattaaacctaaaccatactacctatttcacagtgtcacaagtataaagatttagccaaatgcaagtagaagaaaatcctcatactgattacaatgactacaaagctcagaaatcaagattttttttcattaaatggaggccttagctgattcaaaatatcatacagtatttttatgtactgactgaatccagtagaaacaaactttcagtaagattaaacaaaagcatttcataaatggcaaagtattacaagaatgcatagcattccttcatttcaatccaacctaacaagatattttcctcctcatactactgatacaaactgcaggatttacataaagatattattttgccatctcaccacagaactgacccaataattcatacaaaagaaaaactaattattaggcagcctcctaatttaactgtgttagtaatgagaacaatactgttgtaggttaaacctaaatgtactagtaagtctagaaataatttactttaggataattcagaagacaacattaaagctcagctgaatacaattatatcactgaaagaaacaagtcaggttctctcaggccatcagctattgttaaaatctaacacccaagattgttggtcttctccacagtggtggatttaatagcagctaccagcactcatttctagtgcaagcagtttaagcaggattttatacgaacattttaataaagttcctcaatgagtttacacacacacacacacacacacacacaccctgattattttggtgaattttagttaattctaatgtttttaactttagaatattttaaaattctcaaataactagaatgtgtgaacgttcaatgaccaaacatagaaggagtattctaatatactgattttgcagattaagcaatctacgcaggacccaaactttttatcagataataaagctgagtgtcagaatttggccaaaatgtaccaagaaactacctgagttcttttccaaaggaaacataaaggtaaatatgcagaacttcaaggcagctgtgagcagccaagttgtggagggcctgacaaaagtgagtcagaagggaaaatgttcaaagagaaaaggaggcagcaggtgtacaaggcaaaacacaccttaaaaaatatctttacaggctgggtgcggtagctcatgcctgtaatcccagcactttgggaggccaaggtgggcagatcacgagatccggagatcgagaccatcctggccaacgtggtgaaactccgtctctactaaaaatacaaaaaattagctgggcatggtggggggcacccgtagtcccagctactcgggaggctgaggcagcagaatggcatgaacctgggaggcggagcttgcagcgagcggagatcacgccagtgcactccagcctgggcgacagagcgaaactctgtctcaaaatatatatatatatatatttttctttttacgtcagttgctgattctaagttatgatgcaacttgtaaaatcttgttctgatggcatggcaaacctagggactttggaagatggcagacctgtttcctccaatgaagcagcataccattcttggaaagggaattactttttttttttttgagacacagtctcactctgctgcccaggctgccaggctggagtgcatggcaaaatctgggctcaccgcaacctccacctcctgggttcaagcgattctcctacctcagctgcccaagtaggtgggactacaggcgcgtaccaccatgcccggctaatctttgtatttttagtagagacggagtttcgccatgttggtcaggctggtctcaaaatcctgacctcaggtgatccgcccatctcagcctcccaaagtactgggattacaggcgtgagccaccacgcccagcctagaacattatttttaacccactaattcttggattcttgaacttgtttctatgtacactcaggaacatacagctacaaacggggagtaaccaaagccactgaatatatgcaggagcaacttttttggagtatcaatttaatcaaggattatagtaaaatcagatatacttttgttaaaataaacacaaatatattacaggttgaccatccctaatctgaaaattcaaaaccctccaaaatctgaaactttttgagtgccaacatgacacctcaaatggaaaattccacacgtgacacctttgcttctgatggttctctgaaccatcagaaacactgtttatttcaagaacaaaattattttaaattttgtataaaactggtcggttgtggtagctcatgcctgtaatcctaacactttgggagaccaagatgggaggatcatttgagccctggagttcaaaaccagcctgggcaacatagtgagaccctatctctgaaaaaaaaaaaaaaattaagtccaggtacagtggctcaggcctgtaatcccaacactggaaagccatggcaggtgaatcacttgagctctggagttcaagaccggcctgggcaatgtagcaaaacctatctctaccaaaaacacaaaaaattagccaggcatggtggcatgcacctgtagtcccagctacacaggaagccaaggtgggagaatcacttgagcctggaaggtggaggctacagtgagcagagatggcgctactgcactccaacctgagtaacagaatcagaccccatctcaaacaaacaaaaaaattagctgggcttggcaccgtgcatctgtaccagttagtaccagctacctgggaggctgaggcaggagaatgacttgagcccaggagttctaggctgctgtgagctaggatcacattactgcactccagcctgggcaacagtatgagacatcatctcttaaagaaaaaggtaaaaaaaagaaattatcttcaggctatgtgcataatgtgtacatgaaacatagaatttcatgtttagatttggatcccatctccaagatagtacattatgtacatgcaaacatcccaaaatctgaaaaatctgaaatccaaaaaacttctggtcccaagcatttcggataagggatattcaatgtatacagagcaaaaggcagaattctcactgtttcaagatagaaaaggagtcctcagagagatatgtcctgcttgtaacaaacagctccaaacagccctagaccctgaaaagtactttaaggaaagataaagaggtactggtttagaccatttatagataaatatgcatggctaaaacccctgaatgtaatccttccaggcagaagataaaacctgaaatctaacgtataaattgtcatgggtacaatattataaaagagaccataagttaccgagaacatgactggaattcaggaaatgctaaaggtcctgtcttatctctgtaactcatttacaaagaaatcatgtatgattttctcaactgcaatcttttttgtttctgaattagactgacaaaaattatagaatataatattcaatattttccaccatattccaaattctcactatcacatttaaacacaattttatctaatgaaatgtgtcccaaatgaaccaactttaaccagcatcagaaaaaataaaataaaatagttaaatgaaactgtatcttctttggtataagaagtccttcaggccagacgtggtggctcacatctctaatactagcactttgggaggccgaggccagtggtttgctagaactcaggagttcgagaccagcctgggcaacatggtgaaaacccgtctctactaaaatacaaaaaattagccaggcgtggtggcatgcgcctgtagtcccagctactcgggaggctgaagcaggagaattgcttgaacccagcgggaggtagaggttgcagtgtcagtgagctgagatcgcgccactgcactccagcctgaacgacagagcagactccgtctcaaaaaaaaagaaagaaatccttcagcacagagggtaggaaaaaacaactactcacacttcccagaatacctaccgtggcaataccaaaatatgaccatgcttgttaatatttgggctacggcattaaatgtttataacataacacaaacacttgtaatccaaatgtgaatgattatcttcaattttcagtaaaataagaccctataaaagccctaccattaatacatattcattcataaacatactgagtaccagtggatgttaaacactgtagaatctctaaggaaagaatactcggtcactttataagctatgtggtagtcaagaaaaatcctttctactcattgatacgttaaatgatcaaaaaatccaaagctaaaaaatgatcagagaacaatgaaaaaattttagtggctttatgcttccaattccattttcttctggactcttttctgaagcttgcctaaatcatcccaggaatgctaaaattgggtgttatttatggcataaccaaaatgaaataacaaagtaagtaccccaaataaaactaggagaaaaaatccagggaaccaagcaggcagtaaggatctaaagttctatacttggaacctctaccctgaatgttaaataatagatgttttttaaatagttgactaccaagtgtggtggcatgtgcctgtaatcctagctacttgggaggctgaggtggagagactacttgagcctaggagttctagactagtctggacaaatagcaagaccctgtctcacgggtaggggagcaggggaaggcaaccaagctgggtgtgccatgtgcctctagtcccagctacttgggaggctgagacaggaggagtgcttgaaaccataggccactgtactccagcctaggcaacataggaagaccctatctctaaaacaaacataaacaaaaaggccgggtgtggtggctcacacctgtaatcccagcacttgaggaggctgagttgggaggatcacttgaggtcaggagttcgagaccagcctggccaacatgataaaatttttgtatctttagtctctactaaaaacaaaaattagctgagtgtggtggcaggggcctgtaatcctagctacttgggaggctgaggcataagaatcatttgaacctgggaagtggaggttgcagtgagcggagatcacaccactgcactccagcctgggtaacagagcaagactctatctcaaaaaaacaaacagttatatctttaattattatcttcattcagtaattaggcaattagaatttacaattgctaaatgaatgttcaaagttcaaccaaaattagtccaagatgaagccaagaacacatctcaactcattcaataaagccattattactctgatgccaaaaccagacatagatatcacaagacaactacagaccaatatatcttatgaatacagatgtaaaagtcctcaacaaagcaaaatgaatccagcaacatattaaaaggcttatacaccattgctaagtatgacttaatcccagggattcaaggttggcttaacttctgaaaatcaattaatgtaatacaccatattaataaaggatacaaaccacatgatcatttgaatagatgcagaaaaagcacttaacaaaatccaacatgctttcatgataaaaacactcaacaaagtagaaattgaagaaaacatcttcaatctaataaaaaatacctatgggggaaaaaaagaatacctacaaaaaccccatagctaaaatcatacttaatggagaaagcctgaatgctttctccctcaggtcaagaacaaaacaaggatatccactcttaccactctgtttaacactgcactgaaggttatggccagggcaaataggcaagaaaaagaaataaaaatcactcaggcttaaaaaaaagaaggaaaactacctttatttgcagatgatataatcttgtatatagaaaatcctaagaaaatcccacaaataaactattagagccaataaacacatccaacacagttacaggatacaagctcaatatacaagtagtaatcgtatttctatacacaagcaataagcaatctgaacatgaaaagtttttaaaaattccacttacaatagcatccccccgccaaaaaaaaaagacttagaaagccaagcacgatggctcacacctgtaatcccagcactttgggaggccgaggcaggcggatcacttgaggtcaggagttcaagactagcctagccaacgtggtgaaaccccgtctctactaaaatataaaaattagttgggtgtggtggcaggtgcctgtaatcccagctactcaggaggctgaggcagtggaatcacttgaacccaggaggcggaggttgcaatgagccgagatcacaccactgtactttagcctaggtgacagaatgagacactgtctcaaaaaaaaaaaaaaaaaagacttagaaataaatttaacaaaagcagtgacaatcttatactctgagatatataaaaattacaaaagaagttacagaaatcctaactaaatggaaaggccaggtgtgatggctcacacctgtaatcccagcactttggtagactgaagtgggtgggctgcttgagcgcagaagttcaggatcagactaggcaacatggcaagaactcatctctacaaaaatacaaaaatgagctagatgtggtggcatgcacctgtaatcctagctgcttggggggctgaggagggaagatcacttgagcctagtaggttacagctgcagtgagccatgattgcattactgtacttcactgcagcctggatgacagaacaagactgtgtcccccaaaaaaaaaaaaaaaaaaaaaaggaaagatatcccatgttcatggatgagaatggatcagaagatacaactctgttaaaatggcaatattccctaaattgatctacagaatcaatgtgatcccagcatacccaaaagaaatttgaataggaaaaacaaagttgggggactcacacttcctgatttgaaaacataattcaaagctatggaaatcaagacagtgtggtagtggcataaggataaacatacagatcaatggaatataagtgtgggttcagaaataaacctttacactgacagtcaattgattttatgacaaaaatgccaagacaattcagtggaggaaagaatggtctttttaagccaagtgctgtagctgacacctataatcccagcatttggggaggctgagacaggaggattgcttgaggccaggagtttgagactagccagggcaacaaagcaagacccccatctctacaagaaacaaacaatggtcttttcaacaaaccatgctgggacaactgaatattcacatgcagtagaatgaagctggaccactatatctcacaccatacacaaaaattaattctaattaaatttaaacacggattatagacctaaatgtaacagctaaaacaataaaattcctagaagaaaacaaagctaatcttcatttcatttggtggcctgacatcaaaaccacatgcaacaaaggaaaaaacaagtaaatttggcttcatcagaattataacattttgtacattaaaggacaccatcaagaaattgaaaacacaacccatagatgggagaaaatatttgcaaatcatgtatctcacaagggatttgtatctagtatatttaaagaactcttacaactcaacaataaaaagagaatccaattttaaaatgggcaaaggctgagcatggtggctcacaccagaaggagaggatcccttgaggcaaggattctgagacctgccagagcaatatagcaagaccctgtctctacaaaataaattaataataataaaaaaaaacaattagccaggcatggtggcacacacctgtagtcctagctactcaggagcttgaggcagaaggaacccttgagtccaggagtttgaagttccagaaactatgattgggccgggtgcggtggctcacgcctgtaatcctagcactttgggagtccaaggcgggtggatcatgaggtcaggagttcaagaccaacctggccaagatggtgaaaccccatctctactaaaaatacaaaaattagctgggcgtggtggtgggtgcctctaatcccagctacttgggaggctgaggcagagaatcacttgaacccaggaggcagagattgcagtgagccaagatagtgccactgaactccagcctgggtgacagagcaagactccatctccaaaaaaaaaaaaaaagaaaagaaaactgcgattggccactgcactctagccagagtgacagagcaagacctagcctaaaaaacaatagtgtataaaaataaaattaaaatgtgcagagaatttaaatagacatttctccaaagaagatatatgaatggccaataagcacatgaaaagatctcatcaggttgagcacaggggatcaggcctgtaatcccaacactttgggaggccaaggtgcggggactgcttgagctcaggagtttgagaccagcctgggcaacatggtaaaaccccatctctacaaaaaatacaaaaaggccaggtacagtggctcatgcctttaatcccagcactttgggaggctgaggcgggtggatcacctgatgtcaagagtttgagaccagcctggccaacatggtgaaaccccgtctctactaaaaagacaaaaattagccaggtgtgatggtaggcgcctgtaataccagctactggggaagctgaggcaggagaatcacttgaacctaggaggcggaggttacagtgagccaagatcacaccactgcactccaacctgggtgaaaggcaaaaatccgtctcaaaaaaaaaaaaagtttcaaagataaaacaaaaatcttgttaaagataaatacacgagatgctaaagaaataatctacttcttcaagtcatgctatcaatttgcaccaaaattttcatttcctatgtgtaggtgttgagggtcttgtacccatgataaatgacatacacctgttctgggctgacttttgttccccaaaagagatatatagtactccaaggggctgggcacagtggcacatgcctgtaatcccagcactttggaaggtcaaggccacagcatcgcttgagctcaggaattcaatatcagcctgggcaacatggcaagaccccggctctactaaaaatataaaaaaatagccaggtgtggcagtgcacacctgtagtcccagctacccgggaagctgagatgggaggattgcttgagcctggggtttagggggctggaggttgcagtgatccaagtgccactgcactctagcctggatgacagagggagaccctgtctcaaaaaaaaaaaaaaaaaaaaagatatgtagtactcctaacattcagcacctcagaacctgatcttagagacaggatcttcaggccaggtggcttcccttcctctccgcgtcagtctgtcccacctcagctcagcccaccggagacagagggtgcaggaacctggaggcggaggttgcaggaagccgagatcctgcaactgcactccagcctgggcgacacagcaagactccgtctcaaaaaaaaaaaaaaaaccttacaacaaaatgatgcagcccgggcgcagtggctcacgcctgtaatcccagcactttgggaggccgagtggggcggatcatttgaggtcaggagttcgagaccagcctggccaacatggtgaaatcctatctcaactaaaaaaaaaccaaaaactacagaaattagccaggcgtgatggcgcatgcctgcagtctcagctgcttgggaggctgaggcaggagaattgcttgaacccgggagtcggaggttgcagtgagccaagattgcgccgattgcactccagcctgagtgacaagagcaaaactccatctcaaaaaaaaaagaaaatgcaaagtcacctaagagacagtttaaatacataaaaagctcgatgccaaataaaactggatgggtcacttgataagtgggattgataaaaagcaagacagctgatattatataattcttatttgcttcgatatttactggggaaggtagaggggaaaagctatctaaattactcttaataagcatacaaatctctaatagtgaatcaaatgcatcattaaatatactaaattcctcaaactgatatgtcagatgtcaggtagtcatgaagacccaaaatagtctccatgggttttttgttgttgtttttttgagacagagtctcactctgttgcccaggctggagtgcagtggcaccatctcgactcactgcaacctctgtctcccgggttcaagccattctcccacctcagcctcccaagtagctgggattacaggcatgtgccaccacatttggctgatttttgtatttttagtagagacagggtttcactatgttacccaggctgttctcaaactcctgacctcaagtgattcacccaactcggcctcccaaagtgctgggatttcaggtgtgagccaccacgaccagccccttctctgtgttttaaaggcatttaagtataaattattaaactgcaggacagaacatattagctgacggtcatatgagtgaccttctctaaatgccaggaggatagaatccacttttcctttatcaatattttccttgctcaacttctgacatattaggtactcaataagtatgtgctgaaccaaaacgaacaaaaaaatgctgtcatcaaagtaacttccatctactcaagtaggctgcaacttcaaactgcccaaactagcaaatctctaataaagatgggctcagaagacatatcagcatgaataaccttctgaggaaaagacaacatggattctaaaagtggacatcacaccacaccagttcacccaaattctctgagaaaataaatatgtgtggctgggtgacggtggctcatgcctgtaatcccagcactttgggaggctgaggcgggtggatcatgaggtcaggagatcgagaccatcctagccaacatggtgaaaccccaactctactaaaaatacaaaaattagctgggtgtggtggtgagcacctgtagtcatagctactcgggaggctgaggcaggagaaacgcttgaacccgggaggcggaggttgtagtgagccgagatcgcaccactgcactccagcctgggcaacagagtgagactctgtctcaaaaaaaaaaaaaaaaaaaaaaaaaaaaaagacctgagtggccacaggatgagaacatttactgtagactggacataactgagacacagaaaattataggtagatgctgaggtacttccccaaatgaagaagtaaaaacagaagattgaaaatttttttagaaatgctatatttaacattttaatatattgtacaaaaaatatacagagaattccccattttgcagatgggatgatgagattcctaataatgaaataccacacgagttggaaaaataagggaacggagtgatggaaagggtttctaaatatattaaatgagaaacatttgcaaaaactaagatttatattcagcttagagaatgctttggcaagtataaaagctgtctaaatatgtgaagggttatctagcagaagacaaaccagacttgctctaagcagttcccgtgtagacaaaattgggcccaaagtggcaattccagaagggcacgcttcaactcaagctttctaaccatcagacctaactaaaaaggtggttcttaccttggattacctctaagagcccactgagatatgagtgttaaaaaattacatgcgaggaaatggcaggtatgttacagcatggacaaatgaaaagtaaggcatttacaggaaaaaaaatctaagctatacttaaaagactcatgccttcaagtcaaaaaaggaatttttgaataattatagaatattccctaaagacaatgtgatgttctatgcaaaaaaaaaaaaaaaaaaagggagggagggaggaccaaatcctattaggaaaaaactgtaaatcaagggtacccaatcgtttggcttccctgagccacactggaagaagagctgtcttgggccacacataaaatacactaaagtaacaatagctgatgagctaaaaaagaaaatcttaaaaaaaatctcataatgttttaagaaagtttacagatttgtgttgggccacattcaaagctgtcctgggccgcatgcagcctgtgggccatgggtcggacaagcttgctgtaaatagaacatattttcttatccttctaccaaatcacagtgtagttataactaaaatgcagttctgagtagttatcataaatccagaaagggaaagcaatgctgacaaagatcctggaaggaggtttcactggagattaaattaaaaagtcaagcatcttcagttgagaaacatgaaagcaaaggggcaatgtgatcaaaatcagaaaacgtatcaatatggtaaatactaatttattcaccttttatgcttgaaaagtatttctttatataacagataaaagaaacttgtggattgtgttaccacaatctacaagttaaaaatagattcaagtgctcggataaatgtaggtatattaggtccattcaggtcctacaggatagaagtgctatcagacgtgaggccctaaatttctgaggttaacatcttaacagataacaatgtttcacctgaaaacatcacttggtgccaatttagacagaacaattggttggacagaccccggacagacagactcaaggaggctggttggtatagacttccttccattcttttacctcagtatgtatgtgtgtgtaatatatacatacatattatactagaacatatatacattccttatctttatacacttagaatgctccttatatagctctgcaccctgaatttttcatttatcatttactcaacatcctaagacattaaaaattctttttttttttttagacagagacttgctctgtcaacaggctggagtgcagtggcaccatctcagctcactgcaacctccaactccctggtccaagcaattctcctgcctcagcctcctgagtagctgggatttcaggcacgtgccaccacgcccagctaatttttgtatttttagtagagatggggtttcaccatgttggccaggatggtctcgatctcctgacctcataatccgcccacctcggcctcctgaagtgctggaattacgggcatgagccaccgcacccggccagaaaaattctttcaaatactattccatggttgtaaatgtccatccttaaatataccatgatttattttcctataaatcttgctgctcatttaggtttattctcaattctcactaatatgaataatgttacaatgaacatctttgttcacaaatctttctatgtatcttaatttttcccctttaggataaattcctagatgtgcaattactgaattaaagaacgtttttaattttgccaatatatgttgccaaaatatctttcaaaaaaactaggcccaatgcacactccactagcagtttcagagattgtcccctcaccaccttcgacagcacagtcaactgtaaatctgataggttaaaaaaagagtatgtcatttaatctgcattcctttgattacttatcaggataaaaatgtttctcatatgcttcttggtcatttgtatttcttccttatgaactctgatcatgttctttgccagcaaaacttttctttctcttggccgacaaactttctgtggaaaaccagctgagatggaatcatttaaatatcagcaactgcagctccccctgctgacagataaattaccaccaccatcaagtgcccagtaaaaaaaagtgagctagaaccatacgcttgcctgtcttctgggctgctgctacaaatacaaattatacacggtaataaaaaagaaaatactgtgtatctaaactcatacttaacagagctgtgatggagaaggcaagggggacaagcgttttatttgttttttgttgttgttgttgttgttgttgttttttgagacggagtctcgctctgtggcccaggctggagagtagtggcgtgatctcagctcactgcaagctccgcctgctgggttcacaccattctcctgccacagcctcccgagtagctgggactacaggcacccaacaccacgcccggctaattttttttttttttttttttttagtagagacggggtttcaccatgttagccaggatggtcttgatctcctgacctcatgatgggcccgcctcggcctcccaaagtgctgggattacaggcgtgagccaccgtgcccggcccaaacgttttctaatgtgcaggaactaggcggggtgcagtggctcacacctgtaatcccagtactttgtggaggccgaggtgggtggatcacctgaggtcaggagttcaagaccagcctggccaacatggtgaaaccctgtctctactaaaaatataacaatcagccgggtgtggtggcacgtgcctgtagtccgagatactcaggaggctgaggaacgaggattgcttgaacccaggaggtggaggttgcagtgagccgagactgcgccactgcactccagcctgggcaacagagtgagactccatttaaaaaaaaaaaaactaatatgcaagaactaatgtcacaaacaattctaaaaatcaattccctgccaaatatactacctggcacatataaacatcacagacctaaatattcatttccctatactttaactatgtgaaaacactctaaattaccaaatgacactgggtggtcagcaaactagttctctttttccaaaagcaaaaacaacaaaaacacttttgccctttagcattcaaagaaagagtattaaaaatcttaattcttggcaatccttattccaaagttgcttgcacttatcagactgggaccaatagatccaaagagtaaggccaagactggcaaatgcatgtgactctcagcttttccactgataccctcctaaagatgcatgtcccaagtccagcaatacagtctttaacactcatttactaagtgccatcaagagcaagcagtgatggccgggtatggtggctcacgcctgtaatgccagcactttgggaggctgaggggggtggatcacctgaggtcaggagttcgcaaccagcctgaccaacatggtgacaccctgtctctactaaaaatacaaaaattagctgggcgtggtggcaggcacctgtaatcccagctatttgggaggctgaggcaggagaatcacttcaacctgggaggcagaggttgcagtgagccgagatcgcgccgttgcgctccagcctgggcaacaaagagcgaaattccgtctcaaaaaaaaaagaaacaaaaacagcaagcagtgaggataaaagacaagagcaagtcctcactctcaaagaacctagacactagctgggttcaaagtggagcaaactagcaatcagtacaatagaagtgctaggtctgcatatgcacactcacatgcacacacactaacagtttcagagattgtccccttaccacctttgacagcacagtcaactgcaaatctgataggtaaaaaatagtatgtcatttaatctgcattcctttgattatttatcagaataaaaatgtttctcatatgcttcttggtcatttgtatttctttatgaactctgatcataaagtgataatacctgggtccagaggaagcactcagtgtcagctactgttattactattatcactactgttattttgttttaaggctaatcaagtgaagcagtgggagtggagaaggaacaaagaaatctgtaactggctgtgatcaattaatagtaaacaccaatatacttggaccagccactactgttattaaagactagggggagtaagtttccagaacagggtagagtccatcttaagcagaggtaactgcttgtgtgaagacccagaggcaaagaacaacagggttcacagaaggaactgggcacaagctatctgtactactgcgtacaggatgctcaggaagaagtggagagatgatctggcaaaacatttcaactctaccttcaaagctagttgagccatggtggaagagggagggatatgatcatacgcttgaacatgcattttacaaggatcatgttggcagcgacttggaagagagaaagcagtcaaggagaatgattacaagacaacagaaggtcacgcagccaaaagggcgatgaaggtctggactcaaaaaggagaagtaggatgactaggaaaatattatgagctaggatctcaagaatgtggtgactagaatggcacaagaaggaacccagaggcctctcaaatccctgatttgagtgactggctgggtgacactaccgctcactaagatacgaagataggaagaggttggactggggaagtggataagatcattttaaaatgcccataagatggccagatgcagtggctcacgcctgtaatcccagcactttgggaggctgaggcaggtggatcacctgaggtcaggagttcaagcccagcctggccaacatggtgaaaccccatctctactaaaaatacaaaaactggccggacgtggtggcgcacacctgtaatcccagctacccggaggctgaggcaagagagtcgctggaacctgggaggcagaggctgccgtgagccgagaccgtgccactgcactccagcctgggggatagagcgagactccgtctcaatagtaataataataataaaaaaataaaataaaatgcccataggacatccaagtagagatgtccaggaagcaactgtgtatatgggattggagatcagaaaactagtcagagctggaaaaacacacatttgcaaatcatcggcatatagacggcaagtgaggcacaagtttatctaaggcattcctcataaactgcacagggtgagaggaagaagggtcaagggaaggcaaatactaatgtttttaggagcaaaagaggaaaaaagtctgcaaagaaaaccaagagtatgggccagacttggtgactcacacactttgggaggccgaggcaggtggatcacctgagatcaggagttcgagaccagcctggccaacatggtgaaacccatctctactaaaactacaaaaattagccagatgtggtggcgggcacctgtaatcccagctactggggaaactgaggcaggagaattgcttgaacccaggagacggaggttgcagtgagccgagatcacgccactgcactccagcctgggcaaaagagcaagactccgtctcaaaaaaaaaaaaaaaaaagtttcaaagataaaacaaaaatcttgttaaagataaatacatgagaagctaaataaataatctacttctttaagtcatgctatcaatttgcaccaaaattttcatttcctatgtgtaggtgtcgagggtctagtacccatgataaatgatatacacctgttctgggctgaattgtgttccccaaaagagatatgtagtactccaggggcctgggcacagtggcgcattcctgtaatcctagcactttgggaggccaaggccacaggatcgcttgagctcaggagttcaatatcagcctgggcaacatggcaagaccccatctctactaaaaatatttaaaaatagccagatgtggtagtgtgcacctgtagtcccagctactcaggaagctgaggtgggaggattacttgagtccaggggttagggggctggaggttgcagtgatccaagtgccactgcactccagcctgaatgacaaagggagaccctgtctcaaaaaaaaaaaaaaaaaaaaagagatatgtagtactcctaacattcagtacctcagaatgtgatcttagagacgggatcttcagaccaggtgcagtggctcacgcctgcaatctcagcactttaagaggccgaggtgggtggaccacttgaggtcaggagttcgagaccagcctggccaatgtggtgaaaccccatctctaccaaaaatgtaaaaattagctaggcacggtggcgagcacctgtaactccagctacttggaaggctaaggcagaagaatcacttgaacctaggaggaggaggttgcagtaagctgagatcaccccactgtactccagcctgggcaacaaagagagactctaaaaaaaaaaaaagagataggatcttcaaagaggtcataaagttaaaatgaggtcatcagagaggactctaatcccaatatgacttgtccttataaaaaaggggaaattgtggacacaaagaaatacacacagggaggctgggcgccgtggctcacgcctgtaatcccagcactttgggaggctgaggtgggcagatcacttaaggtcaggagtttgagaccagcctgggcaacaaggtgcagccctgtctctacaaaaaatacaaaatttaggctgggtgctgtggctcatgcctgtaatcccagcactttgggaggccaaggcaggcagatcacctgaggtcaggagttcaagaccggcctgggcaacatggtgaaaccctgtttctacaaaaaatacaaaaaattacctgggcatggtgacacgtgactgtaatcccagctacttaggaggctaaggaaggagaatcacctgaacctgagaggcagaggttgcagtgaaccgatattatgccactgcactccagcctgggcaacagagcaagactctgtctaaaaaaacaaaagaaatacacacagggagaactctacataaggactggagttatgctgccaccagaagctagaagagaggcttgaaacagatcctgtcccagttgcttcagagaaagcatgcctctgcccttagatttctagcctccagaacagggagacaataaatttctgttatttaagccactcagcatatgtcactctgtggcagcagccttagcaaacagatgtcataagaaaattcgcagctcaggtttactaagtacctaccaggtgctgttctaaacactctgcgtgaataaactcatttaatccttataaagtccactctaggatctaggtactatcattataccctttttacagtgtggacaccaaggttctaagaggttaatgagcttacccagtatcacatagccagagccctctctctcaccactagtgtatgaggagctattattaacagtaattacaataagagctggcgtggtggctcacgcctgtaatcccagcactttgggaggccaaggcgggtggatcacttgaggccaggagtttgagaccagcctggccaacatagtgaaaccccgtctctactaaaaatagaaaaataagccgggcatgctggcatgcgcctgtaatcccagctacttgagaggctgaggcaggagaattgcttgaactcaggagacacaggttgcagtgagccgagatcgtgccactgaactccagcctgggcgacacagcaagactccatctcaaaaaaaaaaaaaattagtaattacaataagaacagtagtagtccactgaaccaaacactgccctatgtcctttacagatataatacaaaagtcctctgaagtaagtgttattatttccagtatgaaggaggaacctgaatctcagagagattaagaaaatcgcccaaagtcacacggttaagagtgctgagattaggccgggcacggtggctcatgcctgtaatcccagcactttgggaggccgaggcgggtggatcacctgaggtcaggagtttaagaccagcctggccaagctggtgaaaccccatctctactaaaaataaaaaaaaaattagctggccatggtgacaggtgcctgtaatcccagctacttgggaggctgaggcaggagaatcacttgaacccaggaagtggaggttgcagtgagccaagatcacctggacaacaaagcgagactcttgtctcataaaaaaaaaaaaaggaagaagaatgctgagattatatctaattgctaacttaaggggatatacaatgaaaacctgtttttactaaaactttaagaacaagttaattttttttttttctttaatgagacaagagacaaggtctggctctatcacccaggctggactgcaggggcgcaatcacagttcactgcaacctccacctcccaggctcgagccatcctcccacctaggcctctcaagtagctgcaactacaggtgcacaccaccatgcctggctaattttcttttgtatttttagtagagatggggttttgccatgttgcccaggctgttctcaaactcgtgtgctccagcgatctgcctgttcagcctcctaaagtgctaggattacaggcgtgagccatcgcgtctggccaagttaaattttttaatgcctgactttgcagttcaatactagaaatatacatctataaattcaaaattcttgaagatcccaagagaacacatgtcctagattatgggcccttttgcgtgtgtatcccctcaaccactgttcaagaactattctctcggctgggcacggtggcccacgcctgtaatcccagcactttgggaggccgagttgggcggatcatgaggtcaggagatcgagaccatcctggctaacacggtgaaactccgtctctactaaaaatacaaaaaattagccgggcgtggtggcgggcgcctgtggtcccagctactcgggaggctgaggcaggagaatgacatgaacccaggaggcacagtttgcagtgagccgagattgcgccactgcactctagcctaggtgacagagtgaggctccgtctcaaaaaaacaaaaacaaaaacaaaaaaactattctctcagttagaacccttgccatttctctgacttccagacacagaaagagaagaaaaggaaggattgagatgctgttctttaaaatttttttttttttttgagacggagtctccctctgtcgcccagactggagtgcagtggcacgatctcggctcactgtaaactccgcctcccgggttcacgccattctcctgcctcagcctcccaagtagctgcaactacaggcgcctgccaccacgcccagctatttttttgtatttttagtagagacggggtttcaccgtgttagccaggatggtctcgatctcctgacctcatgatccgcccgcctcggcctcccaaagtgctgggattacaggcgtgagccactgcgcccagctaaaattttcaattttctatttaatttttaaaatctgatacaaacatcagaaagtgtaaaaagatataatgcaatgagaagtctccttcctactctgtcctctacctgaacaattcctagacctaacaggtaaccagtgccaccattttcttatttattcttctaaaggtttgtgttgttgctgttgtttgagacagagtctcgcttggtcagccaggctggaggacagcggcgtgatctcagctcactgcaagctccgtctcccgggctcaagcaattctcctgcctcagcctcccaagtagctgggattacaggtgtgtgccaccatgccccagctagtttttatattttcagtagagacggggtttcaccatattggccaggctggtctcagactcctgacctcaggtaatccacccaccttggactcccaaagtgctgggattacacgtgtgagccaccatgcccagccctaaagatcttttttttttttttttgcatacatacaccaatgcaaattatctttttctcctgtttttttttttccaaaaaacacaaagggtatcaaatcatacatactgttctgcatcttgctttcatcacttaactgtctgccttgcagatctttctatatcatattaaattatgttttaattctctcgttttgcttgtcaagaacagtttttacttcatttcaccatagttcagtctagcacacaaggcatccagcagccctaagaactacctgaaacaactgatgatggctccatgctacacactaaagaccctgtatcttttctctcctcctcatcttcatttcactcttttctccgactcactcaattctccttcctttccctattcctctcccatctcacccactccttagccctaaccctgacaactagaccctagtaacatcactgacattgcttagtcgtggctagaaatattcaggctttaaaaaggtacagacccctaacacagagaaaaagggataaataataatttccatgagaacttctaattaacgagagtgccttaaattgaggagttttggcttggagttattcttccttgttacttgcctcctctggcattttcatttgtgaagactgagtgagtgtgacgctattttctatacgcatggaaacaagcacatactcagtctaacatttacgcaatgcctgacagaacgacagagttcattctacaataagataattggaaacaaaatataagatctatataaaataaacatttgggctccaaaatatgcactttaattaacctatcatttctttttacttaaattaagtagctccaatctgaaactacatcttagaaatgttttaaggatattcaccaatgaaaaagagaataaagttccctctccccacttttattttccagcccacaaactcaatgctatcctccccgcaaaaaggacctttttttctgaccagacgaacactgtaatttttaaggtttctaagtaataaaaataggaagaaaacattaccccccaaaattggtttacacttagaagatgtttcccactgagcaaaggattggtaaggaacataatattaaggcaaccacctaactgcattcttaagtagtaacaggtggtaactcacgatatggagctgatttcctttctctattcctgccatgccagagacctctagtagaacttctgaggttactgtattacaacccaggttcagagagatttagaggtaaaaccttaaacactggaaatatctttaaaagtagggctttgtgtaccaaatacattcgttaaaacctaggaaactataaaatgaaatccaatgtattgatctcaatccccttgcctgcttcctaaagaggacagaggccaccaacactggtgctcaacacttgctaagtcgaaacactcttacacaggtcctctgattcttaacgggttcagaacttctggttgcattccccatgcaacccctccaactctacagggagaatgctggaaaaactgtgtcactttggcttcctgtatattaatataagcactcttatccagcaatagcagctgaaacataaatgaagatgagaactcagcctacatgacctaagatttcccacaagtccagatatttaggttacacacactgcactattgtctgatttctcctctgcatcaatctggaagtccacagagcagattagcacccaacaatcttaactaagctagtatcctactctgaagaaaggcgaagctggtggagggtttccaagactccttatccttctctgtccttcctcccatcccctccttacgtcttttctgtttgtttttatttaattttttttttaatgtatttttagtcacaagaaaatcaaagaagccacctacttaagtcttaagctctgccctttgcttagtcctaatggagagttctttggccatctatgtacaagagattagaggagccaaagagactggagaaccacatcaatgggagctttttcatctaaaggtcatctgtccacactgtccaaatgaggtttaccctgtgaaataaaacttggtgtaagtgctacctgctgagaaaaatagtatgaaatgtcacacaaaggactggggtgcagcaggaggactctgaaagagtcatacgtgtaaaccagcaggtcttagaatgccctaatatactatatgaagtttcagagtaaacaaatggttaatgacacatcttttgtaacacatgaatcagctactgatttgcaagagtgggacacaccctagtacctatgactctaaagtacctgtttgaaaagtggacctagatgtttgaattgccaacccatcctaagaccggaacataattttacaactatgtaagttgccataatttaaagttaaaaagatcactgcctttcattataatggaagttaatttgagaacttcattaaaacattcacaccgataatcaaagaacagtagagatacaaagtaaaatatagccaatcaatcctaggaagcaaacacaagaggcaagagaaatggcaggtaaaggaagtgaagaatagcaaattcaaaaactacaatattcccaattctaaagaaaaatgaataaaatgaggctggtaatgaaaaaataacacatcttaccttaagaggcatccaagtagcattcatagtgtcaggatataaagacaatactcagaaatgagcaagaagtcttagtaattccctcggttaccaagtataagcaggtaggaaaatcttttgtttcgagaaggtatctgaaagagaggattttcatttagactaaaaaataatcaagacaatgcaaatagtttaagctacctgggcagggattttgaagtactatttgcctcatcgcactaaaaaagtatagaaaatacagtcccctttagaaaagggcaaatgtgtgtctccatatatatgtgtgtagaaacatactttacataaaaagagaaataaatatgtaacacgtattttagataatgtaaaattgcttatcaaacaattagccaaaatcccagagagaataaagtaattttccagggtacttcataaacactaaacgtgatttgttaactaaccgtctaaagaaagacccttgccacatttaattatatttagtaaagtaaaacttctctaatcatcccgactgtcccaagattatgcttaagtttcagagtcaattccacatgaaaagtaaaacctattcttgactgaagtactagaaacaaataaaagacccttcttccccagagatcgttaaaagcagaccgagcaacttaattttgagggtgggaggaaggtaaatttgcctggaggcaggaggatggactaaatgacctctggtaggatcctcgttcaagtcctgggcctgtatacaattccagcttaaccagttactgcttcgcttaaaatggaggcttgcctgcgtagggacaaaaataacagcacccacttcttaaaaataaatgtcgaaaagtacccctttttaaataaaaataaaaaataaacacctctggagtggatgtgttcttgctatgcgtttgtcactgaggcttcgaagacttggcatcactttccttaccgctcaccggattttgggggaggagcggggggcgacagtttgactcttgacccaagtctcaggcggacttcagagccccacaggggcccccaactccagagccagagggagcggagaggcgagagcccgagatcgcacctccccccaccgcggaccccagtcccaaacccacccctcacctccccgcagtggggcgcctccttctgccccattcccattgttagggagggcagagcgcggggtgggctcagggcaggggcgcccgcggccgttgcccggctcgcttcaggaggggcgccccgcgggatgcggcttcccttcctctccgcgtcggtccgtcccacctcggctcggcctggcgccccgaggtccgctccgcgcccccggccgcggccccggcccgccccccgggcagccaggccctcaggccagtcggccggcagccggcgtcccaggcctacgagtgggcgctgggcgggggtccccgtgccccacacacgcgtcccctctcccccagccccgccgcttccagggccctcggcggcgcccgctccccgggccccgcggccccccgcctcccagccgggccgctccctcgagctcgtcgggtcagggacacctcctctacctcaccatcaccctggcccactcgtgcccccacccccaggggcaccagtgccaaaggcagctcccccagccccggacctacctgcacggttcaaccaagcctagaagtgggggcggggaatcttccgccctcctctggcgcccattggcccttcaggggcacatcgtgagcgccattggctgagcaatggtgtccgtcagagcgatggggcgggacagaagggggagagggatgctggtgccttggcgtctctgtctctgtgtatctcgttgtctctgtctctgtctcggcccttggaaacgagaggcttttggctgagaggactagaagggggcctgaggtgggaggaataggaataggaatcctgacagagcgtcacgccagttggccactctgaacgccctacctaagtcccctttaggttctcttctccatcacccccaacccctgcccctcacccctcgaggttctttcatccaggaagcgacgtgatgaaaactccaggccggaaggccatagggagagatgttatatatgtatataaaatatacacataaaaatgtttatatataaactcaaccagatatcagttcactagggcctggaaaggaaagggcacacatctcacagacagggaaggacttgagatagagccggtagaagaaggaatcaaaaatcactctaagagctggcaacagtggttacctcctgggagaggaactgagtgcctagggaaccagtgggcggaagacttacatatctcggcatatcatttgtatccattgatttttgcaccattcatcaagattccaatttaaagaaaaggatttaaatgtttaaataaggtcgcaaaaccaggggacagacaagataattgggcaggaaaattggcgcaacatgcagatttggggaggaatcttagcttttaatatgttcagctcccggtaacagggttttgtaaaacccagtgaaggtgtcccagaggcaactgaagttatggaacttgagagagggtagacaatcaggactagagaagatgcagggtcctctgcctaaagatagtgatctatgacatgctaaaggataaactcccaaagaagggtaataagacacccacagtaaaaggtaggaggacgaaaaagaaggtcagtgaggtaaaagaaacaatattaaagaggcatgaaaattaagggaggaagggtctgtggaaaatagaataataaaactatgagagaggccgggcacggtggctcacacctgtaatcccagcactttgggaggccaaggcgggtggatcacctgaggtcaggagttcgagaccagcctgcgcagcatggtgaaacccgatctctaatagaaatgcaaaaaaaaaattagccaagcgtggtggcgcgcctctgtaatcccagctactggaaaggctgaggtgggagaattgcttgaaccgggaggcggaggctgcagtgagccaagatcgcgccactgcactccagcctgggcgacacagtgagaccctgtttcaaaaaaaaaaaaaaaaaaaaaaaaacaacaaacaaactgtgagagcctcataggtcttacctctttacctctttaggctctggtaaccatgggacaataagaatgaaagccaaggccgggcacggtggctcacgcctgtaatcccagcattttgggaggccaaggtgggcggatcacaaggtcaggagatcaagaccatcctggccaacatggtgaaaccacgggcatggtggcgcatgcctgtaatcccagctactcgggaggctgaggcaggagaattgcttgaaccagggagtcagaggttccagtgagccgatatcacgccactgcactccagcctggatgacagagtgagactccgactcaaaaaaaaaaaaaaaaaaaaaaaaaacaacacctttatcgattaagaatcttttttctgagtttattaattctatttaaatcaaccccagaaaacaccttcaacacagcctctcatttcatatctgtaaaatggggcaaaaaaaaaaatagttcctaccctttagagttgttgtgaagattaaattagtgaatacatatgatggatttttttttcttttttcttttttatgagacacagtctcgctctgtctcccaggctggagtgcagtggcactatctcagctcactgcaagctccgccttccgggttcacgccattctcctgcctcagcctcctgagtagctgggactacaggcgtccgccagcatgcccgactaattttttgttatttttagtagatacggggtttcaccgtgttagccaggatggtctcaatctcctgacctcgtgatccgcccgacttggcctcccaagtgctgggattacaggcatgagccatggcgcccggcctgtgtgatggattttttaagagcctgactggcggggtgaggtggctcatgactgtaatcgcagcactttgagaggctgaggcaggtgaatcacttgaagccaggagttcgagaccagcctgggcaacatggcgagacctcgtctctacaaaaacacacacacaaaaattagctgggtatgatggtgcatgcctgtagtcccagctactcaggagactgaggtgagggtcgcttgagcctgggaggcagaggttgcagtcagccgagatctcaccactgcatttcagcctgggtgacagtgtaagaacctgtcaaaacaacaacaacaaaaaaaacaaaacaacaacaacaaaaaaacgcacgaaaaaaaccacataagctccttgagggcagaaactgtcccctagtcttctatattttatttcacacaatgtacagaagactaaatgaataattgttagctggtttttttttttaaaggggataagatcagttacaatgtctttttcctcagtcaatcacataagtatctaaaatgacattccaaagtaaggacaggagtttaaatcctgaactatggtatctaaagtaaacttgaactttccttatttttaaaaaattttggccgggcgcggtggctcacgcctgtaatcccagcactttgggaagctgaggcgggcagatcacaaggtcaagagatctagaccatccttgccaacatggtgaaaccccatctccactaaaaatacaaaaattagctgggcgtggtggcacggacctgtagtcctagctacttgggaggctgaggcaggagaaccgcttgaacccgggaggaggagactgcagtgagccgagatcacgccactgcactccagactggcgacagactgtctcaaaaaaaaaaaaaaaagaaaaagaaaaaagaaaagaaaaaaattccatacatagaattctgtgtggcattttagagaaaatcatggtgactagagacaccaggtgaaatttttttttttttttttttggtgacacaaccccaggagatcctgtgaacatgtgtcccttgaccaggtgaatttcaggagcttgcactagtcccaggttagctggcaccaggttggccctagtttgagtgccttccacataccaggtactgtgctggagaagtaacatcaaaaaggaaaatcaaatttcatcttcaataagcaatcacaatacactgtgatgagagttagggtgaaggaggttcaggttaccatgggcttatattaggagggcaaattctgtcttcaagtctttttgcttcaacagtagcgtttagatcttgtgggctgggcatggtggctctagcctgaaatcccagcactttgggagggtgaagtgggcagactgcttgagcccaggagttgcagattagcctggcaacatggcgaaaccccgtctctacaaaaaatacaaaagtcagccaggcatagtggtgcctgcctgtagtttcagctacttgggaggctgaggtaggaggatcgcttgaccccaggagttcaaggctgcagtgagctaccatcgagccacttcacttcagcctgggccgcagaataagaccctgtctgaaaaaaaaaatcttgtgatataataacagcttgtgcactcttcgatagctcagctggtagagcagagggctgtagactgcatagataataataacagtttgcgtttttgagtcaaagatgataccccagaatcattatcgaaaataatggttgatccattcacctgtgcctatgactgtgagccacattgtgaccaatctgtgagcaacatgggtgggaatgcagtttggggccatggaactcacttaacaggaagttccaatagcagtggatttaccatgttgcggctgtaggatcttggacaaatatttaatgacctctgtctctcagttctctcaataataaaacatccctccgagagttgctgtaaaggttaacatagggggagtcttgcaaatagtaggtgctaaaatcctgtcttgaaaaaaaaaaaaaaatatatatatatatatatatatatatatatatatgaagagatgagatcttcaattgtacagactgtccctgtacccattcatttgcatttcttttcctttacaataatacatatctatgatttcctttcattcccactgtcatcaatttagttagattactgggcagagatcaccagtggggctagagtaaaatgaaaataaatgtacattgactctaggtattcctaagtaatagcacagtttactgtgttctccctcataaatcctggtagctgaatgttgcctgcttttagcagttacgtttctgctcatctcaccctcaatgttcattaagaaaatagttattgaatggccaggctcactggctcacgcctgtaatctattacaggcgtgagccaccgtacccagccttggttatcatatttctaatttataatagtttttcttgttttcttattgttcattttttatagcatcctgttcttatattatggatatatatcttcaggtctcgctgaagaaataaagaggtgtatgtgtatatatgtgtgtgtgtattatctttatttttattttttgagatggaatcttactctgtcgcccaggctgtagtgcagtggcgcttttgggaggctgaggtggaaggatcacttaaggccaatatttggagaccagccagggcaacataacaagacccccatctctacaaaaaaattaaaaattagctggccatggtggtgagtgcctgtagtctcagctacttgggaggctgaggcaggaggattgcttgagcccaggaggttgaggggggaggtgagccatgattgagccactgcactccagcctaggtgacagagtgagaccccatctctaaaaaaaaagagagagagaaataaaatagttattgagcacctactgtatgtcaggtccaagaccctaaagatgtaaagatgaataaggtggtgaccctgccttccagtttccacaaaggtggggaatatggataaaagcagacaaagccattgccatgggataagggcagagaatagcatgtgcaaattatagaaggtgagggataatataccactttccagaaactgatggttcaatgaggctaaagcatggagttcaagaaaggaaaccagatgagattaactgcaatgtggttctcaaacttaaatgtgcataaaaactggccttgttgactgggcacagtgactcacaccggtaatccaagcactttgggaggtcgaggcgggcggatcgcttgaggtcaggagttcgaaactagcctggccaatgtggtgaaaccccatttctttttttttctttttcttttttttttttttttttttttgagacagagtctcgctgtcgtccaggctggagtgcagtggcgtgatctcggctcaccgcaagctccgcctcctgggttcacgccattctcctacctcagcctcccgagtagctgggactacaggcacccgctaccatgcccggctaatttttttgtatttttagtagagacggggtttcaccatgttagccaggatggtctcgatctcctgacctcgtgatccgtccgccttggcctcccaaagtgctgggattacaggcgtgagccaccgcgcccggcctgaaaccccatttctactaaaaatgcaaaaattagctgggtgtggtggtgcacacctatagtcccagctgctcaggaggttgaggcgggagaatcacttcaacctgggaggtggagatggagtaagccaagatcaagccactgcactccagcctgagtgacacagcgagactctgtctccaaaaaacaaacaaacgaacaaaaaactggccttgtttacatagtctcgcaagctccaagcctagagatcttgatggagcgggtcagagtgctgctgctcggagggctacactctgagaaccaccgatggagaagaagggcggggtcaacttgcagagctgtgctgggaggtgtgtgctgcagccttgagggggtgaagaacctttgagaggttttaagcctgcaagagatgtggtcacatttatattttagaaaaatcaccctgtgtgcaatatgaaaaatgaaacagagagggcaagactggagtcagggagagcagttaggaggctgctgcagaaacccaggcaagaaatcataaagacctgaaataaaacaatgccagtggggaacggggaagagaggccaaatccaaggggtatttaggagccagaattgagagggtgtgatgagtgttgatgggatacaggacaggatcctgagatggcttgcaggtcttcagctttgagtgacccatggaagcgaaggaagatgggaaggagggtgcctatcacacagagagaatgaaggtttgagaggcaagtgtagcttttgacattttgcttttgaaatgtctatgggacatcagaaataatctcaaaagaccacaagtcaggcagggcgcggtggctcacgcttgtaattccagcactttgggaggccgaggtgggcagatcacgaagtcaggagctcaagaccagcctggccaacatggtgaaaccccgtctctactaaaaattcaaaaattagctgggcatggtggcgggcacctgtaatcccagctacttgggaggctgaggcaggagaatcacttgaacctgggaggcggaggttgcaatgagctgggatcgagccatcgcactccagcctgggcaacaagagtaaaactctgcctaaaaaaaaaaaaaaaccatgagtcactggttaacagcctgagcggcagaaatctcacagttctgagtctgaatcctatctagcctggctctgaaactcacaatctggagctggggcttggtgcagtggctcaggcctgtaatcccagcactgtgggaggctgaggcaggtggattgcttgaggccaggagtttgagagcagcctggccaacatggtgaaaccccatctctactaaaaatacagttagccaggcatgatggtgtgcacctgtaatcccagctacttgggaggctgaggcacgacaatcgctggagcccaggaggcagacgttgcagtgagccgagattgtgctactgcactccagcctgggcaacacagcaacactgtctaaaaaaaaaaaaaaaaatgctgggcgcggtggtttacgtctgtaatcccacttttagaggctgaggtgggaggatcacctgaagccaggagctcaagaccagcctggccaacatggtaaaacccgccatcccctccctgccatgccccatctcccccaacactctcccaccctgtctctactaaaaatacaaaaattagccgggtgtggtggcacacacctataatctcagctacatgggaggctgaggcataagaattgcttgagcccggaaggtggaggttgcagtgagccaagatcgcaccactgcactccagcctgggtgacagagcaagactctctcttaaaaaaaaaaaaaaaaagaattttttttttaaatatagagatgggctttctgtgtttcccaggctatactcaagctcctgggctcaagctattctcctgcctctgccttcaaccagcctcaatcctccaattttcttattttttatatttttcaacaccttttaaattctacattctggccagctgcagtggctcatgcctataatccagcactttgagaggttgagatatgagacttgcttgaggccaggagtttgaggcttgcagtaagctagaatggcgccacggcacagcagcttgggagacagagcaagaccttgtctcaaaagaaaaagaatttaaatactacattctaggagatttcttcaaccttcaaattttgtattgaatttttaattttggcttttatttatttattttttttttgagacaggttctcactctgtcacccaggttggaatgcggtggcttgatctcagctcactgcaacctctgcctcctgggttcaagtgattctcctgcctcagcctcctgagtagctgggattgcaggcgtggtccagcatgcccagcttatttttgtattttcagtagagacggggtttcaccatattggccaggttggtctcaaactcctggcctcaagtgatccacatgcctcagcctcccaaggtgctgagattacaggtgtgagccactgcacccagccttggctatcatatttctaatttatgatagtttttcttgctttcttattgttcattttttatagcatcctgttcttatgttatggatatatatcttcaggtctcgctgaagaaataaagaggtgtatgtgtatatgtgtgtgtgtattatttttatttttattttttgagacggagtctcactctgttgcccaggctggagtgcagtggcacaatcccagctggctgcaacctctgcttcccaggttcaactgatcctcccacctcaatctcccaagtagctgggattacaggcacctgtcaccatgcccggctaatttttctttctttgtttcttttttttttttttttttttttttttgagatagagtctctgttgcccaggacggagtgcagtggtgtgatctcggctcactgcaagctccacctcctgggttcaagagattctcctgcctcagcctcccaagtagctgggattacaagcgtgtgccaccacacccagctaatttttgtatttttagtagagatggggtttcaccatgttgtccaggctgatctcaaactcctgacctcaaatgatccaccttcttcagcccgccaaagtgctgggattacatgcatgagccaccacaccagcaaaatttttgtatttttagtagagatagggtttcgccatatgtgtgtgtgttttaagtttttctgttttcatttctcttggcatatatacctcggaatggaattactgggtcatatgggagctctgtgttaaacacttgtgtcatatctaagaaaacttgctaatccaaaggtcataaagatgtatgtctatgttttcctctaaggccaacatggtgaaacactgtctctattaaaaaaataaaaactgggccgggcatggttgctcatgcctgtaatcccagcactttgggaggccaaggtgggtggatcacctgtggtcgggagttcgaggccagcctgatcaacatgcagaaaccccgtctctactaaaaatacaaaaaaattagcagggcatggtggcgcatgcctgtaatctcagctacttgggagctgaggcaggagaatcgcttgaacgcaggaggcagaggttgcggtgagccaagatcgtgccattgcactccagcctgggcaacaagagcaaaactcggtctcaaaaaaaaaaaaaaaaattagttgggcgtggtggcgcgcacctgtagtcccagctactccagaggctgaggcaggagaatggcttgaacccaggaggtggaggttgcagtgagctgagatcatgccactgcactccagcctggcaacagagcaacagagcaagactccatctaaaaacaaaaaaaagagttttctacttttcagtctaacaaatgttttataaacaaaggctttgttatattttgagttaatttttatagataatatgaggtgaggtttcaacttcattctattgtgtgtgggtatccagttgtcccaggaccattgtttgaaaagacttttttttctacactttctctcattgaattgtcttggcatatttgttaaaaatcagttgaccttggctgggcaccatggttcacacctgtaatcccagtattttgggaggccaaggcaagaagaccatttgagcccagaagttcaaaacccgcctgggcaatataggcacactccatttctaaaaataattattaaaaagattagctgggcaggccagacatggtggctcacgcctgtaatcccagcactttgggaggccaatgcaggtggatcacctgaggtcagaagttcaagaccagcctgaccaacatggagaaaccccatttctgctaaaaatacaaaattagtctggagtggtgactcatgcctgtaaatcccagctactagggaggctgaggcagaagaattgcttgaacccagaaggcggaggttgtggtgagccgagattgcgccattgcactccagcctgggcaacaagaatgaaactctgtctcaaaaaaaaaaagattagctgggcgtggtggcacatgcctgtggtcccagtgacttaggaggctgaggcagggggatcgggagacggaggctgcagtgagccttgatcactgcactccagcctgggtgacagagtgagaccctgtctcaaaaaagaaaaaaaatcagttgaccgtaatgtgagcactcatttctggactttcaattctattccattgatctatatgtcagtccttatgccagtgcccaggggctcaactactggtactgtgaattagattttgaatcaagaagcgtgagtcttccaattttgttcttatttttcaagattgttttgtctatttgaagttccttacaatttaatgtgaattttagaatcagcttgtccatttttgcaaaaaaggtagttgggattttgatagagattgtgttgagtctgtagatcaatttgggaggcattgctatgtgaagagtagtaagtgtttcaatccatgaacacacaatgtcttttcatgtatttaagtttaatttctttcaataatgttttgtagtttgcacttccttggttaaattcattcctaagttttttttggtgccattacaaatggaattgttttattaatttcatttttggattgttcatttctagtgtatagaaattcaactgagccaggtgtagtggtgcaccacctgtagtcccagctacttgggaggctgagtcaggaggattgcttgtggccatgtttgaggctatagtgcattataattgtgcctgtaaatgatcactgcattctagcctcggcaacatagtgcagtcttgtctcttaaaaaataaataaataaacaactgatttttgtacgttgatcttgtatcctccaactttgcaaaattaatttattactattaagactttgtggctgggcacggtggctcatgcctgtaatcccagcactttgggaggccaaggcgggcagatcacgaggtcaggagatcgagaccatcctggccaacacggtgaaaccccgtctctactaaaaatacaaaaaattagccaggcgcggtggcaggcacctgtagtcccagctacttgggaggctgaggcaggagaatggtgtgaacccgggtggcagagcttgcagtgagccaagatagcgccactgcagtccagcctgggcaaaagagtgagactccgtctcaaaaaaaaaaaaaaaaaaaagattttgctttattttgtgtttggtgtggatactttaggaaccaaaagataaataaataagaacaaggtctagcactttggtcaaatttattcctaagtgtgtgtttgtaaacgatattgtaaatgaattttcttagtttcattttcagcttgctaattgttactgtatagaaatacaatttatttatttatttactttttttttttttttttgagacagtctcgctctgttacccaggctggagtgcagtggtgtgatctcggctcactgcaacctctgcctcctgggttcaagcaattctcttgcctcagtctcccgaacagctgtgattacaggtgcgtgccgcaacccccagctaatttttgtatttttagtagagatgggttttcaccatgttggtcaggttagtctcaagatgttcttttttttttttttttttatcattttatttatttattttttaatttttatttttttttaaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcctgcctttctattccacaaagccgccattgtcatcctggcccattctcaatgagctgttgggcacacctcccagacggggtggtggccgggcagaggggctcctcacttcccagtaggggcggccgggcagaggcgcccctcacctcccggacggggcggctggccgggcgggggggctgaccccccccccaccggtcaggttagtctcgaactcctgacctcatgatctgctcacctaggcctcccaaagtgctgggattataggcatgagccactgcgccaggccaattttttttatatcactcttacacctgcaactttgctgaatttgtttacttgttctgacggttttgtggattccttagaatttcctacatacaagatcatgtcatatgcaaatacatatggttttatttcttcctttctaatttgtgtggcttttatttctttttcttgctaatttcctggctagaaatttaagtataatgttgaatagaggtggcaagagtgaatatccttgtcttcttcctgatcttaggagaaaaacttatagtctttcatcattaagtattacctgtggggctggatgcgatggctcaagcctataatcacagcactttgggaggccaaggcgggtggatcatttgaggtcaggtgttcaagaccagcctggccaagatggtgaaacccccatctctactaaaaacatctctactaaaaatataaaaacttggcggggtgcagtggctcacacctgtaatctcaccactttaggaggccgaggcgggcagatcacgaggtcaggagatcaagaccatcccggctaacacagtgaaacccatctctactaaaaatacaaaaaaaaaaaaaagaaaattagctaggtgtcgtggcacacgcctgtagtcccagctacttgggaggctgaggcaggagaatcgcttgaacccgggagacagaggttgcagtgagccgagatcacaccactgcgctccagcctgggcgacagagcaagactccatctcaaaaaaaaaaataaacgtaaattagacaggcatggtggtgcgcacctgtagtcctagctactcaggaggctgaggaaggagaattgcttgaacctgggaggcagaggttgcagtgagtcgagagcatgccactgcactccagccagggtgacagagtaagactctgtctcaaaaaaaaaaaaaaggatttatgggaagtaattaaggtcaaatgaggtcataaagctgggcactgatctaatagaattagtgtctttatgagacgagaacccagagagctccctagctttctctctgccacatgaggccacttcaagaaggcaagccaggtaataaagcccacgctgaggtaggaggtggaactggactccagagatggggcttggacaccagaccaaattgatgactagctgaaacagggacagggtgaaagcagctttccataagacacgctcaaccagtgcaccatgtcagcttaccatttccatggcagaacccagagttaccaccccaccgccttttttttgagacggagtctcactctgtcgcccaggctggagtgcagtggcacagtcttggctcactgcaagctccacctcccgggttcaagcgattctcctgccttagcctcccgagtagctgggattacaggcgcctgccaccgcgccaaactgatttttgtatttttagtagagacagtgtttcaccatcttggccaggctggtcttgaacttttgacctcatgatccacctgccttggcctcccaaagtgctggaattacaggcctgagccactgtgctcagcctaccacccctttcaatggcaacaacttgacaacccagaagttatcagcctttttctagaaacgtctgtatagtctgccccttaatttgcatgtaattaaaggtcaatgtaaatatgactgcagaactgccctgagctgctactctggtcacactacctacagggtagccctgctctgcaaggagcagtccctctgctgttgctataggccactgcttcaataaaagttggcatctaggccaggtgcagtgggtaatgcctgtaatcccagcactctaggaggctgaggcgggtggatcatttgaggccaggagtttgagaccagcctggtcaacatggtgaaaccccatctctactaaaaatacaaaaaaattagttgggtgttttggcgcacacctgcactcccagctactcaggaggttgaggcgggagaatcacttgaacccaggaggcagagtctgcagtgagccactgcactccagcctgggtgacagagtgagaccctgtcccgaaaaaaaaaaaagttggcctctaacaccttcggtttgcccttgaattatttcctgggtgaagccaagaaccctctcagtctaagccccagttttgtggcttacctgccctgcatcaacaccagaaacttaaccctttgggaatctcgatcttggactttctagcctctagaaccatgagaaaatgatctgtattattaggctacccagtctatgatattctgttgtagcctggggtgactaagacattgagcctgtatgacttgaattttgttacctgcttggccccttgatggcatttcagtttgtgactcttggtttacgtgatcacgaagccaaaactgtttaggaaggaagcaaaatcaagacagattaaaaataaaaataaaaaataaaaggctgggcaccgtggctcacgccctcccagcacgttgggaggcaaaggtaggcagataacttgaggtcagcagttcaagaccagcctggccaacatgatgaaaccacatctctactaaaactacaaaaattagccaggcgtggtggtgggcacctgtaatcccaggtatttgagagggaggcaggagaatcacttgaacctgggaggtggaggttgcagtgagccgagatcacaccactgcactccagcctgggtgacagagcaagactctctctcaaaaaataaaataaaataaaataaaataaaataaaataaaataaaataaagagccgagcacgctggctcacacctgtaatcccacacttcgggagaaagaggtggcaggattgcttgagcccaggagtttgataccagcctaggtaacatggcaaaatcccatctcaattttaaaaaaattttaaaaaagaataatagggctgggcacgatggctcatgcctgtaatcccagcactttgggaggccaagatggatggatcacctgaggttgggagtttgcgaccagcctgaccaacatggagaaaccccatctccactaaaaatacaatattagcaggtcgtggtggcacatacctgtaatcccagctactcggaaggctgaggcaggagaatcgcttgaacctgggaggtggaggttgtggtgagccaagatcgtgccattgcactccagcttgggcaacaagagtgaaattccatctaaaaaaaaaaaaagaaagaaagaaataaggtattttacataaagattaaaaagaaattaaaaccattatttgaagataatggcttaaacagaaactctgcaaatccttagaataagaaagttcaggccaggtgtagtggcttgtgcctgtaatcccaatgcattgggaggctaaggtcggaggattgcttgagcccaggagtttgagacaagccgggtcaacataatgagatcgcatctctacaaaaaattgaaaaatgagccaggtgtggcagtgcgtgcctgtagtcctggctactcaggaggctgaggtgggaaggtcacttgagcctgaagagttcaaggctacagtgttatgatcatgccactgcactgcactccagcctgggagacagagcaagaccctgagaccctgtctcaaaaaacaaaataaaaaaccctcactatattgaacacaacatcaatgttcaatagccactctccttctccttttctaataaaattccacttttttgtgttccatcccaggaccacgatttatctaaactggtcattctggatcaataagtttggctaaaaataaataatatcgaaattggtcacaggaaatctattcttttttttttttttttttttttttttcagacaaagtctcactctgtcgcccaggctggagtgcagcagcatgatcttggctcactgcaacctctgcctcccgggttcaagcaattctctgcctcagcctcccaagtagctgggattacaggtgcctgccaccacgcctggctagtttttgtatttttagtagagatggggtttcaccatcttggccaggctggtcttgaactcctgaccttgcgttctacctgccttggcttcccaaagtgctgggtctgtcacccaggctggagtgcaatggtgcaatcatggctcactgcagcctcaacctccctgggctcagatgattctcccaccttagcctctcaagtagctgggattaaaggcatatgccaccatgcccagctaatttttctattttttttgtagagacagggcatccctaccttgcccaggctggtcttcaactcctggtttcaaaggatcctcctgcttcagcctcccaaagcactgggtctattattccctttcatattcaaacttaattctgcattttcaaggccttgaattttcaagggcagctttttctgtccctgaacttaatcttcagctcctctcacctcctgggaggttggggggtggggaagaaaagtcccaaccctctaatcctgctttggtcttttgccgccagcccccatcctgaagctaccagtcaatttgtttgcatacaagaagatatcactttggagattctaagtgtatacgaggaaatgaggtcaaagaccaaatatatatatttcactatatcacacttcaaacttttgtttactgtttcccttctcctactctattataaacctttgagggtggggactgtgagttatttatctttatattcccagtgtcaagagtgtttagctataatgggaatgaatctcaaagtttcttgaataaatgacaagaagaatcatagttgcatgaactaaattcattattctcagtccttgaggtaaatgaatatattgatattatgtctgcttactctttttttgcgagagagagaaagaggagggagggagggaaggaaggaaaaaaggaaggaaggcgaaaagagtgaaagaaaagagagagaaaaagagagagaaagaaggaaggggagggaaggaaggaaaagaaggagggaagaagggaaagggagggagaggaagaaaagaaagaagaaggaaggaaagaaagaaagaagaaaaggagggaggaaggaacgaagaaagggaaagaaggagggagggagggaaatgaaggaaagaaagaaaaaagaaagaaagaaaaaagaaaagaaaaggagggaggaaggaaggagggagggaaggatggaagaaagggaaagaaggagggaggaagggacatgaagagaataaagaaagaaagaagaaaagaaaagaaaaaagaaaagaaaagggagggctctgcgggcggcggcggcgcggggagccggttgcaggccgagatgctgcagatggacctgatcgacgcgacgggggacactcccggggccgaggaggacgacgacgaggagcgcgcggcccggcggccgggagcggggccgcccaaggccgagtccggccaggagccggcgtcccgcggccagggccagagccaaggccagagccagggcccgggcagcggggacacgtaccggcccaagcggcccaccacgctcaacctctttccgcaggtgcagttgtctcaggacacactgaataataattctctgggcaaaaagtacagttggcaggatcgggtgtctcgatcatcctcacccctgaagacaggggagcagacaccaccgcatgaacccatttgcctgagcgatgagctgcccccccagagcagccccgcccccaccacagatcgaggcacctccaccaacagcccacgctgctggagctggtgagcctgcggccgtgcttcagagactacagtgacgagagtgactcggccatcgtctacgacaactgtgcctccgtctcctcgccctatgagtcagccatcggagaggaatatgaggaggcctcccggccccagcctcctgcctgcctctccaaggactccacgcctgacgaacccgacgtccatttctccaagaagttcctgaacatcttcatgagtggccgctcccgctcctccagtgccgagtccttcgggctgttctcctgcatcatcaaccgggaggagcaggagcagacccaccggaccatattcaggtttgtgcctcgacacgaagacgaacctgagctggaagtggatgaccctctgctagtggagctccaggctgaagactactggtacgaggcctacaacatgcgcactggtgcccggggcatctttactgcctattacgccatcgaggtcaccaaggagcccgagcacatggcagccctggctaaaaacagtgactgggtggaccagttccgggtgaagttcctgggctcagtccaggttccctatcacaagggcgatgtcgtcctctctgccgctatgcaaaagattgccaccacccgccggctaaccgtgcactttaacccgccctccagctgtgtcctggagatcagcgtgcggggtgtgaagataggtatcaaggccgatgactcccaggaggccaaggggaataaatgtagccactttttccagttaaaaaacatctctttccgcggatatcatccaaagaacaacaagtactttgggttcatcaccaagcacctcgccgaccaccggtttgcctgccacgtctttgtgtctgaagactccaccaaagccctggcagagtccgtggggagagcattccagcagtttcacaagcagtttgtggagtacacctgccccacagaaaatatctacctggagtagccgcgcagccccgccctctgcgtcccccggccctcaggccagtgccaggacagctggctgctgacaggatgtggcactgcttgaggaggggcacctgccaccgccaggggatgaggaagtgggggccgctggctcagggtaggggagggtggggcaatggggagaggcaaatgcagtttattgtaatatatgggattagattcatctatggagggcagagtgggctgcctggggattgggagggacagggcttggggagcaggtctctggcagagaaggatgtccgttccaggagcacacggccctgccccatcctgggccatacctcccctgccagggctcgggtgctctggctcctgccttgatgaagcccatgtcctgccttgatgaagcctgtgccacctgcaagtgcccgccctgcccctgtcccaacacccaccgaagagccctgagctcaggctgagcccagccacctcccaaggactttccagtgaggaaatggcaacacatggaagtgaagtccctgttctcagctctgtcatctgcagggcttctgggtggctcctgccactgacctcactggcatgctagcctgtggcaggcctaggacctcagcggggaggaggagctgctgcaaggccctatcccagcaggagagggaggcttcctgactgacacaggctagccccatcttggtcctgtcaccctggccccaactattaaagtgccatttcctgtcaaaaaaaaaaaaaaagaaaagaaaagaaaagggagggagggagggaggcaggaaggaaggaagagagggagggagggaagggaggaagaaagggaaagaaggagggagggagggaaatagaaagaaagaaggaaagaaaaagaaagaaagaaagagaaataaaataaaaattaaaaaaccataaggttaaagtaaaccctttttcttcatacagattaaaacacatgacttcaaattacagctttgcttcttaatagcttggtgatgtaggacgttatgtaacctctctgtgcctcagtttcctcatttataaaatagggcaataataatatctagcccataaggcattgtgaggattaaatgtgaaatgctgatcacaaatacctagcagcccaatagatactcactgtaataattattatttttataatttctgcaaaagtatggtgatgattcttgggttaacctaaaggcagattttcttttatttcttcctgtttcttttcttttccttgttcactttaaagaattaaaaagaaaattgattccagcattttggaataaaaatttgcatcaaaaagaatttattcattttattgacatacaaataaaatgtcatttgtttattcaataaacatttattaaatgtctggtaaatttcagacatcatgccaggcacagggatgacaatgacaataagatgtggtctctgccctcagggagctgatagtccaggagactgacaagtagacaggtgattacatgcaatgtaacaaaggctatgatgtcatacaagaagacaagtgggagtatgtgatgggagtatggttttgaccagttcctcctcttagatttatccctttttctttggctataaagcaaaagaattggtcctatttttttttcttaactttgcaaattaaaccataaattttaataactttataaagataaaaggcaagcggtcagattcagtggctcacacctataatcccaacactttgggaggccgaggcaggtggataacctgagatcaggagttcgagaccagcctggccaacatcgcgaaaccctgtctctactaaaaatacaaaaattagctaggtgtggtggcaggcacctgtaatcccagctactcaggaggctgaggcaggagaatcgcttgaacctgggaggcggagtttgcagtgagatgagatggagccattgctctccagcctgggctacagagcaagactctgtctcaaaacaaaacaaaacaaaacaaaacaaaaagatgagcaacttgaattatggaggacactagaaatagtgtttcctacagaatcagggcttcctaccaacatagtcacttctagggttttcgacctgaaaagttctgtggcatattgtttctttgctatccacttttttttccctatttttccccctctttctctcctctactttatctcctagagatctaggtagttcccaaaggaataatgctttacggagtctaatgttgatttattaggtaaaaacagaaaatgacttttttttttacccacaagttccataccaaaaaatgaatgtaaacttcttatgcagtttcacacattgaaaatgcaggttattttaattccattgcatttttcagaattctcaatcgcaatcctctgacaactgttgaagatccgtatctctttaaattactggcattaaaatatctgtaagtactatagtactcttgggagtcatgagatgatttatactctttttaaatttttcatcaaagattaagtattttgcatttaggctaaaatgtcataatttaaattttaactgagttattgaaaaacattattggcaaaggaaaggatgtgtaatggtcaagatagccagcaggggaaagagaacagtgttgaagaacccatatagatttggaacatgtagacacatggaggaatattacttaaccaagaaagcaaaggggaaaaggtgttcattattctaaaaaggaagaaaagagtaaataatcaagatgggtgaatgcaatatgaaaatgagaagtaagataatggtaaaaaaaaaaaacagtgtaagacctactcttgaatatcattaatttgatgatgcaaatcaactttaatttctttaataagagctctctggaattttgcggcaaataaactgttgaactggcttgttttatagggaagccaaaattgaagtaatcacatgtccttgaattatctttttaagtacagaattttttactggggttcatatcatgaatgtttcggctttcttcttcagagacgtgggaacaacgcaagtcccacttacaacacttaagaacattctcatgatgaccgttgaactggaaaaactgtaagttatttttttcttagacttattttcaccctgttgcgtttttaggtttgttttattattttcttaagtcaggtttattgagatataattttcatatactaacattcaccctttttaagtgtacaatttgatgagttttgacaaatgtatagttacataaccaccaccacattcccaatataaagcatttctgtcgcctcaaaaaggtccctcgtgtccctttgtagtcaatcacctcctcccaccgtcagcccctgttagctactaatctgatttcctatagttttgccttttccagaatatcttataaatgaaatcatatagcatgtagcctcttgtatttgacttctttcacttagcataattttttcttttttgagatggagtctcactgttgcccaggctgcagtgcagcggcatgacctagactcactgcaacctccacctcccaggttcaagtgattctcctgcctcagcctcctgagtagctgggattacaggcacatgccaccacgcctggctaatttttgtatttttagtagagacgaggtttcaccatgttggccaggctggtttggaagtcctgacctcaagtgatccgcccgccttggcttcccaaagtgctaggattacacgtgtgagccacctcacctggcctcacttatcatattattttttgaaattatgctgccatccatgttgctgcacccatcactacagctggccctccatatctgcaggttcctcatccatggattcaactgaacatggatggagaatacttgaaaaaaatgaaatatataaaataactataagacaataaaaacagtagaaaatttaaaatacagtataattatttacataccatttacactgtattaggtatttaaagtatacctgaggctatatacaaacattatgtcatttcatagaaaagacttcagcatctgtggactttggtgtcggcagggggtcctggagccaatcccctgcagacaccgagggacaactgttcactcctttttattgctcagtagtattccagttgtgtggaaaccccatctctactaaaaatacacaaattagccagatgtggtggcacacacctgtaatctcagctactcaggaggctgaggcacaagaagtgcttgaagctgggaggtggaggttgcagagtctcctttacacttgctgtcctccctccactgccgcctgacacactcctccccagcagtggcctcttcataggcaaatttaaggagcaccttttagtccttgtcctgcttgacttggccctgatgtttgaaattcttgataaatctttcttccggaaacacactctttctatgcttccaggaaatctttttcttggttctccagacaacttcttagactccttgaccaattccttcttgttgccaacaatggaaacaaaccagccctacctaagcaaagcacattaaaactcactagaaagatacaggggagggggcgcccactaaaccactaaagagacaggaggtggggagctgtaggaccaggtttgggaacctgcaagaatcaagaccagagcccctgaaatagcaagaagctggaagcacaggaactgtcagagccagatggctgtcactgcagtcagcgcctctgattgtttgtttttgagatggagtctcgctctgtcgcccaggctggagtgcagtggcatgatctcggctcactgcaacctccacctcccgggttcaagcaattctcctgcctcagcctcccgagtaactgggactacaggagcctgccaccatgcccgactagttctttatatttttaatagagatggggtttcaccatgttcgtctcaaactcctgaccccaggcgatccacttgcctcggcctcccaaagtgctgggattacaggcgtgagccaccatgcctggccagtttttgtatatttagtagagactggttttgccatgttggccaggttggtctcaaactcctgacctcaagtgatccatccacctccgcctcccaaagtgctgggattataggcatgaaccactgtgcccagccacctctgatagttttcatcgtcctcgggccactggctcccaaatcacggttccagacaaaagcttacaagtagtccagctttggccaggctcagtgtgatggttaatactgagtgccaacttgattggattgaaggatacaaaatattgatcttgggtgtgtccgtgagggtgttcccaaaggagattaacatttgagtcagcgggctgagaaaggcagacccacccttaatctgggtgggcacaagctaatcagctgccagcaaggctagaatataagcaggcagaaaaatgtgagagactggcttagcctcccagccaacatcttcctcccgtgctggatgcttcttaccctccaacatcggactccaagttcttcagttttggaactcagactggctctccttgctcctcagcctgcagacggcctattgtgggaccttgtgatcctgtgagttaatacttaataaactcctgtatatattccattaattctgtccctctagagaaccctgactaatacgctcagtgactcacacctgtaatcccagtactttgggaggctcaggcaggaggatggcttgagccccagagtcttcttcttctccttctccttgtccttctcttcccttcccctttctcctcttcctcttccttctcttcctcttcctcttcctctccttcctcttcctcttcttcctcttgtttgtttgagaaaggttctccctctgttgccaaggctggattgtagtggcacaattgtgactcactgcttctcagcctcctgagagcccaggagtttgaggctgcagtgagctatgatcacactaccacactcctgcctgggtgacagagcaagaccctgtctcaaaaaacaaacaaaaaactctggtatgatagaggtgaattgtctgttttatcctgataattctgcttaccttagtcccgtggttctcaactgggccaattttgctccccaagtgacatttggcaatatctgggcagaggtcaaggacgctgcttaacatctttttttttttttttttgagacacagttttgctcttgttgcccaggctggagtgaaatggcacgatctcgcctcactgcaacctctgtctcccgggttcaagcgattctcctgcctcagcctcccgagtagctgggattatgggcatgcaccatcacgcctggctaattttgtatttttagtagagatggggtttctccatgttggtcaggctggtctcaaactcccaaccttaggtgatcagcccacctcagcctcccaaagtgctgggattacaggtgtgagccacctcacctgtcctgcttaacgtcttaaaacacacaggacaattcccccataaaaaatgatgaccagccgaaaatgtcaacagtatcaaggtgaagaaattgccataaaggcttggtaaacagggatggtatgacgacactattgataggccacattaaaatacttagggccatatccattatccctgtttttatgatttcttctttgtccccatgcagtttcaggggcaaaataagggagtaagtcagaggtggttccaaatagacatctgggaatcttagggtgtaatatggccctcatggaggcccttgctgagcttagggcctgattctggaatcctagcattgccaagagaggcaggctggcaggtgagaagacaaataatgggagagcccacatatgttggaattcatttgatggtatctaagctggggtgattgtccccactagcattacatgactatggatccagttatttggagaaatccatttcctccacagggaatatatactacattagaaccaaagatggaatccttagtaaatggaatcatttggcaaaattcagttgtctgaaatttttgcataaaattctcttttttattttcattgagccaaataaataaagtatcaggtatttactggggtcaccattctttgattcattgattttttttttcagacaggatctcgctgtcacccacgttggagtgcagtggcataatctcagttcactgcaacctccacttcctgggcttaagtgattctcccacctcagcctcccaagtagctggaaatacaggcgcgtgccaccatgcctccattttctttctttttttttttttttaattgatcattcttgggtgtttctcgcagagggggatttggcagggtcataggacaatagtggagggaaggtcggcagataaacaagtgaacaaaggtctctggttttcctaggcagaggaccctgcgccttccgcagtctttgtgtccctgggtacttgagattagggagtggtgatgactcttaaggagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtatagaacaaaatgaaaagtctcccatgtctacccgcctctacacagacacggcaaccatccgacttctcagtcctttccccacctttcccccctttctactccacaaaaccgccattgtcatcatggcccgttctcaatgagctgttgggtacacctcccggacggggcggctggccgggcggggggctgacccccccacctccctcccggacggggtggctgccgggcggagacgctcctcaattcccagacggggcgactgccgggcggaggggctcctcacttctcagacagggcggttgccgggcggaggggctcctcacttctcagacagggcggttgccgggcggagggtctcctcacttctcagatggggcggccgggcagagacgctcctcacctcccagatggggtcacggccgggcagaggcgctcctcacatcccagacggggcggcggggcagaggcgctccccacatctcagacgatgggcggccgggcagagacgctcctcacttcctagatgggatggcggccgggcagagacgctcctccctttccagactgggcagccaggcagagacgctcctcacttcccagacggggtggcggccgggcagaggctgcaatctcggcactttgggaggccaaggcaggcggctgggaggtggaggttgtagccagccgagatcacgccactgcactccagcctgggcaccactgagcactgagtgaacgagactccgtctgcaatcccggcacctcgggaggccgaggctggcggatcactcgcggttaggagctggagaccagcccggccaacgcagcgaaaccccgtctccaccaaaaaaatacgaaaaccagtcaggcgtggcggcgcgtgcctgcaatcgcaggcacttggtaggctgaggcaggagaatcaggcagggaggttgcagtgagccgagatggcggcagtacagtccagcatcagagggagaccgtggaaagagagggagagggagaccgtggggagagggagagggagggggaggggagggggagagggagagggagaggtgcattttcttataaacccaatttcctctttagtgcaactctaccatttgaaaggaacctttctattgtaatttacaagctgtgaataaccgctatgtaattctttccaaggattaataaactgagagaggatttgaaccaacagaggtaggggaagattagaagggggatgcaagtggccacagatcttagaggcggccagcagagggcgctgctccaaggtgaaggtcgcaccctgagaggccatccttttttgtaggaccagactggggtgtaaggacagtgcctcatcctcacaacgacagacccgtgttctgggtgtggatttgcctcccttgcctgcgggacttctgctagcactgccgttcctagacttagaccatgctagaatgagtccaggaaccgaggagaggagatgggagtggctcctcccactgtggcccctaataattcacatgaagaatttttgctttccttgccagggacccgggactcagtgggtccagaggtcctagtgccaaaggaagaaatgtgtagatcaggaaatactattatggttttattcaactggaagccgaggctggccatttattgtatttatttatttatttatctatctatttatttatttatttagagacagaatctcactcttgtttcccaggctcccaggctcaagagatcctcctaccttagcctcctgagtagctggtactacagtcgcatgccaccttgcccagctaattttttttttttttgagacgcagtctcattttgttgcccaggctagagtgcagtggcgcggtcttggctcactgcaacctccacctcctgggttgaagcgattctcctgtctcagcctccggagtagctgggattacaggcatgtgccaccgcgcctggcaatttttttttttttagtagaggcggggtttcaccatgttggccaggctggtctcaactcctgaccttgtgatccgcctgcctcagcctcccaaagcactgggattgcagacataagccaccgcgcctgttttttttgttttgttttgttttctgacagagtctctgtcacccaggctggagtgcagtggtgtgatctcagctcactgcaacctctgcctcctgggttcaagcgattctcctgccttagcctcccaagtagctgggattataggcgcacaccactatgcccagctaatttttgtatttttagtagaggtggggtttcaccatgttggccaggctggtctcaaactcccgacttcaggtgatccacccacctcggcctcccaaagtgctgggattataggtgtgagccatcaagcccagccctgcccagctaatttttacactatgggcaagtatgctgcccaagagtgctctggaactcctgggctcaagtgatcttccttcctcggcctctcaatgtgcttggattacaagcatgagccaccttgcccagccgaagctggccatttaaagttcctcatgctgctgaatcaataaggatggaaggcggctactattatgggctaagtgtttgcatcctccccaaattctttttttttttttttttttgagatggagttttgctcttgttgcccaggctagagtgcagtggcgcgatctctgctcactgcaacctccacctttcaggttcaagtgattctcctgcctcagcctaccgagttagctgggattacaggcatacgccaccacacccggctaattttgtatttttagtagagatggggtttctccatgttggtcaggctggtctcaaactcccgacctcaggtaatctgctgacttcagcctcccaaagtgctgggattaccagcatgagccaccgcgcccggcccccaaattgttttttgttttttttttttgagacggagtctcgctctgtcacccaggctggagtgcagtggcatgatcttggctcactgcgagctctgcttcctgggttcacgccattctcctgcctcagcctcccgaatagctgggactacaggcgcccgccaccacgcctggctaattttttgtatttttagtggacacggggtttcaccgtgttagccaggatggtctcgatctcctgacctcgtgatctgcctgcctcagcctcccaaagtgctgggattacaggggtgagccaccacacccggcctcggcccccaaattcttatgttgaagccctcacctccatgtgatggtattagaaggtggggcctttgggacgtaattaggctgacagtgccccatgatgggatgagtgtcttaaaagaaaagaccaggtggtctggctagtggctcacccctgaaatcgcagcactttgggaggccaaggtgggtggatcacttgagatcaggcgtttgagaccagcctgggcaatatggtgaaaagccatctctactaaaaatacaaaaattagctgggcgtggtggcgcaagtctgtaatcccagctacttgggaggctgaggtgggagaatcgcttgaacccaggaggtggaggttgcagtgagcccagatcatgtcattgcactccagcctccaacctggacagagagagcatctggagagtctctgtctcaaaacaaaaagaaaaaaaaaagaagagaccagagagcctttcttctctttgtccaccaagtgaagatatggcaagaaggcagccatctgcaagctaggaaaagagcccttgccagcacccaattgtgctatcaccctgatatgggacttcccagcctccagaactgtgagtaatcaatgtctattgtttaagccacccagtatgtaatactgagctgactaaaaccatcaccgaactagcctctttacatatgattagcaagaggaaaatggctctgttacttaatggaggaaggaggctatgtctgaaagccaaaaattcactggggacacatcttagcaggctcttgaccctaagacctggttaatggaaaagtagagcaacccaataaaaacaagaccaccaagaagtcaggtcttatggaataaagtattgagtgtccctatgaggcacagaacccttcgaaaggggattggaagaagtggtgaagaaggcggctatgattatcaacttagacttcatcgccatttgtagaaggaggcttctaacagctatgttttatgttaattggctcttttctcttcttttttctttcaaccttatattaagagcactggcagaagctagcggttttggcatcctgtaattattagctgtataaccttggccaagtaactcaacctttctgtgcctcagttactcatctgtaaaacagggtaataagtctcaacctcgtacttatgttgttataaagatttaacactaggctgggcatggtggctcacacctgtaatcccagcactttgggaggccgaggagggtggatcacctgaggtcaggagttcaagaccagactggccaacatggcaaaaccctgtctctactaaaaatacaaaaaattagctgggtgtggtggcacgtgattgtaatcccagttactcgggaggctgaggcaggagaattgcttgaactaaacctgggaggcggaggttgcagtgagccaagatcgtgccactgcactctagcccaggcaacagagttagactctgtctcaaaaaaaaaaaaaaaaaaaaagtaacactttgaacaaaaaagaaaaaaataataaaatttaaaaaagatttaacaattgggccaggcatagtggctcatgcctgtaataccagcactttgggagcctgaagagggaggattacttgaacccaggagttccagaccagcctggacaacaaagcaagactttgtttctacttaaaaaaaaaaaaaaaacaccaaagtcaggtgtggtggtacacacctgtgatcccagctacttgggaggctgagatgggaggatcccttgagccttggaggttgaggctgcaatgagccatgatcataccactgcactccagcctaggcgacagagtgaggcccatgtcaaaaaaaaaaaaaatgatccccaacatttagcagcttaaaacaaaaaacatttattatatcacactttctgtgggccaggaatctgggagggacttagctgggtggttctgctcagttctcttgggatgtttcagtcaagcagtggcctggggctgcactcttatctgaagactcaattgggagaaaatatgcattcaaggtcactcattggttgttggcaggctgtagttccttactgaatattggttgaagacttcattggcttactacctggacttctccatagactgcttgaatgtcctccccacatagctagagtgaatgactaaaaaagagagagaacacacacagcccaggtaagagttcagtctttctaagtcattatatgaaagagattcttttttttttgagatggagtctcgctctgtcgccaggctggagtgcagcggcacgatcccagctcactgcaacctctgcctcctgggttcaagtgattctcctgcctcagcctcccaagtagctgggattacaggcgtgtgccactatgcccagctactttctgtatttttaatagagatggggttttaccatgttggccaggatggtcttgatctcttgaccttgtgatccacctgccttggcctcccaaagtgctgggattacaggcgtgagccaccacgcctggccgaaaaagattcttgcacacacatgtttatagtagcactattcacaattgtaaaaatgtggaaccagtccaaatgcccatcaatcaatgagtggctaaagaaactgtggtatagatatacagtggaatactactcagtcataaaaaggaatgaattaatggcatttgcagcaacctggacaggattggagactattattctttttttttttttttttttttttttgagatagagtctcacttggtcacccaggctggagtgcagttgtgcaatcttggctcactgcaagctctgcctcctgggttcacaccattctcctgcctcagcctcccaagtagctgagactacaggcgcctgccaccacgcccggctaattttttttttgtatttttagtagagaccgggtttcaccatgttagcctggatggtctcgatctcctgacctcgtgatccgcccacctcagcctcccaaagtgctgggattacaggcatgagccaccgcacccggcctattttttttttttttttttttttttttttttttttactaaccaggggtttaacataaatacaaccagcatagaaagacccaaaactatacagaaaccaaaaccagaatgccatgtggtggaggcaaagggcagaatttctgacccctttggctcagctgcccttccccacaaataaaaaccaacaaagaggacaaatcaggacaataaagaagattcatgctaagctgtggcagaggggggaaggtatgatcgggtgggggtgggataaggaatggccatggaagataactgggtcaggttggaccctgggctgggagggggagggcaaggcccctcaccacaacttaagccaaacctaagctgcccccaggtgccataggtccctgtcccagcagggaggctgatgggcctgggcccatgcccctccccacctttgggggtcagatagtggccacccaggtttgctgggttggggcctgatacaggctctgcatgcccattcgggctgcctgtggagagagaatggagtcactgtttaaccatgctacctgcctcagccccagcagaccacaggaggttggccccagactcactgagtgcctgcagcagccctacagacacagcatccttggccacctcatgcccatcccggccatctagggtcagcacaacccagatgaggccgctgaagggcaccggatgcccaggaatcaccacctggtaccagaagcggtgccagccagcaggtcctatgcccaaacacttggtgaggaacacagggctgcccagcttcattcgttggcacagcaactgcagggtagcccgagccccttgggaccctaacttgtcccttgccaaggccaactggctgccctctggctgtggggaccgcaaggagggacccacaagctgctggcgaagtcgctgcttcagttctggcttgagccactccacagccacctgctctccacagaggtgtggctgcccttcctccagggcctttttggccatggcagcggtccagtgcgagctgaatttgagcagagcgatctgcccgggcgcaggtccggggctgggcagcagccgcgcctcctgcaggccgggacccagcggctgcagcgcgggcagcagcgcgggcagcagcgcggtgcgggtcagattcggcggcaggcagtcaacgctcagctcacacttcccggtgctgcggcacacgagcagcgggcaggacggccgcagcgggtggttgtgcagcgggcgatggcggcctgcgcgccgcgccgcgagctgcagcgggcatatgcgaagccgcggttcaggccgctgaaggtcatcatcaggcggaactcgtagaggcggcccacgcgctggaacagcaggatagctggtgctcatacacttcctgaggcagccgcccgatgaacacctctgacccagccggcggcgggctgcccacccagcctgggggtggcccgccatacttcctctgcccgttcacctgcaccaggcgatgcctgtctccctgacccacgcctccagcgccgccttcaccctctcacaccacagctcacaatcccgcttggactgcatggctctctattctcttttttttttttttttttttgagacgtagtttcactcttgttctccaggctggagtgcaatggcgggatcttggctcaccgcaacctccgcctcccgggttcaagcgattctcctgcctcagcctcccaagtagctgggattacaggcatgcgccaccatgcctggctaattttgtatttttagtagagacggggtttctccctgttggtcaggctggtctcaaactcccgacctcaggtgatccacccacctcggcctcgcatagtgctgggattacaggcatgagccaccgtgccccgtctatggagactattattctcagcgaagtaactcaggaatggaaaaccaaacatcgtacgttctcactcataaatgggagctaagctaggaggatgcaaaggcataagaatgacacagtggactttggggaatcagggggaaaggatgggaagggggtgagggataaaagactattaattgggtgcagtctatattgcttgggtgatgggtgcacacaaatttcacaaatcaccactaaagaacttacttacgtaaccaaacaccagctgttccccaatatcctatggaaataaaaatttttttttagaaaaagagttcggtctttctgtaacctaatcttggaagtgtatattatcacttcttccataggctatcagtctcccagaccaaccctgctacagggtaggggagactacatggtatgtgaataccagaaagtgggggccactggggactggctatttggaggatggttactacaaactatatttgtaattttttttttcttgagatggagtcttgctctgttgcccaggctggagtgcaatggcacgatctcagctcgctgcaacatccacctcctgcgttcaagtgattctcctgcctcagcctcccgagtagctgggattacaggcacgcaccaccacacccagctaattttttgtatttttaatagagatggggtttctccatgttggtcaggctggtctcaaacgcctgacctcaggtgatctgcccgcctcggcctcccagagtgctgggattacaggcccgagccatggtgcctggctatatttgtaatattttaaccactaaaaaaaaaaaaaagaagaagaagaagaagaaaaagaaacaagtatgggaaaatattaagatctgataaaaccgggttatacttatgcaggtattcattacattattctccataactttttaaatgtttaataataaaagtaaaaatattttccccttaaaaatgtgcagagcatacctcaaataatgttgacaaagaatcctaaagacaattattattattattattttttgagacaggttcttgctctgttgcccaggctggagtgcagtgatgccacctgagctcactgtaaactccgtctcccgagtttaagcaattctcctgtctcagcctcctgagcagctgggactacaggcgagcaccatcatacctggttaatttttatattttcagtagagacggggtttcatcatattgcacaggctggtcttgaactcctggcctcaagtgatccacccaccttggcctcccaaagtgctagcattacaggcatgagccactgcaccgggcctctcaaactcctgacctcaggtgatccacctgccttggcctcccaaagtcctggcattataggcgtgagccactgcgcccggccgatcttccttcctttctcccttcccctcttcttcttcttcttcttcttcttttttaattaatagagatgggattttgccatgttgcttaggctggtttcaaactcctgggctcaagctatctgctcgcttcagcttcccaaagtcctgggattaagggcgtgagccactgcgcctggccccagtaaggatttaaaagctcaggaattattagtcagcttccttttttgttcatcctgttgtttgttcatttcagtctattccctttttataatttccttcttcataaggactatttctccttgtacttttgtgagaattcccgtaacttgtaatcccagctacttgggaggctgaggcaggagaatcacttgaaccgggaggcggaggttgcggtgagccgagatcaagccattgcactccagcctgggcaacaagagcaaaactcggtcttggaaaaaaaaaaaaaagaaaagaaaagaaaaaagaaaggaaggaagatcctcattggacagagcaaaaagcagaattgatggcactgaaaatgaaatcagcagctgatgtacaagttccagaatgtctcctagagtaacaaggaaatccgggtgtggtagtttatgcctgtcatccaagcactttgtgaggccaaggaggttagttagcttgagcccaggagttggagaccagcctggccaacatggtgaaaccccatctctacagaaaatataaaagttagctgggtttggtggtgggtacctgtagtcccagctactctggaggcgaaggagggaggatcacctgagtcccgcgaggtcaaggccacagtgagccttgatagagttttgccactgcactccagcctaagcaacagtgagaccctgtctcaataaacaaacaaacaaacaaataaataattgtagagacagaagataaaatggagcccggtgcagtggctcacgcctgtaatcccagaactttgggaggctgaggtgggcagattacttggcccaggagtttgagaccagtctgcccaacatggtgaaaccccgtctctactaaaaatacaaaaattagccaggcatggtggtgtgtgcctataatcccagctacttgagaggctgagacaggagaatcgattgaacccaggaggtggaggttgcagtgagctgagatcacaccactgcactccagcctgggtgacaaagccagactctgtctcaaaaaaaaaaaaaaaaaaaaaaggctgagcacggtggctcatgcctgtaatcccagcactttgagaggctgagccgggcagatcacctaaggtcgggagtttgagaccagcctgaccaacatggagaaaccccgtctctgccaaaaatacagtattagcaggtcgtggtggcacatgcctgtaatcccagctacctgggaggctgaggcaggagaatcgcttgaacctgggaggtggaggttgcagtgagccgagattgtgccactgcactccagactgggcaacaagagtgagactctgtctcaaaaaaaaaaaaaaaaaaaagagagagagacagggtttcaccaggttggccaggctggtcttggactcctgacctcaagtgatctgcccgcctcagcctcccaaagtgctgggattactggtgtgggccactgcatctggctcccaccatctctattaaaataagataaaataaacataaaataatgaaccgacaaaataataatacaattcattgtaagtaaaatgctatcctgagttctgtgagtcattctggataattcaaattctctagaattaccacctcagctgactttttttttttttttttgtagagaccaggctggtcttgaattcttgagctcaagtgatccgcttccctcagtctcccaaagtgctggaattacatgtgtgagccactgagcctggcctacaaattctttattatacaacacacagtagatgctcaataaatatttgctaagcagaaacatacactcaaaataccagaaattatcaaggaagttgccagttggtctcttgggttcttcctcccgacaggtatacacacctattgtaaagatgaacacattaggctgtgagaaaccaatactgttaaacattccaatcaggtgacaaactccctgggctctggtttatattaccaagcaacctgatgataacttggcttcctgtgtggcttgtttatagaaagagaatgctacccaggctgacgtgagttgcatttctgagttgatttctcactgtaaattaataaactggcattctggctacatagatcagtctctttgaactctttgtaccttccaccattagtgtgatttctaaggctgcaagccagacactgcccaagacccagcactggactctggtgagttcttccagctgttgccaccccaggaggctctgggagcccctgggaaccatccagcttgctctctgtctctacatttcagggtgtgggtttcagggcattcacaacattcctgcaacagaagagttttgggaacacccccagcaggatgtgggtgatttgaatgtatgtcagagatgtggttgtaactgagaaatcttaagcctagtgaattttattccacttgacttaaataaagagcacgtgaaagaaggggatctgaggacatctatgaacagggccccgagggcatgaacttactagtgtttatatgactagtgtttatctgggcctgtctagtctggagaacctgactctggtgtacccaagctttgcagtggctgtagaggtttgctcttttggagggagaagataattcattcctccaacacctgaatgagggtagattaacccacctccttcagctgcaatttggcaaatttctcttctttgatttaatgctcaacggacaaatttcctttcttcttcttcttcttcttcttcttcttcttcttcttcttcttcttcttcttcttcttcttcttcttcctcttcttctttttttctcctcttcttcttcttcttctcctccttctccttcttctccttcttcttttctcttccttctcctcctccttcctcctcctcctcttcctactcttcttcctcttcctctcctcctcctcttcctcctcctcttccttcttcttcttctttctttttttttcggttttgagacagggtctccgtcacccaggctggagtgcagtggcacgatctcggctcactgcaacctccacctcctaggctcaagcgatcctcccacctcagcttcccatgtggctgggaccaaggcgtgagctaccatgcccggctaatttttgtattttttgtagagacagggtctctccatgttgctcaggctggtcttgaactcctgagctcaagagatcctcctgtctcaggctcccaaagtcctgggattacaagcacgagccaccatgcccggcctcaacaggcaaccttctgattaataattagacctctgtgccggccgtcgtggctgatgcctgtaattccagcactttggaaggccaaggcgggtggatggcttgaggtcgggcgtttgagaccagcctggccaacacggtgaaaccccgtctctgctaaatatacaaaaattagcctggcatggtggcgtatgcctgtaatcccagctacttgggaggctgaggcacgagaatcgcttgaacccgggaggcagaggttacagtgagctgtcatatataatgaaacagttttactaaacttaggaagcagtgacttggtgtctctagaaattgcctaacatacacattccaggatacattctctgtcatctggaatctcctcccttccacaaacccacgctgtcttaagcactattttcctatttgttgttgacctaatctagaaaaaagcggccatcactctttctcccccactcagtccctcagtcccgaaacacccttattctccgcacttgtcaccccaccctctgctgcccccaccgcagcgcgcaaacgcacacgagtttaaagtttaggctgtgatgctatcctcgcccgcagatcacaggacagacattctcggggacaactttgcgaggccatgtgctcgtcccccttaggaaggaagagggagaaatccctgcggctcggttttgttccaatggtctgctcagcgagtgattcccgtttccccaaaggctgcccctcattagcatgaacggggacgcgggtgtggagaaggggttagaggagagaaagcaagcaaaagcccaggctcacttttagagcctgggaaccctgtctgcaaaaatgacagctagagctttctggctcctctgtttaatcgtcggatcatcccccgaagctccggtggagagaaaaagtaagatcggtgtagtgcggagccctgggagcggagcggggatctggggagggggcgcccaggcctcagccgccggccgacaaccgggccaccttccgtgaggccgcacacgctcccacaggcccgcgcctggcgcaagccgagaaccgcgcgtcgccgcgccgcgggcccgcgacggaggaagccccgagacgcgcgcgctcacgggccctacgcttccccgccgcccggccgcgcgcgcgcgccgccgagggccccgccggccctgcccaccccaaccggccgcgcgccgttgtgccggcccccggctcgccgcccgcgccgccgccgcgcctcagcttcagattcggcctcagtcagccgcgcagggacgcggagcccggcgccgagctctgcgcttgcgcttgccgggcgggcatggacgggcgagaggcgttctgcaagcgcgaaatcggtgagcccggccgccgcgccgccgccccgcgagcctttccgagtcccggagaatcctgcacgcgagatcccagggcgcccgacccatgcgggccgtttcgctgttgctaaaaaccaacgcccagggactgggagaggaactggggttcccaaactgttttttggaagcagcgatgaacgggatagtgcatgacgtggacgtgctgggcgcgggcatctggctggtgaccctgctggtggatcgggacgggctgtacaagatgaaccgcctgtacctcactcacccccgacgtcttcttcttccgagtccacatgttagtcctggactcctccagctgcaataaaccgtgtccagagtttaaacctggtattgaaactgagctgaatgacgctgcatatgtactttataccaccgtttgtaacgtgggtgccacagcccgggctgtgggtcgtccagtctttttttgggacggatgggggacagtattgtaacatgattaggatttagacgacaggtattatttccgccactgtgatttaagcaccgtcagccccacccccacgggtgagaacggcagctgttggcacaaagcgggctgtcaataaatagatgttgacaaatggagtgagcgaccaccaaacaccattgccagaagggactgtacagaactgagtttagaaaagctgcttttttgggggagtgtgtggagggttggtagcggggaatacccactcccacatcttttttttttttttttttttttttttagacagagtctcgctctgttgcccaggctggagtgcaatggcgccatctcagctcactgcaacctccgtcccccaggttcaagccattctcctgccctcagcctcccaagtagctgggattacaggctgagccactgcgcccagccccactcccacatctttctaggcatgtgctctgggaaatcctgatacaatgtgataaggacctttgttctgtaatgtgggctggttacgtattgctttcccttccccacaccccgtgctactttttgtatttttagtacagatggggtttcaccatgttggctaggctggtctcaaactcctgacctcaagtaatctgcccgcctcggcctcccaaagtgctaggattaaaggcgtgagccactgcactggcctggttgggttggttatcttctaaaggtcgctagactgtttccaccttgcctgtagactaaatatcagtttcaacttgtgcagcaagatagtagattgcagcttaggtatttcttaaaggccttatattttctgtttcatggcatttaaaagacgctatgaattaatgttctggttattttgtccaggcagcaggtatattgtgatgggccacatctaccataagagagggcagcttcctacagctctgctccaggtcctgagaggccatctctgtccaggggatggactgctgaggagcagcagcagctatgtgaaaaggtttaacccaaaaagggaagggcaaattcaaggtgcaattcatacccaatgcatttgaaacaaccatcctggcatttctggatcacaagagacatcggcaacaagacatgaaaggtctatcttcatgtaatgggtcctcctttagaagagagcccaaagctactctatgaatgacctgcatagttacaactgtaatctcgaaggtgtcactttgttatttacaagatgcttcttaaatgggctgctcctgagctcagtgtcaaggtgattcaactgttgtgccagacagtgatttacacagctcagataactgacctgtctagttaacagatcactgcttcatgtttttaaatattttaatttaatacattctttagtagaaatagtccacaaaacattttcctgaatttaaatacacaacttttatatcatgtatcaaacctgattttatattcaaacctgatttatattcaaaacttatatgtgaagattaaattcttcacataacagtaagcgcactagtcaaaagacatttacctatgaaacgtcatttagatcaaacacaagggtcaaagcccaggacaaggattaaaattttacacttaaaaagtaccaagccgggcgcggtggctcacacctgtaatcccagcactttgagaggccgaggcgggtggatcacctgaggtccggagttcgagaccaggctgaccaacatggaaaaaccctgtctctactaaaaatacaaaaattagccgggtgtggtggcacatgcctgtaatcccagctgagggaggctgaggcaggagaatcacttgaacccaggaggcagaggttgtggtgagccgagatcgcgccagcctgggcaacaagagcaaaactccgtctcaaaaacaaacaaagtgtacaaaagggccagtgtgcggatgggtggattaaaaaaataaattttaaaaaagtgccaaagggcttacttcaggcaaaagtgttcctgatgtaccaaagagtaagatatagtttattttcatgcctccctgctcctaataatgtatgttttgtgctgaactggcagctatcccaatgtgaactgtattctgagtgtatctgatatcatttttctattaagaccaagtataatgtttgcttgtaaagcaataaatcttgctttgaaattagaccttggatgcacctgtttatttttgttttgttttgttttagcctttgagccctaaaggtttgagaaaaagcctttctcaaattcattccccaaaccttggaaccaatattaaccaatgacagctcacaagcaagtgaattctaaacatttttcagttggttttaaaaaggtttaatcactagctaaattaaatattgattttatacctgagtccacaaagacatgagagtattttttcagaagataaggctgtacttcagtttataagaagtacggtgaacagagacaccactaatgcatagatgaagatgactgcctaaagagagacaggggaaggaatttcactggagagagagcagcctatttggcctcacggtgatgcactcaggaaggtcagaatgtgtcctgacgctgtccatggcacccagtagtagcactgtacacataaaggacatccaggacgggacgctagggaatcacaggagccaagaggcaacagcctaacattacaatacctgatactattatttgttccaattatggggcagacaggtaataaagagttgagaggttctgagtgttctatggtaaagcactactgagagatttctagagtattttccaaaaatgagttttgtccaaatttattataaattttactagaattgctttttgggagtcagatgcattattgcatgatagaattatagctaatgaagagcttctgagctagttttctttaagataaaaaaaattaactcaggcataactcaggccagtcaaatcaaagttgaatttttaaatgtcaaaaggctaggccgggagctgtgactcacacctgtaatcccagcactttgggagaccaaggcgggtggatcacaaggtcaggagtttgagaccagcctggccaacatagcgaaactctgtctctactaaaaatacaaaaattagctgggcatggtggtgcatgcctgtaatcccagctattggggggcaggaggatcgcttgaacctagtaggcagaggttgcagtgagccgagatcatgccactgccctccagcctgggcaacagagcgagactctgtctgaaacaacaacaaaaagtatatctatatggctaatttctttagttgaatttggttcaaattggatcaagtggtataatcttctaagaaaagtcttttagtatctcactccaagtatctagaaataccttagaatgtttcaaattattaaaaatacttctcggttggctcttccctccacctcctcaagtacttcattattttatccatggaatatccccattctcacattaagggcaagaaatctgagacctatggtaatagtttcttttttttttttttttttgagaaggagtttcgctcttgttgcctaggctggagtgtaatggcatgatgtcagctcaccgcaacctctccctcctgggttcaagtgattctcctgctctagcctcccaagtagctgggattacaggcatgcgccactttacctagctaatttttttttttttttttttttgtatttttagtagagatggggtttctccatgtttgtcaggctggtttcaaactcccaacctcaggtgatccacctgccttggcctcccaaagtgctgggattatacgtgtgagccaccacgcccagccgtatcatgatagtttcaatcaggaagagtgaaagctgtaataaccatgtaactttgtctaactaagtgtgcagagatctgaaagtccaccaggttggctctttaacataaagaagtagagagtttgcctaaaggaattagcagaaatagggaaataacttttatttgcagatcccaggaaggtagattacaaacaacagcaaatcttagtgtctctaaataacactctaggccatttggaatataaaaaggtaattattttacttcagaaaatatctccaaaagttcactttttttttgagacagagtcttgctgtgtcgctcaggctggagtgcagtggcacaatctcagctcactacaacctctgcctccccagttcaagccatcctcccacctcagcctcctgagtagctgggactacaggtgtgtgccacttgtccagctaaattgttgtatttttagtagaaacagggtttcaccatgttggtcaggcaggtctctaactcctgaccttgtgatctgcccgcttcagcctcccagagtgctgggattataggcgtgagccaccatgcccagccacaattttatttaaacctcctgtagaatttggataggagaataaaagctttaccaataggaaaatacttttcatgaaatggtttcaaggattgtgaacttggcaggtgaagcataacagttattgaaaatacttttagccaaggaaatctactgatgcaaattaaatatatttacaagcccaaggcctgtggtagaaacatcctaagagtatcacaaatgtacagtttactgcctggattattgaaagcaaaatagctgtgttatatagatcttaatagcagaagctttcaaagattactcacagaaaagcagctttcagaactcattatgttctaaaaaatgtatgtttttctttcttttttattttttttgagatgaagtctcactcttgtcccccaggctggagtgcaatggcgtgatcacggctcactgcaacctccgcctcccaggttcaagtgattctcctgcctcagcctccctagtagctgggatttcaggtgcctgccaccatgcctggctaatttttgtacttttagtagagatggggtttcaccatgttggccaggttggtctcaaattcctgacctcaggtgatcccccctgcctcggcctcccaaagtgctggggttacaggcgtgggccaccacacctggccaggaatgtgtgtttttcaaaaattacttttgaaagactaaagccctatagttgataaaactataaaatgtctttatgtatttgtatggtgatagaaactgtaaaacactttataccattaaatacacatgaaattaatatcttcctggtctcaggatttccataaaatttaccctttttaatttggcaatgctaacagctacagaagacatattaccaccaaccaaccgttgcttcattagaaactgcaccaaatccaatgtcaaaaacattactttatttttctagtatgaaatgtcctattacatacaaaagaattgctgtttagaatttgccacaatttgttgaaaacatagcaatctattgcctacaggtaggaaagttcttgctgcaacaaattttaaatgattaagcccatatatatttctatatatatgaataaatagtgcagaaatactgtgacgtgatgagatgcagaataattttataattcattaaaatgtagaattcttgcatcagcacagtgcatacaatatgtaactttttttaaaaagtaaaaggacaaaataatccatatttaagtatttccatcttaatattttaagcaaaaatgttttcatgttttcatattgagtgattagtctctttagtttgtaaacataggtttaagtgacatcttcatgtacaaaaaggaatgggcttcattagataaaattaagccagaataacctgtacacctgagcctgtaataagaaagaattgggaactgtagcaacatctttcttttaagaaaccaaggtctgggaaaggttttgcatagcagggaaacgttgaaaggaaggaaacttttaaaagcaataattagataaattccagaagttgataggacaaagctaatatgagttagaataaaatctagtagaatttttgcaaagctgcataatccagctatggcagattttatagaagctattaccacaatgcagtaatacaatgtgtaagaacattgaaaggaagaacatgcaaaatacatcttcctcattttcttcctactgcttacactacttttccttacatggaagaaacaaacaaaccaacaagcaaaaaacaaacccaatcaacaaataacacagaggatgagatcatctaacaaaaaatgtccttcatacaatataagtagctgtctgtaattggtaatttgcccagtatcacagaatgtacagatgaaggcaatgtgtatcttgtcgcattacctttttcgttagtatgatcaactgatgcgacaggattagcacccctgaagattcttctctgacgtgatgacaattgactgggaatgataaaacgaggggccactgctgtccaggagaattccaggtacaattagattcttttgcctttcatgaccttgcagccctccctccccacagaggcttacagataatcattagcacacattcaaagacacctctgtctgtgggagaaaaactatctccatttattttgtttcacatacatccatagttgaattttaatacaaaaagaaaaattagaatctgacaaatgtttacaaagaagataccttcaaatagattttactcatttcaacctggtgtggagtaattgacaaattgtactgttatattcaagtcaccagagtctgtagtccaggaccacttagcccaacctttatgcaagcttgattttaatctaccatgaacaataaactcattgttgattcgcagttgtgtgtgtgtgcacatgtgtacatagcagctcctttcatagaaagaaaagacatctagaggttgtcttgtacttttacgtacaggaatcattgataagatatggatggattatatgtaaccgtggctggattttataagaaaaaataattagttgacaaatgagggcagcaataaaaaagcatcttttttgcaacaataaataaatacagtcaaaagttttctttgagactctaaaccagcttcttcactgaagagcagacgtggcatttccatggagttatacttgaccccacagtatcattgtttcttgctttctttttcttttttttttttaataaacaaaattttctcgcttctgccacaataataaaaccatttgatcttgacaagataatggtgtcgttgacttttcttttttctttttcttttcttcctttttttgtttttgaaacggagttttgttcttgtcacccaggctggagtgcaatggctcaatctcggctcaatacaacctctgcctcccgggttccagcgattctcctgcctcagcctcccaagtagctgggattacaggcataggccaccatgcacagctaattttgtatttttggtagagacggggtttctccatattggtcaggctggtctcgaactcccgacctcagatgatccgcccgccttggcctcccaaagtgctgggattacaggcgtgagccaccgcacctggcaactttgcttttttcttgtccattggacaaaattggccaataatataattggactgttatgaccaataaaaacaaagtttaggtcaagtcttgtcaggatagcctcactaaaaagatctggctccttaatttaaaatagttcaggcaacaagattcttgctgtgttttatgttaggttaacatgctgaactttaggaagctgtagactgcagtttgttgttgtgagacctacagagtatagaaaaagggaacaattgagcacctttcatttttgaaaatgatgctttatgcggatgccaaagtaaataaatctggaagaagcagccatgttctttcattcacccttggcaagcgaatagaaaagaacgattaagaaatttttaacctataataataaaacttttcactgtacactaagcataatagctcactggaaaaagccaatatttaaaatatgtatgtatatatatttgtctaataaagattacaacattttcaggcaactggacaaatagagacatttacagaagcattaccattgtggtgaaaggtgcgtgtgtgtgtgtatgtgtgtgtttatttacacggatgaggggaatataaagggaaaaattatgctaaaacaaaagaaaaagcaattttaaaatcatatttttctattaaagtccagaaagtctcccagtttcacacagttttattcacaattttttttttttttgagacgaagtctcgcttttgtccccaggctgtagtgcaaaggcgcgatcttggctcactgcaacctctgcctcccagattcaagcgattctcctgcctcagcctcccgagtagctgggattacaggtgcctgccaccacacccggctaatttttgtactttttgtagagacgaggtttcaccatgttggccaggctggtcgcaaactcctgacctcaggtgatccgcccgcctcggcctcccaaagtgctgggattacaagtgtgagccaccaaggctggcctcacaacttttgtcagtaaaccaaattactgtacagttaccaggactaagtcaaaggactttatattgcaatagcagataaatttatattgcaatagcagataaatacagtattccaatagtttacaatttttaaatacattgtttcacgtggctgctagaataaattttttaccactatacatcgttaacattaaaaaattatattagctaacctgactttttggggggcaattttggattacgtaatcacaaggtacaataaaacagtgaccccaacatccagttctgattccagttaaaaatttagactaaagatatcacaatccgtaagaaaagaaagaatatggatggtataaatgatgaattataacaaagtgcagtaatgaaaacaatgtgcaaacaatgctggagatcataaattacaatgggaaaatatggcaaaggaaattctggaaacccataataaaatcaagtttcaataactggctagttatgtttcattctaccttaaatctggaaagcaatagaaattccctaaaaatgcaacagcaagttgtctttatacaattctttgcattgtaatttttttctttttttctttttttttttttttttgatttgtttgttttgagacagggtctcactctgtagcccagtctggagtgcagtggcacaatcatggctcactgcagcctcaacctccagggctcaggtgatcctcctacctcagcctcctgggtagctgggactacaggcacgtgccaccatgctcagctaattttttgtattttttgtagagatggggtttccccatgttgcccaggctggtctcaaactcctgggctcaagtgagctgcctgccttggcttctcaaagtgttgagatcacaggtgtgagccactgcacacagcctaatttgtttatttaagcagaattgagcaaacgtctccattcagctcccatgtgctttattgaaaattatgtcaacttcagtatattaaaaagctacataaaataaccaggtggcaagaagacatcctaagtggcccctacactatgcgggcc

SEQ ID NO: 1825 - DNA, 6673 bp, Homo sapiens
tgttggttttttttttcgaaaaacactttattggaataatatacttaaaatgcagggaacttttaaaaatagagtgaggccaggcatggtggctcacacctataatcccagcactttgggaggccgaggcaggcggatcacctgcagtcaggagttcaagaccagcctggccaacatggtgaaacccgtctctactgaaaatacaaaaactagctgggtatagtggtgcatacctgtaatctcagctactcaggaggctgaagcaggagaatcacttgaacgctggaggcggaggttgcagtgagccaagatcacaccagtactccagcctggatgacagaggagactctcaaaaacgataataataattataaaatagagggtgaaagaccaaacatcctatagaaaaataagcaaaagataaaaattaattcacagagagatttgttctttaaagatatataaaaagatgttcagcttcacttaataagagaaatccagattaaaattatactgaaatatttctaacccatcggactggcaaaaattcaaaagctggacagtgtactatattggtgaagttgtggggaaatgggcactcttacattactagtagaaatagaaaatccttaaacctctatgaaggagaatcactaataaaactatgtatgcatatagttactcattaacctagcagttctacttctagaatttatcctgaagatacgcccctaataacacaaaaatacatatgtaaaattttattcattgtagcattgtttatatttccaaaacattggaaactatgtaaatgcccacacataggagatagattaaactacagtgtatttatacatggagatactatgtagctgtaaaaaagaatgaagaaaatctctaccaattgatgtataatgattaccaggagattttggtctctgactacaggagtctcgctctgtcacccaggttggagtgcagtggcgtgatctcggctcactgcaacctctgcctcctgggttcaagcgattcttctgcctcagcctcccaagtggctgggattacaggcacccgccaccacacccggctaatttttgtatttttagtagagacaggatttcaccacgttggccaggcaggtctcaaactcccgacctcaggtgatccacccgcctcagcctcccaaagtgctgggattacaggcgtgagccatggcacccagcctccaagagatacttttaagtggaaaaaaagcaaagtgtaagagagcatatatagtgtattacctccttttgtgttaaaacaaaaaaaaaaagaaaagaaaaagaaagaaaaggaagaaaatgtacatacatctgcttacctttactaaaagaatacaggaagataaaccagaaaacagtgaaagtggttgcttaaagggatggtgaggaggacatggtaaagagagtcactcttctttgagcatatcttttatagaatttttacttttagaaacatgttaatgttctacatattttttaaatattaaatcaataaggatagaatgtaagaaatgggactaaaactgaaagcaaactgaaaaacatgaacccaactatttccaatcttttcttaagtaaaatgagctccccaaagggggtaaaaaagagaaccaatctaagttacatgctgaacacagtatttgactacaccagagaacagaaaattaaccctaaactctttttagtagatttggatttttttcttttaaagttagggatgaagtgacttggaaactattttagatgtattacaaaagtgagtaaacaaataaatttgttgatatttttgggagctaggttctcactataaaagaaggaacatacaaataatgggatgaggaaaggcaagaaagaaccctgtggagatggactagaattggaagtactggtgtcagctcaatttctaaaataggtctctgtacacatgtatacgtatacagttatggatgtaagtgtgtgtgtgtgcatgactatgtatacatgcatacttcccagctctgttcattaacatggtctagaagcaaagagcacagctgccacccagatcttggtctctaataccattctgtgctaaaaagaaccagttatcctcagataaatggctgattccagggcatagtagagcccagaacattatgccagaacataaagaagggatcaaaaataatgtgatggcatatccaatgacacgggagccaccagcctgaacggctcccactggcaaaaactggaatattttaaggaccaaattaattaagggctgtaagggattataaaccattgatttaaaaagaattgtgggccaagcatggtgtctcacacctgtaatcccagcactttgggaggctgaggtgggcggatcaccttaggttgggagtctgagaccagcccgtccaacatggtgaaaccctatctctactcaaaatacaaaaattagccaggcatggtggctcatgtagtcccagctgctacttgggagactgaggcaggagagtcacttgaactggggaggtggaggttgcagtgagctgagatcgtaccactgcactccagcctcggtgacagagcaagactccaccacacaaataaaataaaaataattgtgcattcttattgataataaatagattttaaaataataaatgggagaagaggtaggctcttgtttatggtagaatggtgagggctgactggtaaatgtgaaaatcatttcacagctgcagttggaaaatcatcacagtatgagttgcttcagttaaaaattatgagtggatactcaatctgggagggggttgggacttttgataaagaacagaatatttatgtgatttttttttttttttgagatggagtctctgtcgcctcggctggagtgcagtggcgtgatctcagctcactgcaacctctgcatcccggattcaagcgattctcctgcctcagtttcccaagtagctgggactacaggcacccgccaccatgcccagctaatttttgtatttttagtagagacagggtttcatcatattgaccaggctggtcttgaactcctgaccttgtgatccgcccccctcggcctcccaaagtgctgagattacaggcaggagccaccatggccagcctaatttgatttgaggatttgctcagtctgtcttccttccttctttccttccttccttccttccttccttccttccttccttccttccttcctctctctctctctggtctctttctttcttttttctttttttttgagatggagttttactcttgttgcccaggctggagtgcagtgacatgatctcggctcactgtgacctctgcctcctgagttcaagcagttctcctgcctcagcctcccaagtagctgggattacaagcaagtgccataacacctggcaaatttttgtatttttagtagagacgaggtttcaccatgttggccaggctggtctcaaactcctgacctcatgatctgcctgcctcggactcccaaagtgttgggattacacgtgtgagccaccgtgcctggcctatgtgatcttaaattgtctattcacaaactgcttgttagatgcaagggaaaaaataggtactatacaatggagaagtaggacaacaccttgatcaggtggtcagaattcctatcaccagtgcacagcagatggacatgatgtgcctctaaatgtgacactttgagaaggatccatcataatgtgtgtagtagtctgcctgggtgtgcatagtctgaacttaatcatgagaaaatattagacaaatccaaaattagaatcagtctattaaaaatgggaaaataaataagtaatgggataagcgcgtcagacacagtggctcacacctgtaatcccagcactttaggaggctgaggcgggtggattgcttgagtccaggagttcgagaccagcctgggcaacatgacaaaaccccatctactaaaagtacaaaaaaattagccaggcgttgtggtgtgcacctgtggtcccagctacccgggaggcagaggtaggagaatcacctgagcctagggagttgaggctgcagtgagccaaaaaaaattatgccactgcactccagcctgggcaatcagagtaagaccctgtctcaaataaataacaaataaattaaaaatgaggtgaggtaagttatgactatattcttcaaaaatgtccgtatctcaaaagtcaaaatctgaggaaatgttccagatttttaaaaactataaagataccacagttaaatcctgaactagactctgttccagaggagaaaatttccataaaggatattattgggtaattgactaaattgaaatatggacagtagattagataacagtgttactgaagttgatgttgatgtccacactgtagctatgtaagagaatatccttattctcagaaaagatacactgaagttttcagaagtaaaaagacattgtaaatgtaacttcctctcaaatagttcagggaaataaaattgtatgcagagaaagagtacatgcaaatggtgcaaaatgttaacaatattgtgcacctgggtagatgatatgcagatgctttttgtactatttttattcctgcaacttttttctgaatttggaatccttttcaaataaaatacattttaagcaggctaataattaaaaatctaaactaagattatattgggaaacattatgctaagtgaaataagctagacacaaaaagacaaatattgtatgatctcacttatatgaggtacctagaataggcaaatttatagagacaaaagtagagtagcagttaccaggggctagaagtaaagaggagtggggagttattgtttaatgggtacagagtttcttttggggtgatgaaaaacttctaaaaatgcatagaggtagtagttgcacattgtgaatgtacttaatgtcactgaattgtgcatttaaaatttgttaaaatagtaaattttatgttacgtatatttttcaaaataaaaaagtatcttggggatgtttacttccattataaaaggattccctacaattatttaaatataagctccctttgtttatttaaacaattttatacagctttcaagattcacatcagatactttttgaagattccacttataactgattatgtagtatctgtatttcattttagttggtttttaaaaatagattattgaaaaactgacattcaccttgggcaaaggtcttagcttttttcagcatccaggttctccacttgtcaaagcaaaagattcttcagaatacttcattcatcatctagttctcttagaaaaaggatgctggtggttttgcttcacaaaaatatttcataaacatgagctttttctttttctcacaatgatcataccaggcggaatgaagaaaacagatgttgcttataaggcgtctaatagacatgtttgcattgtaagctgatctgactctgaatttggcatctgctccattcactgtgtggactgagcattttcgcctcacagtttggcagaaaagttaatattgacttttgactgttacctgaaaacttggtgataaaatactcttactaaacctcttgagagagtgattttacagtctcagcaaatgtctttaaaatacatcattctattaaccattttaattttattctttggttgggaatacttatttgtttcatctaatacagagcattccccaaatctgactgggaaaagtctgtgtggtcagaatggtagaagaaggaggacataaatcacttataatgttctctacaggtcattataccacagcttctcaattaaccttcatccccctcaggctgcccagggcctcagggaaggcccagaagcctagctgcagcacagtttctcattattatctgctcttctgagtatttgagtgttaactgcagcagctcagcagctcaggtttcccctaaggggaaggtagcccagattcttctgctcttgacctgtcttatttgcaattatcctttttttcttttttcacagttttattgtggcataatagacatacaataaacggtatgaatctaaagtttacaattgtataactttggacatatgtgtacacccatgaaaccatcactatggacatatccactgctcccatggccttttctaatcatgccttcctgctccttctcatccccttttggattgtttccagtttggggctattacaaataaagctgctgtgaacattcatttacaagtctttgtgtggatatgtgctttcacctaccttgggtaaatacctagaaatagaacggatcatatgatatgcacatgtttagctttttaagactgacagatggtttgggaaagtggtcttagcattttacattcccacaattagtgtgtgagagttccagttgatcacacccttgccaacacttgttatagtcagtcttttcagttttagccattctgcgagtgtgcagtggtatctaattgtgattttaatttgcatttctttaatgaataatgatattgaacattttttcatttgcttatttggcatctatcttctttgctaaaatgttaaatacttttgcctactttgtgttgagttgtttcttgttattgaggta

SEQ ID NO: 1826 - DNA, 61720 bp, Homo sapiens
atatccctaaggtgtgtcatgtaggaaaaagatttagaattattgccttcccagatgagtgataatcactgttatgaaaattatccactactgatatcttccctatagaccccttaagtaaaaaaatgtgggacatgattgtgactaaaccttctttagtggttctgaatagtcctaatgatgactgcctgcactaatgagggaagtggaaggaaacttagggacaatgacctgatcattgtcattcacaggacacctgaatgagtgaaactccggtgccattctcagtaagcttttaaatgagacttaacaagacacagcctcctggtagacctccagactatagttgttttggttgtggttattttaattagtatttatttacataattagcgattatgtaagtgggtcctaccatttgttgaaacctcctggggtcaggcactgtgctaaatattttatgtacataatcttttcaaattatcagtgagtgataccaccaaactctatgagtgaggtggtagtattttcattttcggatgaagaaactaaagccagtaaaggtaggttagtttgcccatggttttccagttggtaagtagcagacctcaaacccaaattcaggtctgtttgtttccagaactccaaatcactgtactcaaatgccctttcacacccataccttccatggtgcttttccctattccaggaagttccataatgtataataatatctcttcagcaaccattgccaagattagctgatgatgctcagtccagtttcataatgtctcagtccttgcagattacagagattacagagatttgaaggtaggctaaggttagcatttcttgtagacaacacctcttttttcaggggaaattagattttaccgtttaaaaagatgaaaccactcaaaggtgtgtacatttttgaaaagtgcttgcctctgaattttaccttgctatttcatgccatgtgttatttccttaggcagagactttttgatatgtcattaaacaactttgaaaaaatgaatttggaaggaaaataaacccagaatatgttataaattgcttgttgtgttggttttcttttacatgtatatgtgtgtgtgtggtttttttctgtatgtgtggttgaaatcttcgaaagtactgtttgtcacatacctgaggacctgtgtatttcttctgggtagaaaaatgtgtggttttgttgttgttgttcttgtttttgagatagggacttgctcctttgcccaggctggagtgcagtggcatgatcatagctcggtgcagccttggcctccatgacttaagtgatcatctcacctcagcctcccaagtagctgggactacaggtgcaagccaccatacctggctaatgtttaaatttttgtggagttggggtctcgctgcattacccaggctggtctcaaactcctgggctcaagctatcctcccacctcagcctcccaaagtattaggattacaggcatgagcctctgtgcctacagaatattttgtacttaaaacttttgtatatattattaagatcatcacttggtgaatgctaatcgagggccaagagtagaaattcacccaaagagttgaataagttgtatgcaatgtaccaatagtcactgtggctagagagagcatggtctaaataggaccactcagaggagaacagagacctgggccattccagttcttgaagatcccagtatacttcaacaataaaaattttataaaacgactacttttagatattcagtttttcagtgcatctctttctacatgaataactgtatttgtagatagtgccaaacatgcacatttgagatccttttcgaatatgtattttctcacactcacagacatacagcgcacacatcattttacaggtgagacagctcatgttcggtgacctattagcaagactgaggacctgagcttgggttcatttcttgatctccagctagttccgccttcttctcttctgaaggtcccaggtattggcttgtttgcttatcttataactgctgcaaactagctgttctttccaatcttttttctctctctcctgtaccagggtcagagaggaaaatggtctcagcttttcagttatcttctcaagcctaaataagcaaatatatctggtagtttttttttttgttttttttttttaaagatattttcccttaacttagaaatgaaacaaattttcagtggaatagagaggtgagaaagtaagtaaaaaagtgaaaacatcaacagaaagacaagccagagacggggagaaaatatttgcaaaagacacatctgatgaagaactgttactcaaaatatacaaagaactttttaaaacctaacaataagaaaacaacctgattttaaaagtgggtcaaagatcttaacagacacctcaccaaagaagatatacagatggcaaataagcatgtgaaaagatcctcaacatcatgtaccattagagttgcaaattagaaccgttaagatatcactacctacctgttagaatggttgaaatcccaaacactgacaacaccaaatgctggtgagaatgtggagccataggaactctcattcattcttggtgggaatgcaaaatggtacagctactttggaagatggttttgcagtttcttgtagaattaaacatgctgttaccatatgatgcagctgtctctctccttggcatttatccaggggagttgaaaacttatgtctgcacaaaaacctgcacatggaacagaagcttatagcagctttatttgtaattatcaaaactcggaaacaaccaagatgtccttcagtaggtgaatggataaatgtggtacgttgacacaatgaaatattattcagtgctaaaaagatatgagctatcaaactatgaaagggcatggaggattcaatcttaaatgcattatactaagtgaaagaagccagtctggaaaggctacatactttatgatttcaactctatgtcattgtagaaaaagcaaaactttggagacagtaaaaagatcagtggttatcagggacttcgtgggagggaaaaataggcagagcacagagcattcttagggcagtgaaattattctgtatgatttacaatggtgactatatgtcattgtacatttgtcaaggcccatagaacaggttttgaagttgatgtgatgttgacagtccccggggaggctgtgcctgcgtatagaaagcagcgtatgggaattctctgtactttccacttgattttgctctgagccggaaactgccctgaaaaataaagtctatatttaaaagaatagtcgtagatactagacacagcatttttatcagcattttaaaatatactatatgcaaagataatattatatggtcaagaataactccttaatgtataaatttaaaagcaccatgaaatctcttaagaaacaatcagaagttttataaaattttaaaaaaggaaagtgaggaaaatgcctaaattaaacagtaaaacacacccagttattcaacaccaggtggcgactggactgggtctggatttttcttagcttgcctgactctgtgactgctgctctctgctttcttgggctccttctccctcaatcttcctgtttccagaacagatgctttttatgtcctcttgcctgtggtgacatcccaggatcccttccatctgcagttttttcttacctgttaaactttatgaggaggaaaggagaaaatattgattatttacctgttttgtaataggcattataatagatgcctgttgtaatctcttttaatcctcacaataacccacatgaaggagtgttattctccccattatatatattaataactaatgtgaaagatgatataatttgttgaaggccagtgaattgtaagtgatgtagtttggatataaaccttggtttcaaaattcaagacacggtaatctgtccattctgtaagaagcaagcacataagtgctaatgatgagtgtttggtcacacacaaaaaataaagatttactaacacatttatttaagaaaactcagacttaagctacatttggttcttaagtgtcttcttcaaaaagaaaggcaatcttgggtaattcctcacctgacttttagaagtgtgctagacctctgtcttttaaaaatgttcagcctacgtttatttttattattcttgttcttcatggtatctttctttccttttctccttttttgagatccattaaggattttactgtgatttataaactttcttctggaatggtggttctccacctgaggtgattttattccacagggatcatttggcaatatctggagacatttttcattgttacagctgggagagggtgctactggcatctagagggtagagccgagggccgctgctaaacatcctaccctgcagaagacagccgcctcaacacaaaattatctagcacaaaacgccagtagctcaaggttgagaaatgctgaactagaggtgtgggcttattatcaggatagcatagcactggattcccattagaatccatagtgtcttcatagcactggattcccgttagaacatttcatgcagcctggtgcttcaattacctggcttccctttttgtagcattggcattagaatatagtttagtctgactacagaagggagaaaatacctatgtaacaaaataggtgaactgacagaattttggtaaaagagataaaacatagtagggtgataggtctacacattttaaaagccagtttgcagtcagtgttgaattttatagtttaattgtgcaatttaaactgtttgtttattctccatgagtgtttcacgttatgcctttgtgcctgcttcagtgctgggggacagaccttctaccctcctggttcatgttgcctctgtcttccattcctctttgctggaatgtgtagttgtggtaactgtgacaattcctaaggtttctgacagtttttgaacaccacaatggtgctgtaaattcctgtcttggccaggagatggacaccacattttgatggtttctcaaaccgtgtgtgaccttttcctggtttctctgttctgtcagtcatggcatggctggacagaattcagggacatctatcaggcctctcaggagcaattaaattattttcatgaaggcaatttgcagttgtaaacaatattgaagacactgtgtggcatttctcattagctaaaaaaaaaaaaaaaaagatagtggcaacaatacaggattatctgactcgataattagccaggcatggtggcacacgcctgtaatcccagctactcaggaggctgaggcaggagaattgcttgaacccgggaggtggagtgagccaagatctaaccactgcactgcagcctgggcaacagagcaagactctgtctcaaaaaaaaaaaaagattaaaaataataattaggagggagaataaacgacatcttggttttttaaaagtcctttttatgccattaaagtgtggcttgtggtttattattacatttgtatgcaaccttggtactgacatttttatcaaaagatattggagagatttcaggaatgaggagttacattccctttatatcttgttgccagaaattactcttaagcaaaataaattctgcctgaaataaaaataaaatgagaacacagcatatgcgtgtttttggctctgtgatctatgcaaatagttatgtattaactcattaattaaaatgggcttattctacacacacatttctaccattggatttttcttcttaaaaaataagcagagcagagtggggaggcggcaagaggacctgtggcaggccctcttcggccatctctctggcctggtttccctcggcgtgccactgtgtgctcagtccagcaccatggggaagcgggacaatcgggtggcctatatgcacccaatagcaatggcgagatcaaggggtccaatccagtcttcagggccaacaatacaggattatctgaattgaccaaggcctacctgggaagaagtaaaagagcaactagaaaagaaaaagaaaggttccaaggctttggctgaatttgaagaaaaaatgaatgagaactggaagaaagaactggaaaaacacagggagaaattgttaactgcaagtgagagctcatccaaaaaaaagacagagaaagaaaaaagaaaagaagaaatctgataggtattcatcttcttcatcaagctctgattcttccagcaattcttctgattctgaagatgaggataagaaacaaggaaaatgaagaaagaaaaagaagaaccgttcacataaatcttctgaaagctccatgtcagaaactgaatcagacagtaaggatagtttaaaaaagaaaaagaagtcaaaagatggaactgagaaagaaaaggatattaaaggactcagcaaaaagagaaagatgtattctgaagataaacctttatcatctgagtccttgtaagaatcagagtatattgaggaggtgcgagcaaaaaagaagaaaagcagtgaagaacgagaaaaagcaacagaaaaaacaaaaaagaataagaagcataagaaacacagtaagaagaaaaggctgttagttcaagtcctgactcaccataacattaagaaaaatcaggattcccttataaagaaagtgcaatgtctgaggaaatttcaactgtgaaaactacaacatatttactaacatgcatgaattttcttgtttttagaattattcctggactattcagtagccactcagatgctactgtgtgaaagggccataaatgttgcctgctgcttgaacatctatttttttctcttccagtgcttgataactctgggagataatacactgcagtcatactagtggttaagatatttgggaataaaattaatacttttgactagaaatgtctaaggataaaccaacagaaattgaatctggatacatctttaagatgtaatcagaaatgaccagatgactctagttaaaatttttgaaggagggattacattaatatttcaaaacccttactctgtaagataagtgtagtttaatttttttcccctcgtatacttttatttacctggggaaggagcttttagggttgggggggtggtttgctatctctttagctagcagaatagtgtgcctttgatcctcacacatcctgtattatgaacacagtagccatacttcacggggaggtcagagctggctaccagcagtcttgccctttactgagcttagtgtcatccttggatgctgtcatatgctgctttgagtgaaccagagaaacagccatttgcagcatgagaaagccccaaaagctctgggatttacctccacttcagtaataatgaatattttttagcattagaatgtgttaggtcatttgaattaatttttactacactttggcttgggagaggaattattttaaatagacactggtacttttcgaacttgatagctaaagattctaaaatgcatgttttatactaagttttaaccagtcaggaaaattttatgtaaccagtgatagtttatttttttgtatgaattttgtttaggctacaatgtttagcttttgttaactcctcactcttgctgtcttaagttcattactatgtttaatggcgtacttgccaagatatttagcatgtaaaaagcagggttttgattaaaaaaaaaaaaaaacagcttcatattgaagctgagacttacaataacaagttgagtggcaagcctggtatgctgtgtcttattgccagaatcttagtaaatgtaatgttttaaaagtttattgtctttgtatattaataacaaagtatgacaagttaagtttaaataagagttaaaaaaataagcagagaacttcttctatataagcacgtaaacagtaataccattatttttgtagctgcatgaaataccattgcatgtatatgtaggatatggctataatatacatttcaacagatttgatgacattgggttgttttctcttttgtctacaatgaatttcaaatttagttgcctacttttacacattttttatgttgcgtaaattcttaaaagtagaatttttaggtcacaggatatgagtaactttaatattttttaggattgtcaccttgtccttccaaatgactcttgaactcctactaggcaggggctggattctggaaagagaaacaattgttcttgctcctctttgccaatactgtgctttcctgtcctaggccaatctaaatggtggaaaaaaaaaacaacaacaaaaaaacaaaaaaaacctcatgttgtcatatgcactttcttaatagaaaagttgagcattgtttaatctgtttgtggaacacttatttatatcactctgtgaattgtttgcccttcccttttgttggtttattcatattctttccctatgttagtgagttgttgtcttagttcattttggctactataccaaaataccttagcctgagtaatttgtaaacaacagaaatttattgcttccagttctggagactgggaagtgcaagatcaaggtgctggcagatttggtgtcagggcctgttcctcataggtggcaccttctatgtcttcacatggtagaaggggcaaaaaacctccctcacatcacttttataagggcactaatgctatttaggaggatgcagcccttatgacttaatcaccttccaaagtctccacctcttaatactgtcagcattgggggtaggtttcaacataggaattttgtgggcatataaacattcagactgtagcacttgttcatcttttttttcctggtaaaattagacttttaaattgttttttctattgtttgtcttgcccaaactgttccctcctcgccaccaatgcttatttacaagtaattgatggataatttctatatcaaactagaatgaaatgaattgaccttaaatactaataatgtgttaatttttgaaggactataggaaagtatgtattaacattaaggccattggatttccaaaataaattatctaaagactaggtcctcaatattaatagcatggaaatgtgtgtgtgtgtgtgtgtgtgtgcgcgcgcgcgtgcgcgcgtgcgcacgcccgcgtgcttatgggtatgtgtgtgtgcgtgcatgtttgccctgatatgagaattacttactgtattatacaatagtcattgaatttctgagttttcttggtgtaacagaaagatgatacaataagttgtttggttttatttctatgtgttgggatttgaattctaattttagggtaaaatttctgaattttttctaatccattatattcaagggaaggaggacatataaacttcagtatgttattttgaattggctcatattccatttctactttgtctccatttctagaatggtatccatatgtaaaagtatttaatttttggtatggtttactttctctttaacactcagtttaattaactgagaacaaaattcaccttctgtgctgtgcaacttcagaggtgccaaaatagcaccttatattaaaaaatatcttggaaatatttttgagtgctttgaataaagtttttccagcaacattgatttatattttgttcctcaactcattatgctactttacacctgggttgtgtctgctatggaagggcatcctccatcctcccttttccaactggccaactcctactcatcctcacacatccatcccaggtggcatgtcttcctggaaagcttcacacacacctccagatggagcctaacactctctttcttgcaccagctcagcaccttattcatgcttacatttgggcacttttcttttttttttttgagacggagtctcgctctgtcgcccaggctggagtgcagtggcgggatctcggctcactgcaagctccgcctcatttgggcacttttcatgcttgtattgcatcagcctagacatttgccttttctttggactttgagctcatggacctatgtcaaagaccagtatgtcttattcctttccatgtgcgcagtgcctgccagaaagttggagtgataaattatgagttaaagtttacattatcattagatttaggataaatttgaagttaattcaacagttatttaagttattctgttatcttttgaataacttttgagaaagtaaaaaatggccctggcagctgacaggccacataatgttcccaactgaacataaatacctcttgcagaatataaataatcagacaagcctacttcttgagtatgtctgaaacaagactgagaaaggaccctttccaactacaaaagtaattaaacatccctctcttatgactgacatgaatgattgctgcttctttaccgatgatgactccaactcagctttaatcctctgctttctagattaaatttgccaagataatcagtgaattgtccctacctcctgacagctcccagtccaaacctggcctttagtttcttaaacctttcttggaatcacccaaaacaaactgaaatagtatcctaagtatccaccagtttcttaaaattctccagttactttggtgtactctttcttgctgtcgtaagtgaatgaaagctcaatttatttactacaagagtgttcctggtggtctttgattagtgggcactagagtgagtgttggagtaatttaagaaagaaacatttatctcagtctctgccctttggatacttagagtttgcctggggattctggccctacttgctttaaataaacctttaaagtggcattgtttgctgtcaagactagagtagaggagaagagtgcaagtcacagctaaggaaaatattccttaagtattgataatttctagtgtggatctcaaagggctggggcattctgtgtgggaaaggctgagagctggggagaatcattatgtgttacaggaagagaggagactattttttgaaagggaaagtatttgaagacttggtggccaataaggttggacaggtagaggagatcggtgacagccggtgaccttgtgagaactcatctacagacagtgaaaatcccggggttcggggtggacacaggagataattagtaggaaggggttaaaatactgaaagatgagtatagtaggtcgtatttgatgacaggaggatcagagagtcttttttgaaagatgagtcagcaggacatggtaacttgataagagcaaggaattgggtggtgggctgctgtagcagatgcttttgatatggtcttggcccacctgtgagttcacccacagtggacatctcccatgcatgccaacagctttccatctcaagggcctgatctgtgcttctctaccggagcacattgtcagccctgtggaaatttactcttgctgcagagcagcctcgaagtataacctttactcagtgaagggctggagtcagaacacaaatgcccattttccccttctcttcgtgggacaattctgaagcacattatttatgtcttttcagaacatcctagggacattgacccccagcaggaatgtggcataccacccccttccatggtttttctctctccccagtcaggctttcctcacttcctaacttatgctccctgggatcacctccccagttcactatgccagactaaccaacccaagttcttatctcaaggtgacttttgggggaacccaaactaagatgggtatcttggataattgggttaattattatgccatggaaaaatggaattgggattctttcccaggttaattaatgactgctgtctagtgaaaaaatgactacagtcatctcaagtgtattttatatatcagtgcaggaatatggcaaaatgctttagaattcgtggcttgttttgaggaaaaaaaatatgctccaaaccatctgcaaaagtattacagtgatctcaagtggaacataggcacttgaagcagtttccaggcacattagattgttgtcaacaagaagaaaaatatatgccatggggaggagcaagaagaaagagagggtctagaaatccatgattttagcaagtcaggaaaaataattttcagcacgtaagcagggcaggatccctgagctccttcacctggaagtcatccaggtggtttaagattctcaggctattggcaactatgatgtggctcctgccaggttaaggagcattgatgattgatcacaagggaaaggacccagccatatgattgtttctgtcagcttgtactctcctgaaagtcatggttaatgacttgagccaagttaggaaaaatatttccgttactaacaatatagttgttaagtatgctccatggggattctgaaatatttacttgacagtaatgagctttagaatttcattcttttcctatgattcttcatgatcacatttgcatccagatctttgaacactcagcacttgatggagtttaatagactaatggcaagaaaattgctcataagtaaaggaagcagtgaatccatccggtttccatgagcagtcatacctgagttcttcagcaattggaacagatgcgtcactgaaaagatgcctgcactggggtggtcctatccattacattctcttaggaaatgaagccctggctttccttagccctgtgatctattttgaaccttattctagcggagaaggaatagtgtttattgattttttttctcctgttgtctattatttagagattcttaattctactaaaataagttgggagaacacatattgtttgtttagtatttaataaattttggagaatccatataatcactttacagtattctcatcaatcacatgaattaagtaataaaataataaaacatttgaattcttaggaacatgtattttttaatcagaaaatattcacctccgtggttagcaaacctcatatacaggaaaataaaattaggccatgatcacgttagttatctctgagagagcacttttagaaataataatctagaggacaatgatcagaaaaggaagaagtagcaactaatacttaaggatacctacctatgaaagaagatggtaatagatagggtagtttcttggtgcatcagtgggttgaggtgaaataagtttattttatagttttgtttttgtttcctttaagaataaaggaagcttatttgagtgagcttctagactgaggaagtgtagattgacaatagaggaaattagagggtggtgtttaacctggagcgaccccttgcaggggtagatttaaggtaacaggtgttaaggctgtggttaactagttttgggcttgttcacctcactttgtgaattcttccactgacactttgctcattttattgaaataactgatttcaatttctggtttctagtcttcagttctgctaggtatggtctcagacttaatgatgaaaactgttgattctgccagacacatgcccaataaaatgcttagcttttagcagatcctcaataaatatttattaaaactaatttgaacatattttcctgagtttgggaagaagggagtgagacaaataaaaattataatgtatttgatgtaaactggagaaaattcagtgtaaattccctctactttcctcagtctgtttggagataaagtcatctcctgggagaataaggggatggattagagactcgaagacactggggagtgttcagaacagctgcttatggaaaatgcatggaaaaaaattaaaaacttgccaagatgaactgaatatccagctgaggctgcatggtatgaacttgttgagtttcttaggatagttctatgcctttttctagttctttggtcactcaaaagtggagaaagcagagaggggttatctttggtgagacgggtatggcagaaagcctgaggactggggattttggagtgtttgataaaaagatgaaatgttcagctgaaggttgtgatggcacagagagaatttcaagccagcaggaaggctagagagggcaggggctggagtcataataagctagaaaacttattatgtgttctctagcttgttgcctgtggggttgaggacattcaagattgtgttggtaggaggctgtagccacagaaggaatgatagcttaaaaatcttaagaggttgagtggtctggattgtgataaagtgcaatttacagctgggcttatgggttgctaatgtgtaattactctcacaatttggcaattctcagcatctttaggagtgttgtctagcaaaattaaattagattctttaaacaagcaaaaagaaacttgttaatgaattacaaccaagtaagatggaaacagttagtgtcaacatgatgagtttgtgagattctatgtgactttaagactttgagcagccaagctaatgttcagttcaaagtaattgaatttcatgtatggaagaatgccttatgaaacagccgatcagtgcttttgctagccagttttgaaatgttacatgtccaaacacctcataacttatgcatgttctccagtgagaattacatcataggttgaaagaaaataaatgcatccatgattcttagatgttacataatctaagcacttaataacttcctagttacataatctgtagttattatataatctcatggctctttacaaagggggaaatcaaactattctcagagaaattcaattggatgattggatgaaagaactctgtgtctgtgtgtgtgtgtatatgtgtgtatgtgtgtgtgtgtgtaattttgcacatatacaaatacttaagtgctggttagaattgatctgaccctctccctgactgcttttcccagcccactccaatgaacaactgggtcatctttcagctccagaacattaaaagttgtgacctgtgccatcccaggactatgtacaggattccttggagtcataaggaatgttcttcattcttccagccatttcactctgttcctggcttttggctctgccccagtagttatgcttagccctacttgccctgtcagcagctcctgaaccagttgcaggttcagttggtgacttcaagatggggacactggcttacagactggcagtcaccagaacacatctgtccagagccccggttgccccggtcctgttgaaacaggcgctgcaccttcaggtctctattttccttgcacctccgattactcatcatggtggagtctgggtaagaaggaagttgaagagatgaaagcagatagagttcctgaggatctcattgccagtcgtggctgtctattccctcccttggcagcccagtgtctcatttgaggttagacacctgtctggtgcagatgtaaactgatatacctacctccccatttgcagcaggaatctggagtctcctatggcaattttgtgggggttgattttgggagacttttatctagacatttctgccttgtttaacgtgtggcttactttcctgttctgtgcatgttattatgtattactggcataataacatgcacagaatgcatgttatttccttttggagcacattgttgcaaatatcgatcatgcaagacatgtacatttgtggcagactcttaaatgtgtaaggatgcagtgaggttttacttagcctgatcgttccatctgtgacttccacttccttgccgtccctgccctactacaattcccaactgcagactctgcccagatgtaattcagcaaacattttaaaataccaaattttctctctacctctgtcttgactgtggtcctcattgtgcttctttcaagtatggatcatctagtctccatccttgtttgtgaagttgtcctgtccttcacatatttttaagaggggagaggagcaacgcggaactgtatttcaccgctagagtgaacataccatatcagaaggcagaaatgtgtatttttgtaattacacagcatgtgtttttgtctgtgggtttgcttattttgcaaacaaatccacatggtttacttgctagtcttcttgaatttttcagatggtgagcctgtggatcctcatctcatccaagatgacttcctggccacctcaggccatgttaaacaacctggaatgctagtattactaccagcagtgtctgagggagacatcccagaggctgatggttttctagaatcatgttttcagggaaaagggaataatttttttatgatgaagtaagttcttaaaaaattgccttattcttttggttaatgtttcttaacagctttgtggggaatggttgcacactttataaagtttcctttacaattggggaacttggagaccaactttaatgttgattgttaaggctatttcacttataaaatttagctagctgttaaaaaatttctctgctgtatttcttatatccacaagggattagaatctattgcttttgcaatgtaattttaattagactgcaaattcaatcatctgactaactcttcccttgtcatttaaaattgtttgcaagcttgaatgggaaaagttaaaaatgagaccagataagcatgtgcattttcattcagataagactacccacaatggatttaatcatttaaccagttttaataataataataatagtgaaaattacataatttattgaacactcacctagtcagctgttggattttacatgtcttataatttatctcattcttctgaatagctattcaatgagatgagcatcgcatctcaaagtcgagaacaggcttagagaagttaaaggaacttcatatgtttccattaacttgtaggttctttggctgggatttgcacctacagttcatccatctgggcaacccatcatcttcacagtgcttagagcttctagaataggaccctggcactgccgttgtatactcaagtatcacatgtatatttttaagcactttaattgttaagtctttctgatttcaacaggtaatgttgctattatatgtcatgcacaaataggagacagctgttaggcctccatccatcctgtgtctgttacttacatactgaaaagaaatcagctggttgtgttttatttgggagtgactggaattgatctgtgcccatttttgtgtgtgatcatcttaaaaatatatctgttactatggaatgttctgcagtcacttcttaaggttgaatacacagttgatgggaaatatcttttaatctacatacaaaggaggaagtttaccacagtgaaattcagacgtatagactgttgttgtacaaaatggaactttttcctcctagaatttggcagacttttgagtccaggaggaggaggggtatataggtggatggaagattgaggaaacatgaagttgctttagaaatgtaaggagttgattaaaaagtaagtatagatgcttattttacagagctttgtaactttgtctcactaatgttaacattggcctttaaaaaatgatagaatttagtgttgctcttttctttacaaagaaaactataccatagaaaatggaattttctaggggacagtaagaaaataatatatatatgatttaaattctttattttattcatttaattctctttgagaaaacttagtgcatatgtatccaaagtctgtaaccagattgttaagttaaaaaatggttttcaggctgcgcacaatggctcatgcctatagtcccagtactttgggaggctgaggtgggcagatcacttgagcccaggagttcgagaccagcctgtgtaccatggtgcaaccccatttctactaaaaatatagaaattagcagagtgtggtagtgtgtgcctgcagtcccagctacttgggaggctgaggcaggggaatcacttaagctcgggagactgaggctacagtgagccaagatcatgccactgttctccagcctgggtaacagagcaagatgctgtctcaacaacaaaaaaaaggtggggtggggtgggggcggttcatacttaagaattacaaaaggatttctggcaaagttgtactaaaaaatagatttctttttgtattgaaaatataatctttagaaactggatttatattcctttagcagcaaacctgattaatgtcagttaatagcttcttcttaatcaagtacagacataccttggagacactgcaggtttagttccagactacctcaataaagcaaatacctcattaaagtgagtcacacacatttttagtttaccaatgcatataaaagatatgtttacattacatggtagttgattaagtgtgcaatagcattgtgtctttaaaaaatgtacatactttaattaaaaaaccttttttgctaaaaaatgctagtgatcatctgagctttcagtgagtcttaatctttttgctggtggagggtcttacctcagtgttgatggctactgattgatcagaatgatggttgctgaaggttaggatggctgtggcaatttcttacgaaagtcaacaatgaagtttgccccatcaatggactcttccttccatgaaagatttctctgtagcatgtgatgctgtctaatagcattttattcagagtagaacttcttttacaattgtcatcaatcctctgaaactctgccactgctttatcaactaagtttatatagtattatacatttttggttttcatttcaacaatctttgtagcatcttcatcagaagacaaagaacccatgttctttgcttatccattagaagcaatgtctcatccactcaagttttatcctgagattgcagaaattcatttatatctttaggcttaacttctaattacagttctcttgctgttttcaccaccactgcagctactctctttactgaagtcttgaaccccctcaaagtcatccatgagagttgaaatcaacttcttccaaactcccgttataattgctattttgacctcctcctatgaatcatgaatgatacatagaataatacatcctttccagaggttttcaatttactttgccgcaatccatcagaggaataactgtgtcagctatagtcttacaaaatgtatttcttaaataataataataataatacttgaaagtcataattactcctctatccatggggtacagaaggaatattgtgttagcaggcgtaaaaacattaatctttttgtacatcttcatcagacctcttttgtgaccaggtgcattgtcaatgagcagtaatattttgttttttattttaatattaaaaaaaggaatcttttttttctgagcagtaagtctcaacagtgggcttaaaatattcagcaaatcatactgcaaacacatgtgctgtcatccagactttgttacatttatagagaacaggcagagtagatttagcataattcttgaggattctgggattttgggaatggtaaatgatcattggcttcgacttgtagtcaccagctgcattatcccctgtcaagagcatcagtctgtctttgaaagctttgaaggcagacactgacttctcctttctagctaggaaagttctagatgacacctttttttccaacagaaggctgttttgtctacgttgaaaatttgttgttcagtgtagtcaccttcatcaattttcatagctagatcttctggataacttgctacagcttctacatcagcacttgctgcttcaccttgcattttaaaattatggagatggcatcttttcttaaactttatgaacctgtcagtcttagcctccaacttttcttctttagcttccttacctctctcagcctttagaaaattgaagagagttagggctttgctctggattaggctttgttgtggcttcttacattttctattcagatcactaaaactttcttcatatcagcaataaggcttgtgtttgttcccacacagctttaaagaaatacctgagactgggtaatttataaagaaaagaggtttaattggctcatgattccacaggttttacagaaggtatggtggcatctccttctggggaggcctcagggagcttttactcatggtgaaggccaagtggtagcagccatcttacatgacagaagcaggatgaagagagtgaaagaggcagaggtgctacacacttttaaacaaccacatctcgcaagaattcactcactattgtgacgacagtaccaagggggacgctgttaaatcatccatgaagaatccacccaatggtccagttgcctcccaccaggccccacctccaacattggagattacaattcaacatgaggttttgtgaggacacagatttaaaccatatctttctcccctgaccccacagatctcatatccttctcacattgcaaaatacaatcatgccttcccaacagtcccccaagtcttaactcattcagcattaactaagatgtccaaagtctcaggtctcatttgagacaaggcaagtcccttctgcccatgagcctgtaaaatcaaaaacaagttagttacttccaagatacaatgaaggtataggcattaggtaaaatactccagttccaaaaggtagaaaacagcaaaaaagggggttacaggcactatgcaagtcagaaacccagcaggacagtcattaaatcttaaagctccaaacaaaataatctcctttgacttcatgtcccacatccagggcacactggcatgagaggtgagctcccaaggtcttggggagctctactcctgtggccttgtggggtttagcccctgtggctactgtcatgggctggcattgagtgcctgtggcttttccagtgcagggtgcaagttgccagtggtttacccttccaaggtttggaggacagtggccttctactcacagctccactaggcagtgccccagttgggactctgtgtgggagccccaaccccacatttctcctccacactaccctattagaggttctcagtgagggctctgcccctgtagcaggcttctgcttggacatctaggctttttcatatatcctctaaaatctaggcagaggctcccaagcctcagtctttctttctgtgtccctgtgatcttaacacagtgtagaaaccaccaatgcttctagcctgcaccttctgaagcagagtcctgagtggtacctttgctcttttgagtcagggctgcagctggggcaacagggatactgggagcagtgttctaaggctgtgcggggttgcagggcccttggcctggcccaggaaaccattcagcccccctaggcctccctgcctatgatgggagattatgcaaattcctgcagcctgcttgaattcctcctttgaaaatgggcttttcttttctaacacagaagcaggctgcaaatttttccaaacttttatgttgtgcttcccttttaaataagagtaccagtttcagataacatctttgctcatgcatatgagcatatgttattagaagcagtcaggctatatacttgaatgttttgctgcttagaaactttttttaccagatactctaaatcatctctcacaagtttaaagttccacagatccctagagcaggagaacaaccaggcaagctttttgctaaagcataacaaaagtgactgctggagttcccaaaaagttcctcatctccgtctgagacctcctcagcccggacttcactgtctatgtcactaccagcgttttagttacaaccactcaataagtctctaggaagttccaaacttcccttcatcttccccctcatcttcctgtcttcttctgagccccccatactctttgaacctcttcctattacccagttccaatgttgcttccacattttcaggtatctttgtattaataccccactcctggtagcagttttctgtattagtctgttcttgcactgttataataaaaaaatacatgaaactgagtaattattaaagaaaagaggcttaattgtcttgtggttgacaggctgtgtaggaagcttggcagcatctgcctctggggaggcctcaggaagcttgtactcatggcggaaggcaaagtgggagcaggtgtcttacatgggaggagcaggacaaggggagagagagagagagagagagagagggagggagtgggggagagatgctacacacttttaaacaatcagatctctcaaaaactcactcattgttgtcatgacagtaccaagagggatggtgttaaaccgttcatgaaggatccacctgaatgatccaatcacctcccaccaggccttacctccaacattggagattacaattcaaaatgagattttgtgggaacacagatccaaatcatatcaaggctatttctctttcttatcatttgtgcgttcactggagtggcacttttcatttccttcaagaacttttcatttgcattcataacttggccaactgtttggtttaagaggcttagcttttggcctgttttggctttcaacatgccttgtttactaagcttaatcatttctagcttttcatttaatgtgagaggtgtgtgaatcttccttctgcttgaacatttagaagccattgtagggttattaattgtcctaattttagtattgttctttcttagggaataaggaggcccaaggcggcgggtggggatggggagagagagagagagagagaaagaaggagaagagaggaaagagagaggagaagaggagagagagagagaaagaagaggaagaggagtgtatgtgtgtgtgtgtgtgtgtgtgtatgtatatatatatatatatatatatatatatatatatatatatatatatatatatatatatatactggtcagtggagcaatcagaacacatacatcatttgtcagttaagtttgccttctcagccaggcacattggctcacacctgtaatcccagaactctgggaggctgaggcaggaggattctttgagcccaggagtttgagaccagcctgggcaacatggtgaaaccctgtctctacaaaaaatatgaaaattagccgtgtgtagtgatgcacatctgtagtcccaactacttgggagcctgaggtgggaggattgcttgagcccaggaggtcgaggctgcagtgagctgtattttgcaccactgcattccagcctgtgcaacagagtgagaccttgcctcacacacacacacaaaattgctgtcttatgtggtttggtttgtgatgctccgaaacaatttacaatagtaacatcttctgatcacagatcaccataacaaatataataataatggaaaagtttgaaatattgcaggaattaccaaaacatgacacagaaacacaaagtgagcacattgcttttggaaaaatggcactgacagacttgcttgatgcacgatttccacaaaccttaaatttgtttaaaaaaaaagcccccaaacaaaaaatacagtatctataaagcataataaagcaaagcacaataaaatgaggtatgcttgtaatatttatcactgttactgtgtagggagattaaacatgattgtagctaataaaacatgattttgtaaacacctgtaactctaatttccatgaatctctaaaaatagaactttgtgaaacaatcactagcccttgaggcaatacctagtgcatagtaggtgttcaaaactttttgtgagtgagtgaatgaataatgaatggaagcgtttgtgattatgtgagctttaacatgtcctttcactgccaatgcaatttcttgtgattctaatctgtaaaaaaagtattcctctcttactattccctgttgccttacttgggtatacttagctttatgctcagagaacacacttgcttaaaactagagtaataatcacaggtacaatgtccccaatacatttctgtggaaatttttgtaatctgggttgcattggtagtaaccaagtttcatctagggtagctacagcacctcagatactctccttcaccagtgccatctgctcaagcctgtttctatggtttgctgttgatgcagctgttggagctactctcttggtcacttgcttacccggcttctgagattcctctaaaaatcaatcacatggctaattggctgctgctgttgatcagggccagttggcctagcatcataaatgcattgctggttggcattgatagtcttggaagtggttttctttctgatataagtctctttcactctagtataggatagtagttaggagcatggtgtcttgatgcagaactatgaatgttgtcctgggtcagccagttactagttgtaatttgaaattatgggcaagttattgtacctcactgtaaacatctcagatttctaatctgttaaatggaaagacaagtagtagccacctcttaagggatttgtattgatctctgccctaggtagtgtaacatacacttccatctgtgggaaaagtctgtgactgttgtcactaacctgcacagggatctgggcaaaaatgaggaagactttaacacaaagctgggactgtgtttaagatctgccaccctgcctctgattatcttcacctagtggagggtgagcaccccctctctgtgacttgccgacttggcaaggattttaggtcactgtttctacccagatgccagtatccaattaaactcttgagagtctgtgatcattatgataaaaatgttcattctggaaaagtttgaaaatgctttctggttagaatgagatttttggcatgttttaattgtggtctttggctataaattcctgaaatgctgacatggttgaatttatttttgctttaaacaaaatcgttaacatttccaagtgtccatatgagctcgataaatactttgcctctgcttactgcgtatgtgaaccgagtgaagaggagccatcatgatgtggggaatcttgaacatttttcttcatttagcttgatggggaagtgaattgaaaatacttctttgtcaacataattttggggttttgaaattgtgtttgggttttcaggaaattggtggtaatcttgtattagctgaaaaaaagtgaattttaaaattctcagtgaagaagcaaatgatttatttttcatagaagaagctgcttttttcaagggaatttgctgccaagctgtctgcagtggcttcagacattacttgaccttttggcatatcaagaaattgtggttttttggtctaaatattaaatacctattttaggaaggctgggtactctatggtatatagtgcaagagcagcagaaagagtcagccttgtgcatttccacatctgcaagcaaatttggtttctgtactgtccatcaagcagatcttacagaatgaattttcatcccctcactagttgccatgcaaattctattaatagttctccaagaaataaatcacagtgacccttctgacaaaggtagacagtgaaaaatagtacaaggatatagtacatccacccttaaccagaagcaaattgtgttttccctttttatactacaaaaagagaaaacaatttacaaaaacagtttcttccacacatgtgttatctatgatgtgatagactgttcttttcatagcccttttctgttttggtgactgcaacggggtattatttggaacatgtagtcttctgtttggacaccatactcgggctgtttttcttctcgcagcctgtgctgctggaaatattcccccgtctcatagccatcataagtaaaggacaccttccactgcgacatgctgcatgctgttaaagcccttcgatgccagccaaatgttacaccgtgccttccaggatatctttaattaaacccttatatatgcatttataaccatctgatgaggggattaatattacttgtgcttaacaaatgtgttaattgagaaaggaaaaagaatacaaaataaacatttttaagtaccttccctatcgtagtcactgggctaagttcacagccaccttgccaggcagaagttaccatccccatttatgattgggaactgaaacttgaggcacttttgggaaactcttcaactgattattcgatcgtgtgaaactgaagcccatgtgcaacatcagctgcctccctgagtttcacagtgaaatgtgaaatatttaagatcctcagtgaatattgttgaatgtgaaagatatttactaaattgtaatcagtttctcaaactatgttctttatactacaaggtaactggattaaaatggactttccataggtacctcattcttagctcgaccccaaataaacttgggatctcctcctaaaattgtccccacttcagtgttcccatctcacatgctccagccagaattgcaggagtttcccttgagccccatttccctttctctttccatgttttatcaggcaaaaaagtatcacgattacctacgaagcatcactgccaattgcaggggtgcctgagagagcagcaggacagagcccagtgcagccccacaattcagacctgacacctgtggaaggagatgtgtgtattggggcaggggatgaaatggagcaagatggggacaggagagcttcagactgtgatgcagatcagttctatgtggtcaataagtaaatctgcatattatcattatattacaatacactagccactggagatgcagtgggatataccaccttatgtaatgataataagggacacccaacaaatagctgatgactcactaaaatgagcagtacaaattttattttgtttatcaaatgtttcttctctcagaaaaaacaacatatgtagaattttgtgattaaatttgatgcttgttttaattactaccacatttaatatagtgtgctgtttttccttgcacttagtctttttgtgaaaaatcaagtaccaaatatctaaggtgagtcatcagaggtaaaaagattggtccttctggagtacttgtgaccgactcatttcatgagatttaagaaacactgtaatgccgtctttccattgggtatctccatgatttattgatatgtttttagaaaatgaaaacaagtaaacaaattttaaagttatccccactcttattgaagaaagtctgtgtataaaaatacatatgtatttaaaagtagttaaagtcattgtatgttatcaaattcttgtattaccagaagacttactaaagaacagtagtctttgtgattacctaatactggatggagaggtgagctgagtagtgctaggggaatctaaatctaaattatttgtcgtattcagccaggatgagaaacgttgatttgattgaacaaataaagaaaatagaactaattttattttattttattttatttttttgtctggggcatagaaattttattttcacaaaagtatgctttattacactagaatatttaaaaatgaaatactatatatgtcaacatttgaaaaaaaattttttttgagacagtcatttaatatcatctttattttgtactttctgtgattttttaaaattatactttaagttttagggtacatgtgtacaacgtgcaggtttgttacatatatatacacatgtgccatgttggtgtgctgcacccattaactcgtcatttaacattaggtatatctcccaatgctatccctctcccttccccccaccgcacaacagtccctggtgtgtgatattccccttcctgtgtccatgtgttctcattgttcaatccccacctatgagtgagaacatgcggtgtttggttttttgtccttgcgatagtttgctgagaatgatggtttccagcttcatccatgtccctgcaaagcacatgaactcatccttctttatggctgcatagtattccatggtgtatatgtgcaacattttcttaattcagtctatcattgatggacatttgggttggttccaagtcttcgctattgtgaatagtgccacaataaacataggtgtgcatgtgtctttatagcagcatgatttatattcctttgggtatatacccagcaatgggatggctgggtcaaatggtatttctagttctagatccctgaggaatcgccacactgtcttccacaatggtcgaactagtttacagtaccaccaatggtgctatttctccacatcctccccagcacctgttgtttcctgactttttaatgatcaccattctaactggtgtaaggtggtatctcattttggttttgatttgcatttctctgatggacagtgatgatgagcattttttcatgtgtcttttggctgcataaatgtcttcttttgagaagtgtctgttcatatccttcgcccacttgttggtggggttgtttgattttttcttgtaaattggtttgagttcattgtagattctggatattagccctttgtcagatgagtagattgcgaaaatgttctcccattctgtaggttgcctgttcactctgatggtagtttcttttgctgtgcagaagctctttagtttaattagatcccatttgtcaattttggcttttgttgccattgcttttggtgttttagacatgaagtccttgaccatgcctgtgtcctgaatggtattgcctaggttttcttctagggtttttatggttttaggtctaacaattaagtctttaatccatcttgaattgatttttgtataagatgtaaggaagggatccagtttcagctttctccataaggctagccagttttcccagcaccatttattaaatagggaacctttccccatttcttgtttttgtcagatttgtcaaagatcagatagttgtagatatgcggcattgtttctgagggctctgttctgttccattggtctatatctctgtgttggtgccagtaccatgctgttttggttactgtagccttgtagtgtagtttgaagccaggtagcatgatgcctccagctttgttcttttggcttaggattgacttggcaatgcaggctcttttttggttccatatgaactttaaagtagttttttccaattctgtgaagaaagtcattggtagcttgatggggatggcattgaatctataaattacctggggcagtatggccattttcacgatattgattcttcctacccatgagcatggaatgttcttccatttgtttgtatcctctttgatttcattgagcagtggtttgtagttctccttgaagaggtccttcacatctcttgtaagttggattcctaggtattttattctctttgaagcaattgtgaatgggagttcactcatgatttggctctctgtctgttattggtgtataagaatgcttgtgatttttgcacattgattttgtatcctgagactttgctgaatttgcttatcagcttaaggagatttggggctgagacagtggggttttctagatatataatcatgtcatctgcaaacagggacaatttgacttcctcttttcctaattgaataccctttatttccttctcttgcctaattgccctggccagaacttccaacactatgttgaatgggagtggtgagagagggcatccctgtcttgtgccagttttcaaagggaatgcttccagttttccattcaatatgatattggctgtgggtttgtcatagatagctcttattattttgagatgcgtcccatcaatacctaatttattgagagtttttatcatgaagggctgttgtattttgtcaaaggccttttctgcgtctattgagataatcatatggtttttgtctttggttctgtttatatgctggattacatttattgatttgtgtatgttgaaccagccttgcatcccagggatgaagccaacttgatcatggtggataagctttttgatgtgctgctgtattcggtttgccagtattttcttgaggatttttgcatcgatggagctgattttataaaactttagtttaattttttttttactttccttccagatctaatttctctccaacaattcttacatggaagtataatatttttctcctcatttgttcttgagctattatagataaattttaactgaacacttttgttgttagaaccgatctaacttgggtttactgttttgtcaaattaaaaatcaaaatctatatatagatatatgtacacatatcccttcctctagaaaattggtagtttttccctctgttaggaaataaaaaatattttaataatatcacttatcagtttgggaaattagtatataaatcttagatgaatggcttatatctccactggtcaaagaaggttgcccctttgaatttgacagttggaacaagtctttatttactctatagagaagtcatctaatctgtttagctttttggtaatagactttagcttatagaatatatacatgaccttgtgggtcagattgtctgtatttgagtccttgcttgatgatgtctagctgggtttacttaatctttttgatcagtttccttatatgtaaaacaagaataatggttcctacttcataggatggctgtgggatttaaatgcaggaacctgcaggaagtgcctggagtagtcctggcactaggctcccagggaatggtagctattactatgaccagtgcatggaaataacgtgtgtttttatttcccaaattcaaagttaatttttgaaatgaaggtttatttccctgttgaattctaaaagatttgcacatgtataaagaaaagacgattataatttagaaattatattttggaaacttatcagagtcttaaggttttgtgctgttccctgaaactcctttgacatttaaaagttgtcaagacaccatcaggtatttcaaaatgagatcagctctgattcatttggataaatcaaatgatttataaagtttatttgattgtgttggggcttttgtttccatatttccctggatcttatttgatgggtgtatatatgtgtgtgtgtttagtcaagagtcattatggagtggcttggatttgggtgaaaagaaaaaaaacctctttggaaattaataatttctacatcactgtttaaatcttttaactcttattcccaagttttaacagctccttaggacagagtttaaaacaaagtgtcatgggagtccacatgaggagtgactaactcattctggaagacctcctagaagaagtgacatttgagttggccttgaaggatgaattgttcgccagatggagaaagggatgggtgtggggtggctttggccgaccaaaggcgtgacacgtgaatggtgtggctttggcagaccaaaggggtgacacgtgaaaaggcagagctctgaaagcccacatatttcattaaccgtgggaaattaggtgcctggactgtgagagattacaatgtgaacgctgtccctggaaccgtgaaagagtggtttcaaatggtgaggagcatggtcaagagactggaaatggatttgggaccaaattgagacgggcctgtgtcctaaggaatttgttctttacatagaaggcagtgctcacatttgtattttagatttctgggtggagaatcacctgaagagggcagacgagttgttggaaggtgttgaccgtaatacagatgagagatgaactgttgtaatggaaatggcaacccaaggagattaggagcaagatatttaggcaatagaattgatttgcagaaggagaagggatttgaattaatttttatggattatatatgatcaatgtgagctttaaccttgtaacagccccatgaaagaagttagtattttgtgactgattttttcgggggaagaaatattaatacatttctcaaataaggatactgtagtccaagaagtttgggaaacagtagattaaacagagtgagatcatttttgctctatttatattatttctcataacctttaatttggcaatatgtttggcgaattcccaagagagcaatatagaatgacagaaatacatctcaaaaactatttgttagttgaagcttacttttttattttaaaaaatttcttataagactcatgttgagagaggtcttatatctttgcattacaaacgggaaactgagaataagattgagtatcttgtccaaggattgtgtacctagtaagaatccctttatatttaaacccatgccttttatttttcatgatattgtagttctgttgaaattgttggatttagggtttgagcctaggagacgagacgagtcaagactgacttagaggctttagtttgagtgaccatggctgctggcactttgaaccagcaataggaaacttgaataccgaagcagttttggttttgttttgtacatgtaggaatggaatggataatcatttaagccttggacttgttggatttaagatacttggtggagatgcctcgtaggcagttggaatatcaaaaaatgaaaggtatacttttggacttgacacaactataactttttctgttataaaattggccattaaagtttggatgttcaattttattatgacttcatttataagttgatgtctgaaactgccaaagtaggcagtttgaaaacttgtttttttcctaagtgcaagtattacttcacacccaagtgtcatgtttcattttacttgtgtatgttttgtcagaaagctgtctgaagaagtctttaaagggaaaatatttctactcattttcttttcagagaagtatactgtctagctcttacggcatattttaaggatttcttgacattaacaactgtccatgtgaatgaattattatatctcagtggtattctcaagagttagtcacttctgccatgaggtcatgtgtatgctttaattttttttttttttttttttttttgagatggaatctcactctgttgcccaggctggagtgcagtggcacaatctcagctcactgtaacctcttcctcttggggtcaagcagctctcctgccccagcctcccaagtagctgggattacaggtgcccatcaccatgcctgggtaatttttgtatttttagtagagatggcgtttcaccatattggccagtctggtcttgaactcctgacctcaagtgatctgcccacctcagcctcccaaagtgctgggattacaggagtgagccactgttcccagccaaaattctctggtctaactgtgtgtcaacagctttggcttgatgtgcttaaaggtttctactttaatattcttaaatattgattgattgaagctgatattccttaattttctaccattccattatcattattgtcattcaggttactagagaactagctattagattcagagccattgcccacaccttaaatgatcaatagtatcctggagaagtgatgcagacacctgaatactttggtaggcatgaagtaaatgtcaagcaatgtgaataaaatagttaatgtaaattcataagtcatttttgccaggtggcaattgaacctggttttatagattatttactccttgtaggatgatggctcaaaaggcattcgggtggtggtggttgttcgggaaagtcagatatttagcttatttacagaatgacaagcagacatatttggctggaatgcagaattcatggaattgtatatttggacgttggcttaaaattaagtggcttggggccaaattgtggaggactttgtgatatctgatttcttaagaaaatactatctccaggtctctcatcaataccagtctggctgtcacttttctgtggactagtttatcttgtaggccaatgaaacttgagctatagaatggcacacacatgcatccaacaaaatgggaccagggcctcttcccctctctctaaatttttatttctctaccaccatttgctgggatttttttttttttttggatattttgatagtgagctttaggtaagtttaaaggaaaagatgaagttagttgaatttcccttaaaataccagcagaaataaagcaaggagacagcagctgtgaaaacatacaccaaacatctcagttatggtcttatcatgctagcttcagtgcaggctcacagtgtgtgcttctgtttccatggttacctgctaggcagcagaatcccccaggttggtatgctatagagtcaggatttttcatggaaaggaaattcaagtcttttcagagtgaagttaatagttttcttttctttttttttttttttaaagcagatgggttatacatgttttaaaaataaaaatggttactgcaggtttgatttccaaactgtaagtgaagccagactttaaggcagtgttttaatggtttggaaattctagttttcaaatggtttctcctagatggttcccgtgacaacacaacttaagcaggtatcgagtatcatctttgctgtgaaatattcatgccacaaaaattcctttcatttttaattccacgctaatgaactaaggcagaagaagttagcttattcaaggacaaatggacaaatatttcaaaatcattgttgagcttaataaaattgcaattctaagtgagcttttaaaaaattgaatgatgatatcatactttattatattcttaaattgatgttttgttcccttgaaacaagtattatttcaattgctacctggaaaaaatagtattgttttatgatagaaaaatttgaatttcatagttgtagcagaagattgctgttttaataatgcctgttttgtagtgtagttaaaaagctctctcagtgttttggcatatatctttccccactcaatttttcttccaaagaaaaattttattgttaagctaatacttgataaagccattcatttgttaaaagatatgattttttttaaaaaaatagctttcatgcatgcattttaaaactttgttaaaaaattagaatgaggtgccatttaaagaataagcttctaattcattaataaaaattcattaatattttttaattttaaaaagaataattttttcaaaagtgacaattattctttatttgttgtttaatattttattttattagccattgaagaggaagcataaaatcttacattccatgatgaaacttttatgatttgacatctttatccttatcttgagatttgctgatgagaccccctttatcaaattcagatgtctctctctgatattcagtacaatatctgcctctggaccagggttcaaggaaaaggatggatacaggaggtcattgtgaagatactgggtaatagagaacatctggaggtgatcagagatagccttataggaactgaaccatagaaaggaagttcattacagcaaatggatgaagttgatggtccagaagaaatgagaaagattgacccatgttgagagttcttataagagtgtttttatttgggctacttctgcagattcagtcaggccttaaattagattttctatctcctgttatgaccctgttctgctacattcacattcttgattaaatgttatagtaaataactttatttcctttaaccacatgatgactctaatcttctaaagactttccatcacaaaacttcaacttttaaccacaggttatggctgtccataaagtatttttcagtaattttcagtctttcacatcataaagtcctggcttaggggattgggctctggaacttgactaactgggttgaatgctggttccgccacttattggctctgtgacattggacaagttaataacttgtcacagtatcttcaactgtgagatgggaatgataataataatccctcacaggattatgcaggaattaatatatcagaaatatctagtgttagttttctattgctctaacaactgaccacaaacttagctggcttaatacagacacaaatttattatcctatatttttgtaggtcagaattccagcagtcatatcactgggctaaagtcaacgtgaaagcagaaccatgttcccttctggagactgagaatttgtttccttgcctttccagctctaagagccccccaccgccccccccccacatttttttctgatggctccattcctctgttttcaaagccttttcttctgtagtcacatctctctctgcttcttctgcctccctcttccacctttaaggagccttatgattacattagggccacagataacaattagataactttttattttgagatcagctaactttttattttgagatcagctgattagcaaccttaattaccttttgccgtgtagcctaacacaggatttaagggttaggatgtggagatctttgggggatcattgttctgtctgatttgtgtttttacctcatgctatcctattatagggtagatatttgtatatttctgcaattctaatattctatctattttggagcatatatattaccacaggcagatgagagaggttgaaggaagggagaagtaggaagaattatgtcctggtattattttttgcagccacaaagaagtaatttatttgtcatatttttgtagcaatccaaattggccttcccatttggttagtgcctctgaagtttgctaaaagcagttataacgatgtggacagaatttaatctacttagctttgagacatctttttcctactgaaactttattttgcttacatctataaagtatggcctaactacatcaaatattacaatttagggtgagcaaagacttaaaacaatgtattaatatttgtgaagtgcctcagcatttacaaatgttttcataaaaattattttatgtagcctgtcagcatttggagaactaaagcagctcagctctttcagacaacaaggtgtctctgaatatttgctccctcattgcttctgccaaagaggacaggggtaagaaaaacacctaccttcttccttaattaaaatttggcagtggtatgattggtaagaagggggaaaatgattgaggaggtgagttctcagtttcatagctgagcaaactaaggtgagaaacactaaggctgctcattgctatggctgagtttctatcccagactggttacctttgtccttggtgtgaatcagtttgcaggagtaggctaggagaggcattctttccttttcctaaagcagagcatgaatacaggtattcattaagccattgtttcctagctgggtgttcatctactggcattgtcaatgattgcatataacaaaaagggaatggagagaaaaatctgttctgagttcacaaaactcactgaagaaaaaatgtaaagtcagctgatatgtcaacagcagggaaataattcattgtctcttagaaaagcgaatgccaataacaatagccatgattctggcaacagagtagtacttcagagggtcactttcagctcttggctttctcctttccctccatttccaaaggacattctccccagcaacagaaaccaagtgatttatcatggctcatgtcagctgctgaggttcacgggaccacacagagtggttggtcagccaggtctgtctttccatggctgttattacaaaggaagtattcttttataaaaagagaaatataaagtgatatatttgtttgttattaaagcctttttggatgccttagagaagattagcttcagctccagggtgccagagtaaacttgcatttgataaagccatggtcatttctactgctgtctttattgcacccaaatcttacaaggtaaaagatgtgaagaagacagcctttccttaattgtccattttgattatatctttgtatttaaaaaaatacagaaatgaactttaagaccaacttaaataaataagcaaataaatgatgtaagagataagtatgcagaaatagttattcatttcttaggggtttatacattttatttatacctattattatttttgattgaaaaattatcgtatacatttatggggtacaatgtgatgatgttttgatatatgtatatgatgtggaatgattaaatcaaactaacatgtctatcacttcatttacctatcattttttatggtgagacatttgaaatttactctttcagttattttaaaatatacattatggagtatataccttagataacataaacctttatatgctctttctaaaaatggctatttgaaaccctgtgtatagccttttgtctgtatctgtcaacttagtttttaaatataaaaccaataatagttgttagctctcttgctttcatcagggattggcaaaccacatttcacaggccaaatctggccagctgcctgtgtttgtaaataaaaagttttattggaatacagcctcatccatcatttacatatggtctttgtatgctttcgtgttacggaggcagagttgactagctaaagccaagtccaaatggcctacaaagcctaaaatatttactatctggcccttgcagaaaaaactttgacagctgccagacaggtaagttacattatatcatactaggtgatgtgggttcaaaaattatttaagacttagtctttaatagtttataacgtagctggataaaagacataccaaagtttaagtgataatacaagtcagttttaaatttatgttttcattgtctcaaatcgagtgacttttgagagtgtcctatatgccaggcagtgttctagggactgggatgtagatgtaaagaacacagaatttttgccttcatggagcttataacctggtggatcaggcagataataaagaaagaatatatagtataatgctatactatacattcttgatacattgagatttagcccaggtcacattaatagtcttgtctgcctttagcaataaattggttacttttcctaaatatctttttctccagtaagattcatatgaaaaagtggtggggggtggggagaatgaaaatacctcaaaccagtcattgtttctctaagtttgtacacgtggttcagaattcgatttttatcttgacgtagggtggaaaatattataaacctgttctggtatagtagaagaatatttgattgggaaacaggaaacctgtatcttagccctagtttagtctcttcgggctgagtgggcttgtaaagattcttaacttctctggagcatgtagggtattgtactcggtcagtatttctcaaactcgaatgttcgtcagaatcacttggagagtttcacatttttgagccctaccccctgagactctaactaagtggggcctgagaaatttcatttccagtgagttcccaggtgaggcagctgctgctgctgttttgggaacctgcttagagaaggattgcactccatcattgtggaggtccttccagtttctccattatttttaaactccctggagaagctttacagctctttgagcttgcctaggaagattccactaaataatggtttggttaagttgtctacttaatactcagggctatttgctgaggaagagatttcaaagacataagagtttttaaacacttgcttatggtcacatggattgatattcatttaattgatattatgtggtttctttgggaaaattaatgtttgctaattctaagggcagagactattgttcatgatttcttctttgtatcctgagtccatggtatgcgttagatgctcaatactgatctgtttaattgatctaaacttagagaagcacagaatacttctgaaggtcatcttcctgagttcctgttgggtttctgttatgctctatttagaattaagaatcatgaactctactggctgtcaaaactatacgcattattgtatttttgcaatgtgtattggtattatttctatagaaattccagtaagaacttcatattgatattcagtctgtctcctcctttgagtctgaatatacagcaaaataagcagaaacaagacaaacagtataataaataaaagttatccacattttctgttacatataatgtatccacttaatttcgtataattcagatgtttttgttcaaatgtgacttttacagagcatctcttaaaactgtaatgttattaaaataggtttaaaaagtagatactcatttcaacctgtttctcaaatgcccactgtggatctacaaagatgcataagataaaatttctgccattaagtgccctccagacccttagttgaataaatcaaggattgaagaaatgtccaaggagccaggcacccagtgcttcaaagttgggatttttatgactttttaaaatgttggctcaagttaaaaataatcaaaaatgaaaacagtgtggatcaacaaaacctagagttagttaccagctgaattctaacatcaagccttcagtttataagttttgaaacatggatgcacagacataatatttggggatgtttcatatgatctggagtgagaacaaatctaagtgcagagattagaaaaagttgcttagaggacctggtgtttgacatggactttgaaggataaataaagactctagagcaaaatctagagcagtgtgaggataatgagtcctagcagaaacagaccatgagaaacttctaaggcaagtagatggagtcaatgttcagggcattgtgaatagtttattgctcacagcaggagtagaaaaatggtagcgagtgagagagaagactgttaagtgtagttgggattctactgtgtggacccatgatggccagttgaaagttttatactcagtgtgttaggcaacttcaatcaccagccatagacaagcattattaatctggattatatttataccctatttcatcaaatctaaaatgccattgattgttagaaacatataaccactaaggaagaaaaaaaatgccactgttaaactatgacagaatgctgtgttgtcatttggaattattttaagttcataagaactctaagatttgttttgacacaagaaataacgaacctttgtgtcccagtttgtgcttgcatatagatctatgttatgaccgctaccagaccactagctattgcagctatcagtttgaagatgcatcaccacttcatagaagttgaaaggtgcatcctacagtcaataaaatatgataggtgaaaaagtctacatgttggatattatacataatggattgagtggaagattttttaaacaaaatgcctcccatctaggtcataattaccattataatccagctattaccattttcaagtgaaaagcttgttaattgtgacttaatgttccagaaatcggaaacctgctttttaattggaagcagtctttactctcttgaagccacgaatattttcttacctgaagggtgctcattgaaaacagctgattcctatttcgtgtttgtgttcttccttgggaaagtcttttgcatcccaagctttgtttttctttttctctttctctgttaaaaaatgttaagattttatgaaacggaagaacagccctagggaataaactcttaatcacagagctgattgagtgggtttgaaacagaagatgcacacacccaaatcaatagccatagaaggatagcagttctgcaagtctccagtaactattcttaattcagaaaagccaggaaaggtcacaggctccaaataaataaggttgtttttcttgctcctttagtgttttgtttttaaatcacccatgcctgtaacttaactgaaacgttcctttttatttctatactactaaagtgattctaatataaatggtacagttgttgaaacactgatcactgccatttcttaaggttttgatgtggtgtttctgactggtgtcagcctaccatgctatcctttttgagatgttactaataaatatttgtaataaaatataaatgttaaaaactatcagctgttaatttccttaaaacctaatgaagtcctttattaataatacctgggatatgttttgtatttaggaagtaacgtgcccagtgggaactatttcatttgttctctctgtgtgttagggatgtctaactttatctgttgagatgcaaaatatttcactgttaagcagataatattactggagaagaataatttaacatccaggaaatgttatagcccaaaatataactgtttcttactgctagtcaaaatacatattctgcttttatattttaattttttctttattgaaccattaaaaacttcaaattttgtttaggagagacaaactttaatttaacttctttgtatttttaaagtgcctgaagcatatatccattcacatgtaggtttggaaccaaaaaccacaggctcaatatttttagggaatctaatgcatttggaaattgagactgtacatataacatacctatagggtgcatttatttttttccagaaaaccaagtttaataatgtgttaagatgaaaacaagcctccctttctgttataaccttctctacattatacctcactatgatttcacatgagctattgaacttctacagtttttcttatttttagacataaaattggatgttgtatgcatttttaaaatatctcttcagctaaggagagaatgtggaaaaaacaaagagcaaacccactttgctataattatattgctgaatctaaaggatttttcactggcaccgcaaagtgtaaaagagcctcacagtgtgacatttgtgctgttgtggagttgacctaagtatataaatctaggtttttgtcatcagcgcgtattgatggcattttaaatatattggcatgcagttctctgatattaggcatgcccagggatagagtttgagtatctgcttgcaaaacgtctcagtagaaggatctaattctctggcacaattgcaagatttgggccttcctgaacaatcctactgtctgtctggggctgattcttcggaatgccatcagaacctgggttagcagcagttgaaccagggctcaataatgggtgaagagagaaagaacaattttcttttagcatctttatcctacttggctgctaggctgctgtctttcttctcatttctcttcttcctgaatcttcttctgatcccatctccttagttgagtatcttagaggcaccgttgattctagaaatagttttgattattttcaagagcacatctgccctgaatgctaaaggacatttcaaaaccatagtggtgggcaatgttttgttactttgggtatacagcatttactttaccatgcactttcattcgtggctgcaaagaacagaaaacccaaccagtagtagcttccaagagcaaaggtgaattttcccacttagcacaaaaggtctggaggtcagcagtgcaggctggttccattgactgatgatgcaggtgaccagggaccgaggtgcctgctctctagagagctgtgctggctttctttatgcttcccataaagaaaatgtggtcacaactttgtagctgcatctgagtaatcaggaaaaagtggggcgattgaagggctgcagggtgttccactcttccttcctctgcaaatgggtatttacactgcctctgctgggctccccaaagcctagtgtctcaaagtcaacttaatatttttctatttgattttacgttgttgttgtttttgttgttgttgttgttgagatagggcatccctttgtcacccaggctggagtgcagtggcatgatcatgatcatagttttctgcagacccaatttaccaggcttaagcggttcccccacctcagcctcctgagcaattgggaccccaggcacacaccatcaggcctggctgattttttatttttgttagagacagagtctcgctatgttgtccaggcttgtctcaaacctccagggctcaagtgatcctcctgccttggtctcccaaagtgctgggattacaggtataagccaccacgcctggtcagtttacctttcttatgtagacctttgatccatctggaatatgtttttgtatatgatgagagggatccaatttttttccacaagatgagtcagttttcccagcatcagtttctagataatctgtcctttctcacaggcttatgatgccacttctctgcatcggccacacctgctttctttatgatgccacttgttagctaagttggaaaacacacacacagacacacacacacacacagtctcttttctctctttctttttcttcatccctcctttatatttttctggaatttctattcttttccatttttctcttacactttgtaatataccttgatatatgctggacaaaggccctttttgccttgccttgccatttttccctattccgtactatatcatttgtcctgtttcatttttcttccccccctttacttttcttctctttttcttcttaaaattgacagtagatgatatctctgcatactcaccatatgataggacttaatttttgtgtttctctttcattgaccaccaactgtaaagcaaattttgaggtattaggtgtataaaaaggctacattcagcaataacagcctaaaaacagcatactgtgtgtttctaaaaactgtatgtttttggccactacagaaattttgggtttgttttgttttgctttggttttgactgccagatggagcaaagtgttcatgtacagctcaaacatagctctgtataatgttgcctttttttactcttgtctccttacagtcattatctgactaaaagtaattagtgtgttggaaatttagagtgaataactttgagaggaagcacttattttcttttattgcaagtaaaagatgttttttgattcagttgaatagtacttgaaagactgaacgaatgtagcaaattctgtcagcaaactggataatccaaaagttgaaaatgtgggggtctgcaaaaatcagttacagaagattaaagtacctttggtagcacattattaagaaaatccacagctgttttaaagtgggtgtttcctcatggagaaaagtctaaagtctcttgcagttacattctgatttcttcgtagcttgccaaaggttggcaacctttgctcagtacatgcctcacacggcagggagcaggagtgtctcatcatttctggggtgggtggtctccttgggggagcccagggatgccttatgcatggctgagaaattttctttctgtggccctctgtactgtatgggctttagggacaaacttgtgagggggggtgtgtatgtgtgtgtgtgtgtgtgtgtgtgtaaaacactcttcttgagctctgactgcaagaagaaatggtttgagaagacagaggaaggctgagaaaggactttgaatgtgaaaatgctattcttgtagcatccttaatgccattggtccttagctttatagatcaagattgcgagtgagccccttataggtctggggtttattgttgctaataccagatgagttacagtatgtattgcagtccttgtattttaagttacatctggtttctcttaaagttccttagtaaaccaaaactgttggtgagtggaagcctgatgctgaaaattttgaaaagcaactgtgtcagatcacaggatttttctttgttttttgttttcatagagttgttttgggcttggtgactgtttcatttaaatcaagtataaatgcacagaggtaaacagacactcctatttagtcttaagaacttggtttgatttggaattttaactgccagggcccactgtttagtgtctagcctgctttctatttcctgcgctattgttttgcttttggtcaccttaggggaaaggctacagcttccatggtcccaaagtcagtggcgctgtcagattataaactgagaagagctgattccttggtggacaaccagagttcttcatgtgattttagtttacatttagttggatttcacattacagtacatttggtgaattatttcctgaatgagactgagaaatcactgggctctggcaactctgtactgcttcctctgctttagggattttctgtctgaaatcttcagaaaaagttgcaatagagttcatgaaaaccctcagttctaaatggacacatgaagaaacaccttaggtttgaaagggtgttttaaaattacattcctgtcttgtatttttttttctcctttttattttttttttctttttggcctaagtttcaatgacattctggaagatgaatttcagttgggttttgggaaactatttccagcagcggttgagtctggatttgattccacagagttacagccgaggcttctctgcattggccacacctgctttcttgagcaacctgagagacactgcctgtggacattttccactacttagtgattagtcacctcacagttctgctgtttttgccgtgagataatttcactttctccttctgctcctgcgtgttctatgtctgttttcacccatctttgcttttcccattttcctctggatttatttattctgtcccttacatttctttatacatttgcctcttcttatcctgggaacctcacacctctgcttgttccattttcacttgtttctggatgtgttgtatctattcctttgaaaaacgttgctcttttgtaacatgacctgtcccagcatcatcaagatagagacttttaaaaaatactccctttcgtatcttagaaggcaatagatcttctttcccagccaaccagctggaaaggcttttttttgcttttccgttttttgcatttccacgtagactgcgttgctccttgctagagaaaccacaagcattcctgtgtgaaatgaaactcgctgttttgtgattttgtgtgtgggggtggagaggggcatggtaatatttagagtccctggcctttgcctcccaaaggtttgtcattaacattttgttgatttttaagcttgctcttatatttaggaccagtttactgagtttacctcccattccctttctagcaggacacccaagagtcctgtttgctcatttcctcttgtcctggtcccaccctaagggttttccatgggctcgcacttctcaaggagttcttgggatccaggaccctttagcaactactagccttttttttttttttttttttttttttttttttgccagagtcttctccttagcaactgtaatggcatattaagttaccagttaattcctttgtgaggaagcgtagcagtttaatatcgaacaaaggcatgtttgagcaaatattgacaattgaacactttagcaacattaagatgccttttataatggatctgtcttacaaagaaaagcgataactttctagtctcttatgctgtccaaaactcagggacttcgtagatttagataacatgatttccttggtagttggatttcagcaatatcatagactttgatagtgaagcatgcttgtatgctattttcaaataattttcattggtgctaacatttttaaaaattcaattattgtctcactgctttaatttcttagttactctaataacaaagcccttttattgtgcagagaagtaaccgtatgtaatttataatacgggatgctgaacaggacttatcgtgtaacccgctacaagactttagaatatacaaggactgtatataaaataatgagaccaagtctgtggctcaggcatgaaatcagccaccttgttgaatgttaaactacttttatataatgttctgtggatttgtatttgttcatgagtatgtgaacatttctcctctatgaaataaagctgtcaatgagttctatgaaatcgtaacacattttctataggacgagtatttgacgttatggttaaatatagtaccaatttatctacccaactattatcatgtttctatgtttctactggaaaatgcactcctaattgagatgtcagaggtgagaactaaagcctctgtgagactagcatttaagaatgcagaagtaaatatcagtgagtccatgccagagtggagcttatcagtaagtgatgttatggagagtatatattcagagtctctgactaaggtttcagttcctttaagagattgagtccgtaaaaagggacaggaagggcacaggtcttttaatgctgtacacctatgtaatttcacaagagccaggaccccccatccaggtcagccactctcaagatattcaagacataacttccttcagtgattatttgtatgtttaggttgttcttgggtaaactgtgttagaaccagagatgccataaatatcaatgcagtctgtccttaagcctgtggctgccaactcagatcagctgtgtacagctgacctttacatcaaaggcttctctttttgctgccacagcaaaaggtttgaagttcttggcagtcagcaacactgtgaagaacacaaggggaagatgcatttcctatctcagaaacaacccataggaagcaaccttagcagtggtgcttggtttcctaagccattctgcataagacataacatactgacacttaacacatttgcagtatttttccttctactatcttaaaaaaaaatatatgtagttttaaagtcatcctatgaatgattaggcttctgtgagccaaacctaggtcagtagccgtcattaaaaattttttttggttggaaaaatatgttgtatatttcacataaccagttcatataaacacttacagaatataatccattcataagtttgcggttcccaagtgtgtgtttagcatgtgccatatatacttatagatttgacattatataggagcccctcactataagtgcctaaaggttgctagatgattactaatgtattcttcccctaccaaattgacaattctctgctactgaataaaaaatggaacttgtgatgtatcctagaacaggctattaaatcactgccatgagtatgacattcactaagaaaggaattcctggcacatagttcatctagtttttctcctcttccctataaggtctgtgacaaaaaggcagttcactgttcttcttgtccctgcctggttacaaggttagttctaataaccaaactgtgggtctagatagtaattctatttcaaccctgtaaataattacccaaagctgccaagcttaagaaatgttttatcagacatttcttctcatcatcggtaagtctaagataatgaaacaaatggcactaactttttttattttttacttgtgaaacatttctgttttggggaataaaagagcaagagatttttaaagctctgttaagttctgtaaagtctgatcagaaaatggaattaaaattaataaaaactgagcttttgttctaataagattttttttaagctggccacttgcttaagtccaatttagcttcccaaggacagtatctttgatcattaaaatatttatttatttatttatttatttatttatttatttatttattttgagatggagtcttgctttgtcactcaggctggagtgcagtggcacaatctcggctcattgcaatgtctgtctcccgggttcaagtgattcttctgcctcagcctcctgagtagctgggattacaggtgtgtgccaccacacccagctaatttttgtatttttagtagggacggggttttgtcatgttggccaggctggtctcgaactcctgacctcagatgatctgaccacctcagcctcccaaagtgctgcaattacaggagtgagcaaccacacctggcctgatcattaaaatatttaagagagtggcaatataagcaaaaatgattcaatataaacaaatacaaatttcaatataaacaaaaagatttatgaaacctaaaatatttgaaacttttctagagagagaacactagtctaaatatctaggaagcaggcatttaagtccttgtgctggcatatgaaatgggttaattccttgatacaaacagctctgggtatttattgtatgtatttgtatagtggcataaaacattctttactaagttacaagtcaaaacagtaaaggaatgaaaatgactaaattgttcatttgttaatacaatatttcctgtttactctttttctatggtgtaaaagaaactgaacattgactttctgttttgtaaaacctaaaaatataattaagaagaagagagcaggcctggcgcggtggctcacacctgtaatcccagcactttgggaggccgaggcgggtggatcacgaggtcaggagatcgagaccatcctggctaacacggtgaaaccccgtctctactaaaaacacaaaaaattagccgggcttggtggtgggcgcctgtcgtcccagctactcaggaggctgaggcaggggaatggcgtggacctgggaggcggagcttgcagtgagccgagatcgcgctaccacactccagcctgggcagcagagtgagactcgtctcaaaagaaaaagaaaaaaaaaaaaaaaagaagacagcaaagaagtgagaaaggagttttggaaggggttgtgatcatttgcaatgtgacacgatgttagctgcttttcataagcgcgttttaagcaaatgtgttcttagctctgtttttggttttaatagtaattccactgtgaatttgtatgttgtggaatgagagaatagtgttaaaaggtgcctggttgttgccagatctaagaatgggaatgattttctcaggcaactcttattccatcaagtgtgttaaattactgtaaattacaatcatgcaggagattggtggtccccaaatgacgttttccactatttgcagctccttagtgtatctatacctaacagttttgcatcttgttaaaccgcagcattcatatattacgcctcttccacagagaagctcacatgtacattccaggtggaatcccaccgtaatatatacatcacaaccaaacaccatagagtaggttttctgaatcatttatttaattggtatttaatacagaggaatttctgtttgccaaaaaatgttttttgtaatctactgtaagcagacttaaattgtccttgttaatggctttgagaattattttttttaccattaaagaataattttctgggaaaataaaaaatgatgagactcatacagacataaattgaacacgtgttaaagattttatgaatcttattaatggagaactaggaagatgtcataaccattcaaaggagaatcatagatttatatggaataaagaaatgtgagatgaatttacaaatggatctgaagctggctttttctaatgggaggaggaatgtaaattgaacctccaagggacagaatttatttgtattgtctatagaaaagacttactttgctttggtctcatttatctaaaacagagctatgaaatatttcagaggcagtaaaatgccagaatcagaggaccccaaagggtgttctctagacaatgcattgttttccattggaaacacctagtaatcctttttgtttatcaccctgcctggcaaaatttttgtatatttttttttaatagagacagggtttcaccatgttggccaggctggtcttgaactcctggactcaagtgatctgcctgcctcagcctcccaaagtgctgggattacaggcgtgagccactgcacccagcctaagagaccaagaatttatgaacagaatgacaagtttgtgtgaaagtacatgatgctaagatacagatgaaggctaccccacctctgtgctagctgtctacaaaaggagccgagtgcggctggaaagaaagttgcttcctttccaattcgaagaggaggtatacaaatcctagagctgggggcagtgacaaggtttaaaatcgatgtgagagaaacactaaggaatgagtcagtgaaagattttaaactccatcacacccaactcagtttctctttaaaggaaatggcagagatgcccatcaatgtagatttttagagatggtttattgtgatttcccatttatgttaattagctttatctgtcccctttcatttcttttgataaaatcacttagaaaaatgtagacgtagttatgtgtgttaaataatataattcagtgtgacaaggagttgcgtccctgaagatgtgttgttgagaatggatgacaaacagttcaggtcaaccttgagtaagtgtgaggaaaaaataaaaataaataaatgaaggatgtaattgggctcctctcctggagactgaaaagtaaggactggcatggaaatctttgatttttggcagtatatcattatctttagaggtctagaaaaagtgcctacgtcatcctttctatgaacacatttcaggagctgagaagttcctatccatcatgaataaaagcaaccacttgcatgtggcttttctagaaaaaaattcttataaaacattttcatcaggaaagaaccaggagtctaaagtcagatgaaagaacgtcagactgtagaaatcagctttgtaggtatgagtccaggatcagtttgaggtcaaacccctttgcacatgtttttaactttgcaccgccctcgctctcagtgctggctcctccactcatctttgttgctaattcatgtttgagagagtctgcacaaactccccacccaggctggtatgggccttaatgcaagtttgtgtgtccaggagactcacaaatctgatcaatttcaagggcaagtaagtgaaagctggagaatgtacaaacagaaaatcgaaagctatggaaacttgaagagacaaaacgaaaatgtaagaaatgccactaaaatgagaaaatatggtcaaacattgagaactgatttgcagataagctttatgggaatgtctgtgaaatattggagagtgtaggtgtcagatttgctgagtacagcaacaaaaaatatctaaagcatatagtggtagtaccaaaatcaagattcataaggttttacatgatgtagtatctggccaaaaatgtggtcagcgttgttttttgtttgtttgtttgtttgtttccacactatgtggtaaaaggaagaagaacaggttattaagtggccagcattcatctttataatctgtggtgtctgtggtcagtcctgctgcagggaatatccagcctgtatgcttacacatgtggactggttttcatgatggaccatttcagtgccaggtggtgtacatgacattaagcttctgtacacactcttttcaaaattttctttacatgaaaattaacatcagtttttattatgagatggaagttaatagtcattgacaaaacttgaaaatgtactttaaaaactttaaaaaacaaagagttctctctctccagatcaaccttacaagtacatcacaggatttaagcaatttcatcgtaacacaaaggaggcccagtacattcttcagtgccagagccaatccacctgtgttggttagactcaatgaaacagaaagtttataggttctaaatgtaaaatggagccagccctattatgtttgttgttttaaggccctgtgatatattgtttttgtgaatgggggaaatataggaaaaaaaacactgagttttgaattattaacatactatgatttgcttcataattctcagatgtagttctgtcagatcctcaaaatgtgcacaagattgaccatcccttccaggaagaaaaataatatgcttccaataatgaatacactctaaaaatatatggtagttactttaaaaatattggagatattgggaaaaattattaatatatattttttcttttaaatgctgttaagacactagtcactgtagctgatagcatgggttagtcaaccttcacaagtgattttaaaactgtgagagtatagccatagccctgagcttttcccaagacagcatcccaaagaacaagttaaatgtgatttaaatggaagaagaaaatattttgaggtacaagtggactcaataaatttaggaattactatatttgaaggaaaaaagaaagcatagtggttcctactaatggattgtgcctcactgaccattagaattacatacacaggagagatccttgaggagttaagttctgagtacagactagtgtttatattaaaggacaagatcacatgctggtgatctgttaacctttggattgctttttctacagtgttctttcttaaactgtggagatccccattgcaccacccagaaaagagagaagagtaatgaattttggacctggcacgttgaaattaaagagcatgaagaaagtgagaagttgtttactaggcgtttgagactagctgggaggcttggaatagaggcctaaactaggaaactggaattggaaagaatcacaatactagatagtaaagttacacaagtagacgccctaggcaaaaggcctggaagagaataaagccaaagggatcacttctaagagcagaggcagagaagacaggaaactaacaaggaatatcaaatgaagactcacaggcatggaattgctatacatttagtggtgtttgggggccctcagaaggtacaggtacaggtacagtaacacatactgatgtttacttacacttaaaatgaaataggcactattgtcaaaaccatttaatgagtgaggaaactgagttcacttcagtagacccaggactcatacctgtattactctgagaatagccagttgcctacattaggcttttgaaagcttaattagacaaatgatgaaacagagaactagacatgacagtgaattggcagaaacactgtttcttcagaggcccataatcagcttacatacctagagaccctagactgagccatagaagtggaaacaaatctgatttatatgactgtggagaaaatcttgtacttggaatgctgtaccctgttctcgacacattattggcagaaagatacatatcaaggaaaggacctggaattcacttgtggatgaaaaagcaaaagaaataaatgtgtaaggcagtaaaagtatatagaaagtgaaggtgatactcatgtatgtgctgacataacagaaggaaaatgacctgagtaagcataaaactgatgccagagtcaggaagagaaacatagagcctggaaattgatcactaatttccttcttttttttttttttttttttgttctaggcttgacattttccactttctttctcctaaaacaagaaaggggacaggttgtagattttatgtctttaattttctttaattcttgcctaacagtgataaaaacataagatcagtgggctgaaatttagggacactgagggaatgaaaatagaaaactaaacctggataagttcatcagcatgtctgggaataatcaacaggttatatgagaaacaggttttagttaagttactaatctggaataatcaaggtgataactgtaaattaggagaaagtttgaatctaagagcttgtattaaaagaaagttttcttttcctcttttgggttacataaccaaattatggtctaatattcctagggaaactagcttaataattagttgctgcagttttgtaggtagtatgggttttttgtttgtttttttgttttgttttgttttgtttttgagacagtcttgctctgttgcccaggctggagtgcagtggtgcgatctctgctcactgcaacctccgcctctccgttcaagcaatttttgtgcttcggcctcgcaagcctggctaatttttttttctatttttggtagagatggggtttcaacatgttggccaggctggtctcgaactcctgacctcaggccatccacccacctcagcctcccaaaagtgctggcattacaggtgtgagccaccatgcctggcctggtagtgtgtatttttaaatgtgtgcaaagtgggcttccacaggacctatgttgtttgaataggacctctcttgcctaaacatttttatttacattcattcatctatcaaacatgttctttaaagtaacggtgaactccagacttgcacaaaatttttatattattataaattagtgaagttcacattaataaggttgtacgtgataaactccactgtaaatcctgaaacatgtgccctgtcaagacgggagaatcccattaatatctaagatttcaaaacttagcaacaattttggacaggccaaatcataaatgaagtagtctaacattttaccaactaaaattttgtattctaagatgaggactcacagggcaaaaaggcctttcctcttgttctgaacagatacctctggtgctctgcacttactaataatcatgtcaaaaaagctgatgccaatttcatttttcctcttaaagtcactctattaaaggaaaaaaggttctgttaaaatttaatcaacaaaagcaggtgttacagggaggggtagattcgttgaaagctgccagtgaatccaaatactctctcttttccaggcacacaataaagttagtccacaagggcacatgaaatctttccagcccacaatcatattagaatttgcattgtgttactggaagcagcacagaaatattcccttttggctcacttcagttcttcgtcaccccctgaagctgcctcctgctgattcgaaggtcttgatagtttctggcaggacagtggtatcactctccagttatattgctgcttagcatctggtagttgcagaggaggtttatactgcattatgttccaaaaaaaaacccaatctgtgaaccacattaaggccaaatctagtcttggatatagtgccatggggtggggatgaaaaggggatggcagggatactgactggcaaaaaaactggaacttgatggaataacatattggaagaatgacccccatgtgtgtatttttgttttgttatttccctagaagtatgtgggaagggagagtaattagggggcgggcacgagagaaaagcatacacttttttatttagtgatataaataatagtaaaatttggataatctcctgaactgaaggatctagttctcttcaacaacaaatgcttatcaggaatgatttcagcaagatagcagaatagaagttttctatcattgtctccctgtagaagcaccaattttgacaatcactcatggacaagagtacctttgtgggagtctgagagtctagcagagaagttccagctcactgctggagcaaaaaatttaaggagagatgcattgaagaggttaagaagaatagtttcattttacccatgtcacctctcctgtaaagcagcacagttcagtgccaggagagaccctctttgcccatgattcttctcacagggggaaagttagtgttgtgaatacccagctttaccagctgtgtaaaatgctgtccaagaagcccacctcttttttgacccaccgagaacactggaggagattagcatgtctgagtggctgaaagtagggaaaggtggggatgggggtggcggaaatcacagcagataggtcttagaattcaacagctgtttgtatctgactgactgcatctcagactccattaggaggcctgcccatgagctagttgggatgcctgacctataaacccaaccaattccatgggtgcccccatgccccacatgcttcctcccctacccctcctgtggccaattctgatgcacattccttgggtcatgagtacaagcctttacaggtggtttgtagtcagttggcttgactctgggattggaggaaggtacataaactgagcatttcagggcactgccctagggaaagcaaatgaaaggctctcagcacaaagcctggctttgtgagattgagagaaggtacacaatcttaagaattacctcccaagagaaagcaaaaagagtggagggagtgcattcatagaaaatatcgagagtgcctcagaattctagccaggctgactggtgaaggagttcctctccccaaagctagtcagtaaagactggaggagatgactactacttcagatgtgaaaacagcaacacaggacttcacagaacacacacacgcagaaacccgacaccagcaaaagaacacaataatttctcagtaaccatccccaaagaagtagaggtctacaaattacccgacaaggaatttaaaaataattgctttttaaggacacttagcaggctacaataaaactcagtataaatctaaataaaataaaatcagtgtaaatctaaataaaactcggtgtaatcaggaaaacaatatatgaacaaaactgaaagctcaacaaatagatatacatcgtaaaatagaaccaaacaacttctgaagctgaagactgcaatgaatgaaatgaaaaatgcatcagagagagtcaacagcagattcgatcaagcagaagaaaggatctgtgaactcaaatacaaagcatttgaaattatctagtcagagaaggaaaaagaaagcttatgggatttatgcgataccatcaggagaaataatatatgcaatatgagagtcttcaaaggagaaaagaaagaaaagggtagaaatcttacttaaataaataatggctgaaaacttcccatatcatgggaaagatatggacatccaggttatgaggctcaaaggtcctcaggcaggttcaaccaaaataaaacttcaccaagacacataatcttattgtcaataatcaatgacagagaattttgaaaacagcaagagaaaagagactcgtcacacataaaagaagactgtcagttagactatcaataagactatcagttgacttctcagcagaaatcccacgggtcacgaaggagtgggatgatatactcaaagtgctgaaaggaaaaaactgtctttcaatggtactttactcagcaaagctgtcctttgtaaaggaaggagagataaagattatcccagacaaacaaaagctaagagagttcatcaccactaagactgccttacaagaaatggtaaacgaaattgttcaagctgaaatgaaaagacaccaattagtagcatgaaaatatagtatttttactccctggtaaaaataaatatgtaggcaaattcagaatactccaatatcctaatgatggtgtttaaattcattttaactctagtataaatgttaaaagacaaaagtattaaaaataactatagctacaccaatgttaatggagacacaatataaaaaaagtaaatcataacatcaaaaaaaatggggagtaaaagtgtagagttaccagcttcaaatagactcataactataagatgttttgtgtaactccattgtaacatcaaaacagaaatctatagtagatacacaaaagataaagaatcaaaccataccactattgaaaatcatgaaattacaaaggaacataccaagagaggtataaagaaacaaaacaactgcaaaacaatcagaaaacaacaaaatggcaatagtaagtccacaatggaatgttattcagccttagaaaaaaggacatactgccatttgtgacaacatggatgaacctggaggacattatgttaagcgaaataaaccagacacaaacagacaaatactgcataatataacttatatgtcaaatctaagaaagttgaactcatagaaacagagagtagaattgtactaacagggattgagtgtgaggacaatggggagatgttggtcaaaggatacaaactttcatttataagatgaataaattttggagacctagtgtacagtgtggtgactatagctcataatatacccttgaaatttgctaacagggtagattttaaatgttctcaacacacacacacacacacacacacatgcacacgcacagaggtcagtatgtgaagtgatagatatgttgattgtggtaatagttttataatgtatgtgtgtgtgtgtgtgtgtgtgtgtgtgtatatatatatatatatatataatcacagtatatatctttaatagatatactttttatttgtcaatcactcctaagcttgaaaactcaccattttcaaagcagtcactcctttcatgtccacatttcatcagggaatgattttgtcccattattaatataagtaccatttcccatatattgtttgatttaaagatttctgtttctcccatgttttcattgtgcagtctgaactactattggcacaactatatttacataaacagttctaaacctagggatcaattattgttatttttgtttagaaaatatttttatgaatatcaatggctttttcttttgagattctactgtattcatatagtgtactttactacctgtaccttatttatattttaccagctagggagctgaggggaactcaaaatatccaagactttgggcctaaatttctaaaaatggtcattaaaataggaagtattaaaggagtgtgggttgtggactttcgtactgattagcatgaacatttgaaaagcgtaaaagtagtgctacaaaatatttcaggtttacatatctttattatatgttcagtcaaagctgtcaaaatcggttcttacagttttaattataattgcaaaataaaaattttataaatttcggtgtaatcttttataatctttagcagatataagttcatttaatttatttagaagtgttgcataaaactcctttgctatattttctaatatgtaggtatcattgagaggctctgctgtgaaaaaatatatattgtagaaatgttaggaatttgtggtaaattagtcttcattgatttttcaggttttagaatttctattgagtcataatattctagtctgacattttttctttttttgagaaacagtgagatgatggcaaagtgaatatgtcccattttttattgcttttcatcaaatgttactttctcataaactgcagagtgaacctttctccaccaagtaattatgctgatatgttgtacattcttaatactccttaaaagtgagggaaaataaacatatcaaatgtcaaatagtataaaaaaatttctctactaatctgagaataagaattatatgtttggattcccttgatcatatatctctttatgaggatggtaccaacaacccaataggaatttaccataaaaaaaaacacaaacactgatataatacaactaatataagacattttattataatttatactaaaaccataataaaaaggttgtttatacttaatgggacaatccagggaggggaggaatacaaggctgaacaccagttgatatgagaaggctctgagattttggttgttaaaagtcactctgcaccagcatgtgatgtgtctgcaatgctgttataaatgccatcttaggcagatttgacagagggattcggagattatgtagacctgttgggctctgctaatcagaaaacatctctaaaaagatataagaagaaataagagctgaaatggtaactattgtcgtaatccttcatttagttactaataactaacatttatggagtatttactgtgtcaaagacactgctaagcccattatgttatcttacttactatgatttaatccttacaacaatctatttctatggacacctactttattccatagcctatgctagagattgaggattcaaaaaattaaagttgcctgacttagagtgagttcacagaaggacccactgagagaagtagggtgattgattgcccaaagaaaaagtgattgagaatgtaacagttggtggctgtgccagagtctgaagggctgtcatggatatgctaaggggatgacatttttaatatagaggaagggggaataaaggcacaaaaattatgaggaaatagatatcagtcactctagtgaaatccagatagttatcta

SEQ ID NO: 1827 - DNA, 9717 bp, Homo sapiens
ttccttgatacgtcaaaatctcctaaactgagcattatttcctttactaaatctgctcctaatttagctccctatagaatcacatgctgaagccagttttaggagtcatcctaagttgccattaacccctgaactatgccattaatatcctatgctataacaccactcaccaaattccatttattctactacttaatgtgacccacctgtgatccttagcacccttattattctcacttgagtgctgtaattcctcctcactgacaaggaagcaagatagtgggtaaaggatgggatatgagagcaagatagacagaatttgaatttacacctctgggtttactctatgtataatttctccaagcctcagttctttacataaaatggtgaaataataatacttacatcataaagttgatgtaaagaatttaaggaaaaatgcacgaaaagtgtttagtgcagtatctgacttctagtaggtgtcaatgagtgttaacgtgtgttattactaggaatatgtctccctgcatctgcattcgataatacctctgtataaagtagacctgtcacatagaatcatttaatgagcctaagcatttcatgtttaccttcttagatatattgcttaattcatttatggttagggttctaggcatattaattggtacatgcacaatactgcagatatatatttcttatgggtcaatcaagctgtatttgattgaagaaaaaaatgaatgttataaatgataatatttgttacagtagaatttcctatatatttggatattttctaggcaaggttgaaattagtgtgcatatatgtggctcatgcttctatttaattaaattattacaagattagaatacaataattacttagtcataattacatagcaagaaatataattggcaagggagatatttttaaagatattaaatcagaatccattgcaaaaacaatagtttactgtatcagtacaaaagtagaataggttggaagaaaaccaaagaaggaaagaggaatctgtaatctttgattacattatttgcactgaattattaaagcagatgatagtgtgaataaatcatgctagagaaaccctatgctttaggctgaaaatttggaattccaatgttctaacttgggaaatattagtatctccttaggaatcctgggtagaaggaattttctggatattcgagtctatcctctagctccaggtcattgtcagtggcccctgaaacatattattattatatgttaatgaatatttctccagtagtaaaaagtgagagctgcacttattgaattcacattatacatcatactttggattaaagttttacctatggtaaatttcatttattcttcaatatatgcctattgggtattatcaacttcattttacaaacgaagaaattgaagttcagcaacattaaatatcatgccccaagtcacacagctattgagccgcttttctgagaattctatccaggcgtgtttatgagatatgaaccacagtccctgccttctggatgtgtgccatattttgcctactagtgaagggactcatttttacatgctccttggtccaaagagtagaaaatggcctaatttcagcaagcaataatgaactgcagtttgtgttaatcatttgaagctgctgataaaattggggattagcaactcaactttagtaagcactcttgtctattgtaaatatatttggagtgggtgatgtatgttagttaatatatgtatttaataatactataatagctaacattttatagtgtttaccatgtgctgggtaaaattccaagtcctgtacattcataaactctttcagtgttaacagcaaacacatggaaatagtactgtcataacttatatattacagatgagaaaattgaggcacagaaggccaaatactttgtccacattcacacaaccagtaaatggaaaactggattaaaatgtaggcagtgtagcacaagaatttagatagtcaacaactattctatgaaacaaatacacatagaaaaagatttgacatgtgtaaatgatttaattgaatatatatatatagagagagagtatttcttcagaatttttacccttatttttgatttttttgaaagtttctaaaaatttattaaaattgaaataaaactatattaaacttccacatggctatcctcagattcagcgattactgcattttgccttaccaaaaatggttgatagttctctaaagtgttgtataatccagacttctctggttacttgtggtttcttttatctttttcatctgtgccctgtttttcccattccttcacaactttgtcaatatttagtgttataggtgagtgtgtgtgtgtgtgtgtgtgtgtgtgcgcgtgcatgtgcggggagtggtggtggtggtgtttggttctgttgttggtattgttctgtttagttttagccattctggtcagtgtataatggtatcttattgtggttttaatttgaatttgtctcctgattgatgacattgagtagtttttcatctgcttttgggcatttgtgtatcttctttagtgaaatgtttttttttctttttttcagttgttctgcccatttgttttagtggttatctttttattattgagttgtagttatccttaatatatcatagatactaacccttggacagatatatatttttataaatagcatctcaagttattgctttcctattcattttcttaatggtgtttttcaaagattagaattttttgatttgatgaagtctaatatatcatttgtttttctctctttgcttacattctgtgacatgcctaagaaactttgactaacatcaagttatgcatacattttatgtttctccaatagctttttatttcagattttgtgtttagatatatagtttgaattatttttatgcatgatttgaggtagtggctgagagttcactaatttccatacgaatgttgttactctagcaccattttttaagaagacttaccttttcttatttgatcatttttttatatttgtcaaatatctaatgaataaataattggggatttatttctgatgttgatattctttcactgatctatttggccagtatcatacagtcttgattattgagaattgtactaactcttgaaggcaagtagtgtaaatcctctaactttgttcttttactaaattgctttcaacattctagatgctttgcatttccatgtaagttttataaacagcttatcaattttcataaaatagtcactagagttattaagttttgttgaatcttttgtaatttgaggatcattactatattaacagtgttaagtctttcagttcaggagtataactatctatatcttctttactttctctcagcaatgcttttatcattttcagtttataggtcttacatacctttgactaaatttgttcctaaatattttatggtgatgctattgcaaacataattgatttttaaatttcatagttcagtgggtttctcctggtatataaaatatatacaatttttatacattaatattgtgatatttgagctgtctaaaattactcgtttattctatcaattttgtacattcctttggatattctatgtaaattttcatatcattaggaaatataggtggttttacttctacccttctaatgtttatacattttatttctttctcttattgcaatgagtatggcctctagtaaaacagtgggtgagttgtgagactatacatcattacctttgtcttaattttaggaggagaattacattcaatatttgaccattaagttagatattagctgtagcattttctagcacctttatcaggttgaagaaattttcttcttttcccggttttctaagagtcttttttgaaaaaaaaaaaaaaaaactctattgaggtataaattacaaacagcaaaatacaccatcttaagtgtattatcataatcaagatacagtatattaaacatctccacaaatttctcttgtaccccataccagtaaatcttcaccctatcccagtctctgcttctgtctctgtacatgaagtttgtgtttcctagaagacatatatcttcttatgatttgaatcatagagtttgtatacttttgtaactggcttttttattcagtataaggttttttgagaaatactggtgtggttccgtgtctctgtaattgacaattttcaattctttttttttatattgctaatttctctatctatgcttgttctcatctcctgtcagcttttgcagattttgtgctaccaattatacttggattttcctgtctccctgccttcttttatgtttctccttaacaagattccatctccttcattacccaactttgagactagagaccatgtcttcatacactttatattcatttagtcagtcctttattgagtgtctgtgttgtggctgccatcatgggctcttaagtgatgccaatactgctggttcaagaatcgcatttgaatagatagcttctagaatattctaggatactggggacaggtgaaggttagattactaaatatttcctcatctaatacaaataatatatgtaatttcatgtaaacatacaaaatattaaaatttatatttatcaagaaggcagattatactgcaggtgatcagaactaaatttttatgtacatatatatggttattcaattcataaatgtttttataaaacatgggaatatctgagatacactgaatttacaaaccttggagagaccacctatatggattcttcaatcaggagcacgttcatatttagcctatctgttagcttatcacaattgacagagatgctttggttgtgagtttggaatatgaacataaatgtggttgatggagagacaaaataaaggatttttcttaatgagaatatagaaaaatagatggatttacctaattaatattactcacgtgtttaaacagaatacacacaattagaataagatttaaagaaataagacttcgtattgtaaatagagatcttattattaatatttactaaattcctttttaatcgaactctaggattttgaatcttagcgcttcttatagtcttccagaagactttttacttttctcattctattgtttaatccttttattacagagtaccaattacttttaaaatggcagaaaaagaaagttttgcagtggtgtgagggcacctttcttgatgaatcatcatgataacattttaagtagacaaaggctatttgttttctgacttactttgccattgttttctcagatatccttatttaggccaggtgcggtggctcacgcctgcaatcccagcactttgggaggccaaggcgggcagatcacctgaggtcaggagttcgagaccagcctggccaatatggcaaaactccatctctactaaaaatacaaaaattagctaggcatggcggtatgctcctgtaatcccagctacttgagagggaggctgaggcaagagaatcgcttgaattcgggaggtggagattgcagtgagccaagagcatgccactgcactccagcctgggcgacaagtgtgaaactccatctcaaaataaataaataaataaataaataaataaattcttatttatatcttctcttaaatagctatccagtaaactagcattatcagctcacaagataatttagacatttctttctatgaagtttgagattaaaattacatacatatacacatgtatctatttcatagcataattttaagagcacactttaaaaaaataacaaaataattaaacaaccaaaaggtagtgtgtaagctacaaaaaatgtcttcaaatcaattcctgcatttggaaaaatcccaaatgttaactagtcaaaacttctgatgattcacaaattgatattctattaaaattcagtcataagaatgaacatttgcattagaaaaaaaatcaatattcaaggcccaggtagcctaggctatttttaatgtttgccttaatataattatctttattgactatgacagttattttatggtatctagaaaaatagtctgcataaacaataatgcaataaatatctttatatatatgaatgtatctgataattttcataataaaaattcctttgttgttcagaagataggcactttttataaggttttagttatcactaacaacatgcttcctctcaaatttgtatttggatggtaaatgtcagtttctctaaaccctgagtaggttcatttttttttagtattatactttaagttttagggtacatgtgcacaacgtgcaggtttgttacatatgtatacatgtgccatgttggtgtgctgcacccattaactcttcatttaacattaggtatatctcctaatgctatccctccccactccccccaccccacaacagtccccggtgtgtgatgttccccttcctgtgtccatgtgttctcattgttcaattcccacctatgagtgacaacatgcggtgttgggttttttgtccttgtgatagtttgctgagaatgatggtttccagcttcatccatgtccctacaaaggacatgaactcatcatttttatggctgcatagtattccatggtgtatatgtgccacattttcttaatccagtctatcattgttggacatttgggttggttccaagtctttactattgtgaatagtgccgcaataaacatacgtgtgcatgtggctttatagtagcatgttttataatcctctgggtatatacccagtaatgggatgactgggtcaaatggtatttctagttctagatccctgaggaatcaccacactgacttccacaatgcttgaactagcttacagtcccaccaatagtgtaaaagtgttcctatttcttcacatcctctccagcacctattgtttcctgactttttaatgatcgccattctaactggtgtgagatggtatctcattgtggttttgattttcatttctctgatggccagtgatgatgagcattttttcatgtgtctgttggctgcataaatatcttcttttgagaagtgtctgttcatatccttcgcccactttttgatggggttgtttgtttttttcttgtaaatttgtttgagttcattgtagattctggatattagccctttgtcagatgagtagattgcaaacattttctcccattctgtaggttgcctgttcactctgatggtagtttcttttgctgtgcagaagctctttagttgaattagatcccatttgtcaattttgtcttttgttgccattgcttttggtgttttagacatgaagtccttgcccatgcctatgtcctgaatggtattgcctaggttttcttctagggtttttatggttttaggtctaacatttaagcctttaatccatcttgaatttatttttgtataaggtataaggaagggatccagtttcagctttctacatatggctagccagttttcccagcaccatttattaaatagggaatcctttccccattgcttgtttttctcaggtttgtcaaagatcagatagttgtagatgtgtggtattatttctgagagctctgttctgttccattggtctatatctctgttttggtaccagtaccatgctgttttggttactgtagccttgtagtatagtttgaagtcaggtagcgtgatgcctccagctttgttcttttgcgttaggattgacttggcaatgcaggctcttttttggttccatatgaagtttaaagtagttttttccaattctgtgaagaaagtcattggtagcttgatggagatggcattgaatctataaattacctcgggcagtgtggccattttcacgatattgtttcttcctacccatgagcatgggatgttcttccatttgtttgtatcctcttttatttcattgagcagtggtttgtagttctccttgaagagatccttcacatcccttgtaagttggattcctaggtattttattctctttgaagcaattgtgaatgggagttcactcatgatttggctctctgtttgtctgttattggtgtataagaatacttgtgatttttgggcattgattttgtatcctgagactttgctgaaattgcctatcagcttaagattttgggctgagaaatggggttttctagatatacaatcatgtcatctgcaaacagggacaatttgacttcctcttttcctaattgaataccctttatttccttctcctgcctgattgccctggctagaacttccaacaccatgttgaataggagtggtaagagagggcatccctgtcttgtgccagttttcaaagggaatgcttccagtttttgtccattcattatgatactggctgtgggtttgtcatagatagctcttattattttgagatacatcccatgaatacctaatttattgagagtttgtagcatgaaaggttgttgaattttgtcaaaggccttttctgcatctattgaggtaatcatgtggtttttgtctttggttctgtttatatgctggattacgtttattgatttgcatatgttgaaccagccttgcctccaagggatgaagcccacttgatcatggtggataagctttttgatgtgttgctggattcggtttgccagtcttttattgaggatttttgcatctatgttcatcagggatattgctctaaaattctcttttttttgtgtgtctgtgccaggctttggtatcaggataatgctggcctcataaaatgagttagggaagattccctctttttctattgattggaatagtttcagaaggaatggtaccagctcctctttgtacctgtggtagaatttggctgtgaattcatctggtcctggacattttttggttggtaagcttttaattattgcatcaatttcagtgcctgttattggtctattaaataccttattttcacagagataccttctccaactcctcagcatgggtttagtccccttgctacaagctcccaagatatcctgggcttatgcttcacaacactgagcccatataatggtgttaattgagtaactgcttttattctttgctaatctgtgagcttcattaggaagggaaccaggtattatttactctgcacttaacacgttgcttgcacatggtagacactaaaaaaatagctactgggtttttacagtaatcaaatgaccgtgttagtatcttcgaaattgacatcctccaggtttttaaaaatctttttccaagatatctcagagttttatgtatttatttattttgttaatttttagtttattttaagttccagatacatgtgcaggatgtgcaggtttgttacttagtgccatggtggtttgctgcgcctatcaacccatcatctaggtattaagccctgcatgcatcagctatttatcctgatgctctccctcccccggcagtccaccagcaggttccagtgtgtgttgttcccctccatgtgtcaatgtgttctcattgttcagctcccacttacaagtgtatctcagagttttaaacaggtaattggatgacctctgaaggcttatctctcagactttcacagcatccagtaataattactttgtaagaacctagcaaattttgataagcaaacatctaaata

SEQ ID NO: 1828 - DNA, 12236 bp, Homo sapiens
ttccttgatacgtcaaaatctcctaaactgagcattatttcctttactaaatctgctcctaatttagctccctatagaatcacatgctgaagccagttttaggagtcatcctaagttgccattaacccctgaactatgccattaatatcctatgctataacaccactcaccaaattccatttattctactacttaatgtgacccacctgtgatccttagcacccttattattctcacttgagtgctgtaattcctcctcactgacaaggaagcaagatagtgggtaaaggatgggatatgagagcaagatagacagaatttgaatttacacctctgggtttactctatgtataatttctccaagcctcagttctttacataaaatggtgaaataataatacttacatcataaagttgatgtaaagaatttaaggaaaaatgcacgaaaagtgtttagtgcagtatctgacttctagtaggtgtcaatgagtgttaacgtgtgttattactaggaatatgtctccctgcatctgcattcgataatacctctgtataaagtagacctgtcacatagaatcatttaatgagcctaagcatttcatgtttaccttcttagatatattgcttaattcatttatggttagggttctaggcatattaattggtacatgcacaatactgcagatatatatttcttatgggtcaatcaagctgtatttgattgaagaaaaaaatgaatgttataaatgataatatttgttacagtagaatttcctatatatttggatattttctaggcaaggttgaaattagtgtgcatatatgtggctcatgcttctatttaattaaattattacaagattagaatacaataattacttagtcataattacatagcaagaaatataattggcaagggagatatttttaaagatattaaatcagaatccattgcaaaaacaatagtttactgtatcagtacaaaagtagaataggttggaagaaaaccaaagaaggaaagaggaatctgtaatctttgattacattatttgcactgaattattaaagcagatgatagtgtgaataaatcatgctagagaaaccctatgctttaggctgaaaatttggaattccaatgttctaacttgggaaatattagtatctccttaggaatcctgggtagaaggaattttctggatattcgagtctatcctctagctccaggtcattgtcagtggcccctgaaacatattattattatatgttaatgaatatttctccagtagtaaaaagtgagagctgcacttattgaattcacattatacatcatactttggattaaagttttacctatggtaaatttcatttattcttcaatatatgcctattgggtattatcaacttcattttacaaacgaagaaattgaagttcagcaacattaaatatcatgccccaagtcacacagctattgagccgcttttctgagaattctatccaggcgtgtttatgagatatgaaccacagtccctgccttctggatgtgtgccatattttgcctactagtgaagggactcatttttacatgctccttggtccaaagagtagaaaatggcctaatttcagcaagcaataatgaactgcagtttgtgttaatcatttgaagctgctgataaaattggggattagcaactcaactttagtaagcactcttgtctattgtaaatatatttggagtgggtgatgtatgttagttaatatatgtatttaataatactataatagctaacattttatagtgtttaccatgtgctgggtaaaattccaagtcctgtacattcataaactctttcagtgttaacagcaaacacatggaaatagtactgtcataacttatatattacagatgagaaaattgaggcacagaaggccaaatactttgtccacattcacacaaccagtaaatggaaaactggattaaaatgtaggcagtgtagcacaagaatttagatagtcaacaactattctatgaaacaaatacacatagaaaaagatttgacatgtgtaaatgatttaattgaatatatatatatagagagagagtatttcttcagaatttttacccttatttttgatttttttgaaagtttctaaaaatttattaaaattgaaataaaactatattaaacttccacatggctatcctcagattcagcgattactgcattttgccttaccaaaaatggttgatagttctctaaagtgttgtataatccagacttctctggttacttgtggtttcttttatctttttcatctgtgccctgtttttcccattccttcacaactttgtcaatatttagtgttataggtgagtgtgtgtgtgtgtgtgtgtgtgtgtgcgcgtgcatgtgcggggagtggtggtggtggtgtttggttctgttgttggtattgttctgtttagttttagccattctggtcagtgtataatggtatcttattgtggttttaatttgaatttgtctcctgattgatgacattgagtagtttttcatctgcttttgggcatttgtgtatcttctttagtgaaatgtttttttttctttttttcagttgttctgcccatttgttttagtggttatctttttattattgagttgtagttatccttaatatatcatagatactaacccttggacagatatatatttttataaatagcatctcaagttattgctttcctattcattttcttaatggtgtttttcaaagattagaattttttgatttgatgaagtctaatatatcatttgtttttctctctttgcttacattctgtgacatgcctaagaaactttgactaacatcaagttatgcatacattttatgtttctccaatagctttttatttcagattttgtgtttagatatatagtttgaattatttttatgcatgatttgaggtagtggctgagagttcactaatttccatacgaatgttgttactctagcaccattttttaagaagacttaccttttcttatttgatcatttttttatatttgtcaaatatctaatgaataaataattggggatttatttctgatgttgatattctttcactgatctatttggccagtatcatacagtcttgattattgagaattgtactaactcttgaaggcaagtagtgtaaatcctctaactttgttcttttactaaattgctttcaacattctagatgctttgcatttccatgtaagttttataaacagcttatcaattttcataaaatagtcactagagttattaagttttgttgaatcttttgtaatttgaggatcattactatattaacagtgttaagtctttcagttcaggagtataactatctatatcttctttactttctctcagcaatgcttttatcattttcagtttataggtcttacatacctttgactaaatttgttcctaaatattttatggtgatgctattgcaaacataattgatttttaaatttcatagttcagtgggtttctcctggtatataaaatatatacaatttttatacattaatattgtgatatttgagctgtctaaaattactcgtttattctatcaattttgtacattcctttggatattctatgtaaattttcatatcattaggaaatataggtggttttacttctacccttctaatgtttatacattttatttctttctcttattgcaatgagtatggcctctagtaaaacagtgggtgagttgtgagactatacatcattacctttgtcttaattttaggaggagaattacattcaatatttgaccattaagttagatattagctgtagcattttctagcacctttatcaggttgaagaaattttcttcttttcccggttttctaagagtcttttttgaaaaaaaaaaaaaaaaactctattgaggtataaattacaaacagcaaaatacaccatcttaagtgtattatcataatcaagatacagtatattaaacatctccacaaatttctcttgtaccccataccagtaaatcttcaccctatcccagtctctgcttctgtctctgtacatgaagtttgtgtttcctagaagacatatatcttcttatgatttgaatcatagagtttgtatacttttgtaactggcttttttattcagtataaggttttttgagaaatactggtgtggttccgtgtctctgtaattgacaattttcaattctttttttttatattgctaatttctctatctatgcttgttctcatctcctgtcagcttttgcagattttgtgctaccaattatacttggattttcctgtctccctgccttcttttatgtttctccttaacaagattccatctccttcattacccaactttgagactagagaccatgtcttcatacactttatattcatttagtcagtcctttattgagtgtctgtgttgtggctgccatcatgggctcttaagtgatgccaatactgctggttcaagaatcgcatttgaatagatagcttctagaatattctaggatactggggacaggtgaaggttagattactaaatatttcctcatctaatacaaataatatatgtaatttcatgtaaacatacaaaatattaaaatttatatttatcaagaaggcagattatactgcaggtgatcagaactaaatttttatgtacatatatatggttattcaattcataaatgtttttataaaacatgggaatatctgagatacactgaatttacaaaccttggagagaccacctatatggattcttcaatcaggagcacgttcatatttagcctatctgttagcttatcacaattgacagagatgctttggttgtgagtttggaatatgaacataaatgtggttgatggagagacaaaataaaggatttttcttaatgagaatatagaaaaatagatggatttacctaattaatattactcacgtgtttaaacagaatacacacaattagaataagatttaaagaaataagacttcgtattgtaaatagagatcttattattaatatttactaaattcctttttaatcgaactctaggattttgaatcttagcgcttcttatagtcttccagaagactttttacttttctcattctattgtttaatccttttattacagagtaccaattacttttaaaatggcagaaaaagaaagttttgcagtggtgtgagggcacctttcttgatgaatcatcatgataacattttaagtagacaaaggctatttgttttctgacttactttgccattgttttctcagatatccttatttaggccaggtgcggtggctcacgcctgcaatcccagcactttgggaggccaaggcgggcagatcacctgaggtcaggagttcgagaccagcctggccaatatggcaaaactccatctctactaaaaatacaaaaattagctaggcatggcggtatgctcctgtaatcccagctacttgagagggaggctgaggcaagagaatcgcttgaattcgggaggtggagattgcagtgagccaagagcatgccactgcactccagcctgggcgacaagtgtgaaactccatctcaaaataaataaataaataaataaataaataaattcttatttatatcttctcttaaatagctatccagtaaactagcattatcagctcacaagataatttagacatttctttctatgaagtttgagattaaaattacatacatatacacatgtatctatttcatagcataattttaagagcacactttaaaaaaataacaaaataattaaacaaccaaaaggtagtgtgtaagctacaaaaaatgtcttcaaatcaattcctgcatttggaaaaatcccaaatgttaactagtcaaaacttctgatgattcacaaattgatattctattaaaattcagtcataagaatgaacatttgcattagaaaaaaaatcaatattcaaggcccaggtagcctaggctatttttaatgtttgccttaatataattatctttattgactatgacagttattttatggtatctagaaaaatagtctgcataaacaataatgcaataaatatctttatatatatgaatgtatctgataattttcataataaaaattcctttgttgttcagaagataggcactttttataaggttttagttatcactaacaacatgcttcctctcaaatttgtatttggatggtaaatgtcagtttctctaaaccctgagtaggttcatttttttttagtattatactttaagttttagggtacatgtgcacaacgtgcaggtttgttacatatgtatacatgtgccatgttggtgtgctgcacccattaactcttcatttaacattaggtatatctcctaatgctatccctccccactccccccaccccacaacagtccccggtgtgtgatgttccccttcctgtgtccatgtgttctcattgttcaattcccacctatgagtgacaacatgcggtgttgggttttttgtccttgtgatagtttgctgagaatgatggtttccagcttcatccatgtccctacaaaggacatgaactcatcatttttatggctgcatagtattccatggtgtatatgtgccacattttcttaatccagtctatcattgttggacatttgggttggttccaagtctttactattgtgaatagtgccgcaataaacatacgtgtgcatgtggctttatagtagcatgttttataatcctctgggtatatacccagtaatgggatgactgggtcaaatggtatttctagttctagatccctgaggaatcaccacactgacttccacaatgcttgaactagcttacagtcccaccaatagtgtaaaagtgttcctatttcttcacatcctctccagcacctattgtttcctgactttttaatgatcgccattctaactggtgtgagatggtatctcattgtggttttgattttcatttctctgatggccagtgatgatgagcattttttcatgtgtctgttggctgcataaatatcttcttttgagaagtgtctgttcatatccttcgcccactttttgatggggttgtttgtttttttcttgtaaatttgtttgagttcattgtagattctggatattagccctttgtcagatgagtagattgcaaacattttctcccattctgtaggttgcctgttcactctgatggtagtttcttttgctgtgcagaagctctttagttgaattagatcccatttgtcaattttgtcttttgttgccattgcttttggtgttttagacatgaagtccttgcccatgcctatgtcctgaatggtattgcctaggttttcttctagggtttttatggttttaggtctaacatttaagcctttaatccatcttgaatttatttttgtataaggtataaggaagggatccagtttcagctttctacatatggctagccagttttcccagcaccatttattaaatagggaatcctttccccattgcttgtttttctcaggtttgtcaaagatcagatagttgtagatgtgtggtattatttctgagagctctgttctgttccattggtctatatctctgttttggtaccagtaccatgctgttttggttactgtagccttgtagtatagtttgaagtcaggtagcgtgatgcctccagctttgttcttttgcgttaggattgacttggcaatgcaggctcttttttggttccatatgaagtttaaagtagttttttccaattctgtgaagaaagtcattggtagcttgatggagatggcattgaatctataaattacctcgggcagtgtggccattttcacgatattgtttcttcctacccatgagcatgggatgttcttccatttgtttgtatcctcttttatttcattgagcagtggtttgtagttctccttgaagagatccttcacatcccttgtaagttggattcctaggtattttattctctttgaagcaattgtgaatgggagttcactcatgatttggctctctgtttgtctgttattggtgtataagaatacttgtgatttttgggcattgattttgtatcctgagactttgctgaaattgcctatcagcttaagattttgggctgagaaatggggttttctagatatacaatcatgtcatctgcaaacagggacaatttgacttcctcttttcctaattgaataccctttatttccttctcctgcctgattgccctggctagaacttccaacaccatgttgaataggagtggtaagagagggcatccctgtcttgtgccagttttcaaagggaatgcttccagtttttgtccattcattatgatactggctgtgggtttgtcatagatagctcttattattttgagatacatcccatgaatacctaatttattgagagtttgtagcatgaaaggttgttgaattttgtcaaaggccttttctgcatctattgaggtaatcatgtggtttttgtctttggttctgtttatatgctggattacgtttattgatttgcatatgttgaaccagccttgcctccaagggatgaagcccacttgatcatggtggataagctttttgatgtgttgctggattcggtttgccagtcttttattgaggatttttgcatctatgttcatcagggatattgctctaaaattctcttttttttgtgtgtctgtgccaggctttggtatcaggataatgctggcctcataaaatgagttagggaagattccctctttttctattgattggaatagtttcagaaggaatggtaccagctcctctttgtacctgtggtagaatttggctgtgaattcatctggtcctggacattttttggttggtaagcttttaattattgcatcaatttcagtgcctgttattggtctattaaataccttattttcacagagataccttctccaactcctcagcatgggtttagtccccttgctacaagctcccaagatatcctgggcttatgcttcacaacactgagcccatataatggtgttaattgagtaactgcttttattctttgctaatctgtgagcttcattaggaagggaaccaggtattatttactctgcacttaacacgttgcttgcacatggtagacactaaaaaaatagctactgggtttttacagtaatcaaatgaccgtgttagtatcttcgaaattgacatcctccaggtttttaaaaatctttttccaagatatctcagagttttatgtatttatttattttgttaatttttagtttattttaagttccagatacatgtgcaggatgtgcaggtttgttacttagtgccatggtggtttgctgcgcctatcaacccatcatctaggtattaagccctgcatgcatcagctatttatcctgatgctctccctcccccggcagtccaccagcaggttccagtgtgtgttgttcccctccatgtgtcaatgtgttctcattgttcagctcccacttacaagtgtatctcagagttttaaacaggtaattggatgacctctgaaggcttatctctcagactttcacagcatccagtaataattactttgtaagaacctagcaaattttgataagcaaacatctaaataaaaacagaactttaagccccagagactttatctacttcccacttagaaattctttatcataatacagtagttctgtttactacataccattgatgttactattgttgttagcgatatggagtaacagactttgtccagttttgagagatgggaggaaaatgtgaagtggcagataattatgtataattatatatattagaattatatataaaataataattatagaattctctacgtatagaatttctatacataaaattctataaattctatttttatgttcagtgtatgtaaaaacatctcatagtgtaaagaatagatatagatagaagatttttatcaaaaggaaattgatttttctctttcttattaaataaatgctgaacaattatttaaagaatattggttggaaagactccaagttgttagcctgcccagggcacccacataccttggtacagtcatggtcttataataataaggcagtgtctgagtactcacagttttaaagtacatgacagatccttacatggtatctgctcactcatgcttgatttaataatgcttgtcatgacctagactttgaggttgctaaacacttatgactctgtatgttaagtcacactgtaatatttttttccacaaatatttttacaagagtagacctttcaagtggtgagtagttcattttgacaacaatcaactctattatcaagagtggatattctatttttcaatgttcagaagtgattattaattttttggccataaacgttaaattctagttcttggcaattttcctagagacttagtaagagaagatcttactttcccaatttccaaagtatataaataaatcttcaggtctaaaggagtaatttcaatgaaatgtgatacctttatttgtgtgtgaactcttagatgacacaaattaagttgatttgaggtttgtgctgtgtcaagctatgtatataataaatgcttccagagaatatgagctactgttctgatgttgccagaatttcatttttcacaaaagggatacatagttttctagctaatgttttcttcatgagcacacgtttcaagttcacttatgtgtgtgcacgtatgtgtgtatgtttcaccaaacatgtaagcttgttctttatactgacaagtatatgtaggaatacttgttatatgaaattaggtactacaagacatgtattaataatttggttcagcatataaatattaagtgtagagcaactgggaaagagaaatagcagacggcacaaatcactgaattttaatcgacgtcccctcccctggcagtacttttaagttcctatatgacattcacaaagggatttgatgttaaaatattcagaggaaacaatgatcaggccagctgcagaaggtaaaatgcacttcctagtcttgaaagacttatatttgaattgctgttcactgtagttacataaactaaagttgaattatatatgaatcacattgtgtttatgaattatatatgtaattttatagaccttttgcaacttatacagccttattcatagtatcttcttttttcccccacaattaacatgccatatagatgtatgtatatggcatgttgtgtgtgtgtgtgtgtgcgtgtgagtgtatttaaccctattttataaactaacacttaaggatattgaatgactaacctgaccttacaagtattaagttccatatccaattactggaagactaagaatcttagttaacatctactaagtaaatatataagaattctgcaatatggaaatgaaacaaaccttctagcaaatatatgctgagtacctactgtgtgcaaagcagtgtgggaacctcattttctcagggctcagcagcatgttctaaatcccttgggtgttttatagttgcattttccgtcattataaaggcatgaccctcttctgggcttcaagccaaacactgaacagcatgagataatgtgcaaacgcttattcttgacatctgataatttataaaaacgaagttgtacatgagaaagattcctataaatatattttatataaaatcatttgtagaagattttactttttaaattaaattatttgtttttcacttaaaagattgttgataaatttggcctactaagctgttacagaccagacatccctagtgtctgcaattctccctgggaatgcttgtcactttgtaggaatcatattatctttttgaggccacctgaagatagtttattaatttgttggtttaccagtctcttaattatcctgaaagacttaactccatttccaaaggtgctacagggtgtagcactgtaaatctgatacttgatggtaatttttacattatataaatttctttcatgggaaattccatatgcataactagaagggaatcctgactgggatttttttttcttttcttattatcttcaatttaaagcactttgcttcttttgctcgctgaagagaagaaataacacatatgagttattggta

SEQ ID NO: 1829 - DNA, 14437 bp, Homo sapiens
ttccttgatacgtcaaaatctcctaaactgagcattatttcctttactaaatctgctcctaatttagctccctatagaatcacatgctgaagccagttttaggagtcatcctaagttgccattaacccctgaactatgccattaatatcctatgctataacaccactcaccaaattccatttattctactacttaatgtgacccacctgtgatccttagcacccttattattctcacttgagtgctgtaattcctcctcactgacaaggaagcaagatagtgggtaaaggatgggatatgagagcaagatagacagaatttgaatttacacctctgggtttactctatgtataatttctccaagcctcagttctttacataaaatggtgaaataataatacttacatcataaagttgatgtaaagaatttaaggaaaaatgcacgaaaagtgtttagtgcagtatctgacttctagtaggtgtcaatgagtgttaacgtgtgttattactaggaatatgtctccctgcatctgcattcgataatacctctgtataaagtagacctgtcacatagaatcatttaatgagcctaagcatttcatgtttaccttcttagatatattgcttaattcatttatggttagggttctaggcatattaattggtacatgcacaatactgcagatatatatttcttatgggtcaatcaagctgtatttgattgaagaaaaaaatgaatgttataaatgataatatttgttacagtagaatttcctatatatttggatattttctaggcaaggttgaaattagtgtgcatatatgtggctcatgcttctatttaattaaattattacaagattagaatacaataattacttagtcataattacatagcaagaaatataattggcaagggagatatttttaaagatattaaatcagaatccattgcaaaaacaatagtttactgtatcagtacaaaagtagaataggttggaagaaaaccaaagaaggaaagaggaatctgtaatctttgattacattatttgcactgaattattaaagcagatgatagtgtgaataaatcatgctagagaaaccctatgctttaggctgaaaatttggaattccaatgttctaacttgggaaatattagtatctccttaggaatcctgggtagaaggaattttctggatattcgagtctatcctctagctccaggtcattgtcagtggcccctgaaacatattattattatatgttaatgaatatttctccagtagtaaaaagtgagagctgcacttattgaattcacattatacatcatactttggattaaagttttacctatggtaaatttcatttattcttcaatatatgcctattgggtattatcaacttcattttacaaacgaagaaattgaagttcagcaacattaaatatcatgccccaagtcacacagctattgagccgcttttctgagaattctatccaggcgtgtttatgagatatgaaccacagtccctgccttctggatgtgtgccatattttgcctactagtgaagggactcatttttacatgctccttggtccaaagagtagaaaatggcctaatttcagcaagcaataatgaactgcagtttgtgttaatcatttgaagctgctgataaaattggggattagcaactcaactttagtaagcactcttgtctattgtaaatatatttggagtgggtgatgtatgttagttaatatatgtatttaataatactataatagctaacattttatagtgtttaccatgtgctgggtaaaattccaagtcctgtacattcataaactctttcagtgttaacagcaaacacatggaaatagtactgtcataacttatatattacagatgagaaaattgaggcacagaaggccaaatactttgtccacattcacacaaccagtaaatggaaaactggattaaaatgtaggcagtgtagcacaagaatttagatagtcaacaactattctatgaaacaaatacacatagaaaaagatttgacatgtgtaaatgatttaattgaatatatatatatagagagagagtatttcttcagaatttttacccttatttttgatttttttgaaagtttctaaaaatttattaaaattgaaataaaactatattaaacttccacatggctatcctcagattcagcgattactgcattttgccttaccaaaaatggttgatagttctctaaagtgttgtataatccagacttctctggttacttgtggtttcttttatctttttcatctgtgccctgtttttcccattccttcacaactttgtcaatatttagtgttataggtgagtgtgtgtgtgtgtgtgtgtgtgtgtgcgcgtgcatgtgcggggagtggtggtggtggtgtttggttctgttgttggtattgttctgtttagttttagccattctggtcagtgtataatggtatcttattgtggttttaatttgaatttgtctcctgattgatgacattgagtagtttttcatctgcttttgggcatttgtgtatcttctttagtgaaatgtttttttttctttttttcagttgttctgcccatttgttttagtggttatctttttattattgagttgtagttatccttaatatatcatagatactaacccttggacagatatatatttttataaatagcatctcaagttattgctttcctattcattttcttaatggtgtttttcaaagattagaattttttgatttgatgaagtctaatatatcatttgtttttctctctttgcttacattctgtgacatgcctaagaaactttgactaacatcaagttatgcatacattttatgtttctccaatagctttttatttcagattttgtgtttagatatatagtttgaattatttttatgcatgatttgaggtagtggctgagagttcactaatttccatacgaatgttgttactctagcaccattttttaagaagacttaccttttcttatttgatcatttttttatatttgtcaaatatctaatgaataaataattggggatttatttctgatgttgatattctttcactgatctatttggccagtatcatacagtcttgattattgagaattgtactaactcttgaaggcaagtagtgtaaatcctctaactttgttcttttactaaattgctttcaacattctagatgctttgcatttccatgtaagttttataaacagcttatcaattttcataaaatagtcactagagttattaagttttgttgaatcttttgtaatttgaggatcattactatattaacagtgttaagtctttcagttcaggagtataactatctatatcttctttactttctctcagcaatgcttttatcattttcagtttataggtcttacatacctttgactaaatttgttcctaaatattttatggtgatgctattgcaaacataattgatttttaaatttcatagttcagtgggtttctcctggtatataaaatatatacaatttttatacattaatattgtgatatttgagctgtctaaaattactcgtttattctatcaattttgtacattcctttggatattctatgtaaattttcatatcattaggaaatataggtggttttacttctacccttctaatgtttatacattttatttctttctcttattgcaatgagtatggcctctagtaaaacagtgggtgagttgtgagactatacatcattacctttgtcttaattttaggaggagaattacattcaatatttgaccattaagttagatattagctgtagcattttctagcacctttatcaggttgaagaaattttcttcttttcccggttttctaagagtcttttttgaaaaaaaaaaaaaaaaactctattgaggtataaattacaaacagcaaaatacaccatcttaagtgtattatcataatcaagatacagtatattaaacatctccacaaatttctcttgtaccccataccagtaaatcttcaccctatcccagtctctgcttctgtctctgtacatgaagtttgtgtttcctagaagacatatatcttcttatgatttgaatcatagagtttgtatacttttgtaactggcttttttattcagtataaggttttttgagaaatactggtgtggttccgtgtctctgtaattgacaattttcaattctttttttttatattgctaatttctctatctatgcttgttctcatctcctgtcagcttttgcagattttgtgctaccaattatacttggattttcctgtctccctgccttcttttatgtttctccttaacaagattccatctccttcattacccaactttgagactagagaccatgtcttcatacactttatattcatttagtcagtcctttattgagtgtctgtgttgtggctgccatcatgggctcttaagtgatgccaatactgctggttcaagaatcgcatttgaatagatagcttctagaatattctaggatactggggacaggtgaaggttagattactaaatatttcctcatctaatacaaataatatatgtaatttcatgtaaacatacaaaatattaaaatttatatttatcaagaaggcagattatactgcaggtgatcagaactaaatttttatgtacatatatatggttattcaattcataaatgtttttataaaacatgggaatatctgagatacactgaatttacaaaccttggagagaccacctatatggattcttcaatcaggagcacgttcatatttagcctatctgttagcttatcacaattgacagagatgctttggttgtgagtttggaatatgaacataaatgtggttgatggagagacaaaataaaggatttttcttaatgagaatatagaaaaatagatggatttacctaattaatattactcacgtgtttaaacagaatacacacaattagaataagatttaaagaaataagacttcgtattgtaaatagagatcttattattaatatttactaaattcctttttaatcgaactctaggattttgaatcttagcgcttcttatagtcttccagaagactttttacttttctcattctattgtttaatccttttattacagagtaccaattacttttaaaatggcagaaaaagaaagttttgcagtggtgtgagggcacctttcttgatgaatcatcatgataacattttaagtagacaaaggctatttgttttctgacttactttgccattgttttctcagatatccttatttaggccaggtgcggtggctcacgcctgcaatcccagcactttgggaggccaaggcgggcagatcacctgaggtcaggagttcgagaccagcctggccaatatggcaaaactccatctctactaaaaatacaaaaattagctaggcatggcggtatgctcctgtaatcccagctacttgagagggaggctgaggcaagagaatcgcttgaattcgggaggtggagattgcagtgagccaagagcatgccactgcactccagcctgggcgacaagtgtgaaactccatctcaaaataaataaataaataaataaataaataaattcttatttatatcttctcttaaatagctatccagtaaactagcattatcagctcacaagataatttagacatttctttctatgaagtttgagattaaaattacatacatatacacatgtatctatttcatagcataattttaagagcacactttaaaaaaataacaaaataattaaacaaccaaaaggtagtgtgtaagctacaaaaaatgtcttcaaatcaattcctgcatttggaaaaatcccaaatgttaactagtcaaaacttctgatgattcacaaattgatattctattaaaattcagtcataagaatgaacatttgcattagaaaaaaaatcaatattcaaggcccaggtagcctaggctatttttaatgtttgccttaatataattatctttattgactatgacagttattttatggtatctagaaaaatagtctgcataaacaataatgcaataaatatctttatatatatgaatgtatctgataattttcataataaaaattcctttgttgttcagaagataggcactttttataaggttttagttatcactaacaacatgcttcctctcaaatttgtatttggatggtaaatgtcagtttctctaaaccctgagtaggttcatttttttttagtattatactttaagttttagggtacatgtgcacaacgtgcaggtttgttacatatgtatacatgtgccatgttggtgtgctgcacccattaactcttcatttaacattaggtatatctcctaatgctatccctccccactccccccaccccacaacagtccccggtgtgtgatgttccccttcctgtgtccatgtgttctcattgttcaattcccacctatgagtgacaacatgcggtgttgggttttttgtccttgtgatagtttgctgagaatgatggtttccagcttcatccatgtccctacaaaggacatgaactcatcatttttatggctgcatagtattccatggtgtatatgtgccacattttcttaatccagtctatcattgttggacatttgggttggttccaagtctttactattgtgaatagtgccgcaataaacatacgtgtgcatgtggctttatagtagcatgttttataatcctctgggtatatacccagtaatgggatgactgggtcaaatggtatttctagttctagatccctgaggaatcaccacactgacttccacaatgcttgaactagcttacagtcccaccaatagtgtaaaagtgttcctatttcttcacatcctctccagcacctattgtttcctgactttttaatgatcgccattctaactggtgtgagatggtatctcattgtggttttgattttcatttctctgatggccagtgatgatgagcattttttcatgtgtctgttggctgcataaatatcttcttttgagaagtgtctgttcatatccttcgcccactttttgatggggttgtttgtttttttcttgtaaatttgtttgagttcattgtagattctggatattagccctttgtcagatgagtagattgcaaacattttctcccattctgtaggttgcctgttcactctgatggtagtttcttttgctgtgcagaagctctttagttgaattagatcccatttgtcaattttgtcttttgttgccattgcttttggtgttttagacatgaagtccttgcccatgcctatgtcctgaatggtattgcctaggttttcttctagggtttttatggttttaggtctaacatttaagcctttaatccatcttgaatttatttttgtataaggtataaggaagggatccagtttcagctttctacatatggctagccagttttcccagcaccatttattaaatagggaatcctttccccattgcttgtttttctcaggtttgtcaaagatcagatagttgtagatgtgtggtattatttctgagagctctgttctgttccattggtctatatctctgttttggtaccagtaccatgctgttttggttactgtagccttgtagtatagtttgaagtcaggtagcgtgatgcctccagctttgttcttttgcgttaggattgacttggcaatgcaggctcttttttggttccatatgaagtttaaagtagttttttccaattctgtgaagaaagtcattggtagcttgatggagatggcattgaatctataaattacctcgggcagtgtggccattttcacgatattgtttcttcctacccatgagcatgggatgttcttccatttgtttgtatcctcttttatttcattgagcagtggtttgtagttctccttgaagagatccttcacatcccttgtaagttggattcctaggtattttattctctttgaagcaattgtgaatgggagttcactcatgatttggctctctgtttgtctgttattggtgtataagaatacttgtgatttttgggcattgattttgtatcctgagactttgctgaaattgcctatcagcttaagattttgggctgagaaatggggttttctagatatacaatcatgtcatctgcaaacagggacaatttgacttcctcttttcctaattgaataccctttatttccttctcctgcctgattgccctggctagaacttccaacaccatgttgaataggagtggtaagagagggcatccctgtcttgtgccagttttcaaagggaatgcttccagtttttgtccattcattatgatactggctgtgggtttgtcatagatagctcttattattttgagatacatcccatgaatacctaatttattgagagtttgtagcatgaaaggttgttgaattttgtcaaaggccttttctgcatctattgaggtaatcatgtggtttttgtctttggttctgtttatatgctggattacgtttattgatttgcatatgttgaaccagccttgcctccaagggatgaagcccacttgatcatggtggataagctttttgatgtgttgctggattcggtttgccagtcttttattgaggatttttgcatctatgttcatcagggatattgctctaaaattctcttttttttgtgtgtctgtgccaggctttggtatcaggataatgctggcctcataaaatgagttagggaagattccctctttttctattgattggaatagtttcagaaggaatggtaccagctcctctttgtacctgtggtagaatttggctgtgaattcatctggtcctggacattttttggttggtaagcttttaattattgcatcaatttcagtgcctgttattggtctattaaataccttattttcacagagataccttctccaactcctcagcatgggtttagtccccttgctacaagctcccaagatatcctgggcttatgcttcacaacactgagcccatataatggtgttaattgagtaactgcttttattctttgctaatctgtgagcttcattaggaagggaaccaggtattatttactctgcacttaacacgttgcttgcacatggtagacactaaaaaaatagctactgggtttttacagtaatcaaatgaccgtgttagtatcttcgaaattgacatcctccaggtttttaaaaatctttttccaagatatctcagagttttatgtatttatttattttgttaatttttagtttattttaagttccagatacatgtgcaggatgtgcaggtttgttacttagtgccatggtggtttgctgcgcctatcaacccatcatctaggtattaagccctgcatgcatcagctatttatcctgatgctctccctcccccggcagtccaccagcaggttccagtgtgtgttgttcccctccatgtgtcaatgtgttctcattgttcagctcccacttacaagtgtatctcagagttttaaacaggtaattggatgacctctgaaggcttatctctcagactttcacagcatccagtaataattactttgtaagaacctagcaaattttgataagcaaacatctaaataaaaacagaactttaagccccagagactttatctacttcccacttagaaattctttatcataatacagtagttctgtttactacataccattgatgttactattgttgttagcgatatggagtaacagactttgtccagttttgagagatgggaggaaaatgtgaagtggcagataattatgtataattatatatattagaattatatataaaataataattatagaattctctacgtatagaatttctatacataaaattctataaattctatttttatgttcagtgtatgtaaaaacatctcatagtgtaaagaatagatatagatagaagatttttatcaaaaggaaattgatttttctctttcttattaaataaatgctgaacaattatttaaagaatattggttggaaagactccaagttgttagcctgcccagggcacccacataccttggtacagtcatggtcttataataataaggcagtgtctgagtactcacagttttaaagtacatgacagatccttacatggtatctgctcactcatgcttgatttaataatgcttgtcatgacctagactttgaggttgctaaacacttatgactctgtatgttaagtcacactgtaatatttttttccacaaatatttttacaagagtagacctttcaagtggtgagtagttcattttgacaacaatcaactctattatcaagagtggatattctatttttcaatgttcagaagtgattattaattttttggccataaacgttaaattctagttcttggcaattttcctagagacttagtaagagaagatcttactttcccaatttccaaagtatataaataaatcttcaggtctaaaggagtaatttcaatgaaatgtgatacctttatttgtgtgtgaactcttagatgacacaaattaagttgatttgaggtttgtgctgtgtcaagctatgtatataataaatgcttccagagaatatgagctactgttctgatgttgccagaatttcatttttcacaaaagggatacatagttttctagctaatgttttcttcatgagcacacgtttcaagttcacttatgtgtgtgcacgtatgtgtgtatgtttcaccaaacatgtaagcttgttctttatactgacaagtatatgtaggaatacttgttatatgaaattaggtactacaagacatgtattaataatttggttcagcatataaatattaagtgtagagcaactgggaaagagaaatagcagacggcacaaatcactgaattttaatcgacgtcccctcccctggcagtacttttaagttcctatatgacattcacaaagggatttgatgttaaaatattcagaggaaacaatgatcaggccagctgcagaaggtaaaatgcacttcctagtcttgaaagacttatatttgaattgctgttcactgtagttacataaactaaagttgaattatatatgaatcacattgtgtttatgaattatatatgtaattttatagaccttttgcaacttatacagccttattcatagtatcttcttttttcccccacaattaacatgccatatagatgtatgtatatggcatgttgtgtgtgtgtgtgtgtgcgtgtgagtgtatttaaccctattttataaactaacacttaaggatattgaatgactaacctgaccttacaagtattaagttccatatccaattactggaagactaagaatcttagttaacatctactaagtaaatatataagaattctgcaatatggaaatgaaacaaaccttctagcaaatatatgctgagtacctactgtgtgcaaagcagtgtgggaacctcattttctcagggctcagcagcatgttctaaatcccttgggtgttttatagttgcattttccgtcattataaaggcatgaccctcttctgggcttcaagccaaacactgaacagcatgagataatgtgcaaacgcttattcttgacatctgataatttataaaaacgaagttgtacatgagaaagattcctataaatatattttatataaaatcatttgtagaagattttactttttaaattaaattatttgtttttcacttaaaagattgttgataaatttggcctactaagctgttacagaccagacatccctagtgtctgcaattctccctgggaatgcttgtcactttgtaggaatcatattatctttttgaggccacctgaagatagtttattaatttgttggtttaccagtctcttaattatcctgaaagacttaactccatttccaaaggtgctacagggtgtagcactgtaaatctgatacttgatggtaatttttacattatataaatttctttcatgggaaattccatatgcataactagaagggaatcctgactgggatttttttttcttttcttattatcttcaatttaaagcactttgcttcttttgctcgctgaagagaagaaataacacatatgagttattggtagcaagataggaaaatagcaacatcagaaatctgataattaggaggtttataatggcacatatgtgtcataaactgccaattaatcttgatgagaaatgtaatcaactttagttatgaataatgcctcccttcagaagatttagaaaaatgtcaatggtccatacaatttttatctttgtttctgtttcattggaccactataggcacaccccttcagaatgtttatctgcaggctataggtaatgctggttctagttattgagtgtaatccacacacttgcttatttatacactatatacagcatatgtgtacagcatttggtgaattaatgaggaaatgtatgtaatggaatacattctgagattctaaactgatagctcatatgtgtgctttagcgttttcagaaatagtgtttttaatccccgtatattgaatttacttcagatttacattttcaacgtcagtaattcaaaatctaacctaaaaagaggaaaaatagagtttgcaaagcacatatctttctgttaaaatattttgatattatggagacccttgaaatctcttaacctcccatctgctatccacacttgtctactgcattcacagcccaaggttaagaaagacctgtttatacccaagatttccatgtcctcttttctctttcacccttcaacccactccagtctggtttcacacgaactctccaccaaaatagactttttcatcacttgatgtcaccattcatcatctttcagtcctcttcattggtgatctctcagcaacatttgacctccattgaccacgttctctttcccttatcttttcttcctaccattcccattacttctttcagaattccctgcaggcttgtcctcttaagtctatttcgtgttggacttcctcaagacgaaaaactcctaaataaatatttacaattaaggcctcaaatctaaagagcagatccagagatttcagagcctgtttgatatcttcagttgactctctcatggacacctcaagtttaacaagtctataattgaacaaaatatgcccttcccccaccccttgcccccgccacacacacatggactccttcacatccagacttcctcttccattctgtgtctctgtaaatgacatcactcttcaaccattgcttgagtcaggaaacagagacttactctggatgcccaactttttcatcttctttattaagacatcacttttaatttatgaacacctccttgaattatcctagttccagtttccactgctgtaacctgaattcaagtcactttaacccctacctggcttacagcattggcagattgtaatggagctccatgcatggaatccagcagccatattgcaaccaaagcaaacttttgagaacatagatctacatcatgccagtgccttacttaaaattctgcattggcttcctataattctttaattagtgaccatgtgtttaatatagcccataatgccctttagaatttaatatctgcctcctctccagagaattctgatattctgcaccactcttctcctaagggtctttcagtatatcaagctccttggtatactgttccttggtatacttggaatattacctccaccttgaaagttctctgcatccgttgtaccttacctcatctcccattacctaaactattcttcaaagcttggtgaaaatgtcacttcctcagaagcccttcctgaccattcaggatcttcttgttatcctaactgtcattggcagtcgattcctctctgtcactgaatttagcacaattattaaataatgacttaaataactacttgtttgaagtctttctcatctgctataatagaggctttatgggataaagaactatatgtatattgttcattgctgtacaacacccaaaataataatttgcctgttacagaatttgtatgtatatatgtttaatgaatgaacaaatgaacaagtaataatttcaagagctaataccacgtatttctaaaaccactagcatatagttggcaccaggtaaatatttataaataaatcaacaaatataatgaaaatatacatttttgcttagtgttcctgataaaccttgaaccttgaccatattattaaccatactttttacaaaatggtgtctgctgttttttcctttggcaaaaggaattttctatcctcttgaaa

SEQ ID NO: 1830 - DNA, 15826 bp, Homo sapiens
acctctgtataaagtagacctgtcacatagaatcatttaatgagcctaagcatttcatgtttaccttcttagatatattgcttaattcatttatggttagggttctaggcatattaattggtacatgcacaatactgcagatatatatttcttatgggtcaatcaagctgtatttgattgaagaaaaaaatgaatgttataaatgataatatttgttacagtagaatttcctatatatttggatattttctaggcaaggttgaaattagtgtgcatatatgtggctcatgcttctatttaattaaattattacaagattagaatacaataattacttagtcataattacatagcaagaaatataattggcaagggagatatttttaaagatattaaatcagaatccattgcaaaaacaatagtttactgtatcagtacaaaagtagaataggttggaagaaaaccaaagaaggaaagaggaatctgtaatctttgattacattatttgcactgaattattaaagcagatgatagtgtgaataaatcatgctagagaaaccctatgctttaggctgaaaatttggaattccaatgttctaacttgggaaatattagtatctccttaggaatcctgggtagaaggaattttctggatattcgagtctatcctctagctccaggtcattgtcagtggcccctgaaacatattattattatatgttaatgaatatttctccagtagtaaaaagtgagagctgcacttattgaattcacattatacatcatactttggattaaagttttacctatggtaaatttcatttattcttcaatatatgcctattgggtattatcaacttcattttacaaacgaagaaattgaagttcagcaacattaaatatcatgccccaagtcacacagctattgagccgcttttctgagaattctatccaggcgtgtttatgagatatgaaccacagtccctgccttctggatgtgtgccatattttgcctactagtgaagggactcatttttacatgctccttggtccaaagagtagaaaatggcctaatttcagcaagcaataatgaactgcagtttgtgttaatcatttgaagctgctgataaaattggggattagcaactcaactttagtaagcactcttgtctattgtaaatatatttggagtgggtgatgtatgttagttaatatatgtatttaataatactataatagctaacattttatagtgtttaccatgtgctgggtaaaattccaagtcctgtacattcataaactctttcagtgttaacagcaaacacatggaaatagtactgtcataacttatatattacagatgagaaaattgaggcacagaaggccaaatactttgtccacattcacacaaccagtaaatggaaaactggattaaaatgtaggcagtgtagcacaagaatttagatagtcaacaactattctatgaaacaaatacacatagaaaaagatttgacatgtgtaaatgatttaattgaatatatatatatagagagagagtatttcttcagaatttttacccttatttttgatttttttgaaagtttctaaaaatttattaaaattgaaataaaactatattaaacttccacatggctatcctcagattcagcgattactgcattttgccttaccaaaaatggttgatagttctctaaagtgttgtataatccagacttctctggttacttgtggtttcttttatctttttcatctgtgccctgtttttcccattccttcacaactttgtcaatatttagtgttataggtgagtgtgtgtgtgtgtgtgtgtgtgtgtgcgcgtgcatgtgcggggagtggtggtggtggtgtttggttctgttgttggtattgttctgtttagttttagccattctggtcagtgtataatggtatcttattgtggttttaatttgaatttgtctcctgattgatgacattgagtagtttttcatctgcttttgggcatttgtgtatcttctttagtgaaatgtttttttttctttttttcagttgttctgcccatttgttttagtggttatctttttattattgagttgtagttatccttaatatatcatagatactaacccttggacagatatatatttttataaatagcatctcaagttattgctttcctattcattttcttaatggtgtttttcaaagattagaattttttgatttgatgaagtctaatatatcatttgtttttctctctttgcttacattctgtgacatgcctaagaaactttgactaacatcaagttatgcatacattttatgtttctccaatagctttttatttcagattttgtgtttagatatatagtttgaattatttttatgcatgatttgaggtagtggctgagagttcactaatttccatacgaatgttgttactctagcaccattttttaagaagacttaccttttcttatttgatcatttttttatatttgtcaaatatctaatgaataaataattggggatttatttctgatgttgatattctttcactgatctatttggccagtatcatacagtcttgattattgagaattgtactaactcttgaaggcaagtagtgtaaatcctctaactttgttcttttactaaattgctttcaacattctagatgctttgcatttccatgtaagttttataaacagcttatcaattttcataaaatagtcactagagttattaagttttgttgaatcttttgtaatttgaggatcattactatattaacagtgttaagtctttcagttcaggagtataactatctatatcttctttactttctctcagcaatgcttttatcattttcagtttataggtcttacatacctttgactaaatttgttcctaaatattttatggtgatgctattgcaaacataattgatttttaaatttcatagttcagtgggtttctcctggtatataaaatatatacaatttttatacattaatattgtgatatttgagctgtctaaaattactcgtttattctatcaattttgtacattcctttggatattctatgtaaattttcatatcattaggaaatataggtggttttacttctacccttctaatgtttatacattttatttctttctcttattgcaatgagtatggcctctagtaaaacagtgggtgagttgtgagactatacatcattacctttgtcttaattttaggaggagaattacattcaatatttgaccattaagttagatattagctgtagcattttctagcacctttatcaggttgaagaaattttcttcttttcccggttttctaagagtcttttttgaaaaaaaaaaaaaaaaactctattgaggtataaattacaaacagcaaaatacaccatcttaagtgtattatcataatcaagatacagtatattaaacatctccacaaatttctcttgtaccccataccagtaaatcttcaccctatcccagtctctgcttctgtctctgtacatgaagtttgtgtttcctagaagacatatatcttcttatgatttgaatcatagagtttgtatacttttgtaactggcttttttattcagtataaggttttttgagaaatactggtgtggttccgtgtctctgtaattgacaattttcaattctttttttttatattgctaatttctctatctatgcttgttctcatctcctgtcagcttttgcagattttgtgctaccaattatacttggattttcctgtctccctgccttcttttatgtttctccttaacaagattccatctccttcattacccaactttgagactagagaccatgtcttcatacactttatattcatttagtcagtcctttattgagtgtctgtgttgtggctgccatcatgggctcttaagtgatgccaatactgctggttcaagaatcgcatttgaatagatagcttctagaatattctaggatactggggacaggtgaaggttagattactaaatatttcctcatctaatacaaataatatatgtaatttcatgtaaacatacaaaatattaaaatttatatttatcaagaaggcagattatactgcaggtgatcagaactaaatttttatgtacatatatatggttattcaattcataaatgtttttataaaacatgggaatatctgagatacactgaatttacaaaccttggagagaccacctatatggattcttcaatcaggagcacgttcatatttagcctatctgttagcttatcacaattgacagagatgctttggttgtgagtttggaatatgaacataaatgtggttgatggagagacaaaataaaggatttttcttaatgagaatatagaaaaatagatggatttacctaattaatattactcacgtgtttaaacagaatacacacaattagaataagatttaaagaaataagacttcgtattgtaaatagagatcttattattaatatttactaaattcctttttaatcgaactctaggattttgaatcttagcgcttcttatagtcttccagaagactttttacttttctcattctattgtttaatccttttattacagagtaccaattacttttaaaatggcagaaaaagaaagttttgcagtggtgtgagggcacctttcttgatgaatcatcatgataacattttaagtagacaaaggctatttgttttctgacttactttgccattgttttctcagatatccttatttaggccaggtgcggtggctcacgcctgcaatcccagcactttgggaggccaaggcgggcagatcacctgaggtcaggagttcgagaccagcctggccaatatggcaaaactccatctctactaaaaatacaaaaattagctaggcatggcggtatgctcctgtaatcccagctacttgagagggaggctgaggcaagagaatcgcttgaattcgggaggtggagattgcagtgagccaagagcatgccactgcactccagcctgggcgacaagtgtgaaactccatctcaaaataaataaataaataaataaataaataaattcttatttatatcttctcttaaatagctatccagtaaactagcattatcagctcacaagataatttagacatttctttctatgaagtttgagattaaaattacatacatatacacatgtatctatttcatagcataattttaagagcacactttaaaaaaataacaaaataattaaacaaccaaaaggtagtgtgtaagctacaaaaaatgtcttcaaatcaattcctgcatttggaaaaatcccaaatgttaactagtcaaaacttctgatgattcacaaattgatattctattaaaattcagtcataagaatgaacatttgcattagaaaaaaaatcaatattcaaggcccaggtagcctaggctatttttaatgtttgccttaatataattatctttattgactatgacagttattttatggtatctagaaaaatagtctgcataaacaataatgcaataaatatctttatatatatgaatgtatctgataattttcataataaaaattcctttgttgttcagaagataggcactttttataaggttttagttatcactaacaacatgcttcctctcaaatttgtatttggatggtaaatgtcagtttctctaaaccctgagtaggttcatttttttttagtattatactttaagttttagggtacatgtgcacaacgtgcaggtttgttacatatgtatacatgtgccatgttggtgtgctgcacccattaactcttcatttaacattaggtatatctcctaatgctatccctccccactccccccaccccacaacagtccccggtgtgtgatgttccccttcctgtgtccatgtgttctcattgttcaattcccacctatgagtgacaacatgcggtgttgggttttttgtccttgtgatagtttgctgagaatgatggtttccagcttcatccatgtccctacaaaggacatgaactcatcatttttatggctgcatagtattccatggtgtatatgtgccacattttcttaatccagtctatcattgttggacatttgggttggttccaagtctttactattgtgaatagtgccgcaataaacatacgtgtgcatgtggctttatagtagcatgttttataatcctctgggtatatacccagtaatgggatgactgggtcaaatggtatttctagttctagatccctgaggaatcaccacactgacttccacaatgcttgaactagcttacagtcccaccaatagtgtaaaagtgttcctatttcttcacatcctctccagcacctattgtttcctgactttttaatgatcgccattctaactggtgtgagatggtatctcattgtggttttgattttcatttctctgatggccagtgatgatgagcattttttcatgtgtctgttggctgcataaatatcttcttttgagaagtgtctgttcatatccttcgcccactttttgatggggttgtttgtttttttcttgtaaatttgtttgagttcattgtagattctggatattagccctttgtcagatgagtagattgcaaacattttctcccattctgtaggttgcctgttcactctgatggtagtttcttttgctgtgcagaagctctttagttgaattagatcccatttgtcaattttgtcttttgttgccattgcttttggtgttttagacatgaagtccttgcccatgcctatgtcctgaatggtattgcctaggttttcttctagggtttttatggttttaggtctaacatttaagcctttaatccatcttgaatttatttttgtataaggtataaggaagggatccagtttcagctttctacatatggctagccagttttcccagcaccatttattaaatagggaatcctttccccattgcttgtttttctcaggtttgtcaaagatcagatagttgtagatgtgtggtattatttctgagagctctgttctgttccattggtctatatctctgttttggtaccagtaccatgctgttttggttactgtagccttgtagtatagtttgaagtcaggtagcgtgatgcctccagctttgttcttttgcgttaggattgacttggcaatgcaggctcttttttggttccatatgaagtttaaagtagttttttccaattctgtgaagaaagtcattggtagcttgatggagatggcattgaatctataaattacctcgggcagtgtggccattttcacgatattgtttcttcctacccatgagcatgggatgttcttccatttgtttgtatcctcttttatttcattgagcagtggtttgtagttctccttgaagagatccttcacatcccttgtaagttggattcctaggtattttattctctttgaagcaattgtgaatgggagttcactcatgatttggctctctgtttgtctgttattggtgtataagaatacttgtgatttttgggcattgattttgtatcctgagactttgctgaaattgcctatcagcttaagattttgggctgagaaatggggttttctagatatacaatcatgtcatctgcaaacagggacaatttgacttcctcttttcctaattgaataccctttatttccttctcctgcctgattgccctggctagaacttccaacaccatgttgaataggagtggtaagagagggcatccctgtcttgtgccagttttcaaagggaatgcttccagtttttgtccattcattatgatactggctgtgggtttgtcatagatagctcttattattttgagatacatcccatgaatacctaatttattgagagtttgtagcatgaaaggttgttgaattttgtcaaaggccttttctgcatctattgaggtaatcatgtggtttttgtctttggttctgtttatatgctggattacgtttattgatttgcatatgttgaaccagccttgcctccaagggatgaagcccacttgatcatggtggataagctttttgatgtgttgctggattcggtttgccagtcttttattgaggatttttgcatctatgttcatcagggatattgctctaaaattctcttttttttgtgtgtctgtgccaggctttggtatcaggataatgctggcctcataaaatgagttagggaagattccctctttttctattgattggaatagtttcagaaggaatggtaccagctcctctttgtacctgtggtagaatttggctgtgaattcatctggtcctggacattttttggttggtaagcttttaattattgcatcaatttcagtgcctgttattggtctattaaataccttattttcacagagataccttctccaactcctcagcatgggtttagtccccttgctacaagctcccaagatatcctgggcttatgcttcacaacactgagcccatataatggtgttaattgagtaactgcttttattctttgctaatctgtgagcttcattaggaagggaaccaggtattatttactctgcacttaacacgttgcttgcacatggtagacactaaaaaaatagctactgggtttttacagtaatcaaatgaccgtgttagtatcttcgaaattgacatcctccaggtttttaaaaatctttttccaagatatctcagagttttatgtatttatttattttgttaatttttagtttattttaagttccagatacatgtgcaggatgtgcaggtttgttacttagtgccatggtggtttgctgcgcctatcaacccatcatctaggtattaagccctgcatgcatcagctatttatcctgatgctctccctcccccggcagtccaccagcaggttccagtgtgtgttgttcccctccatgtgtcaatgtgttctcattgttcagctcccacttacaagtgtatctcagagttttaaacaggtaattggatgacctctgaaggcttatctctcagactttcacagcatccagtaataattactttgtaagaacctagcaaattttgataagcaaacatctaaataaaaacagaactttaagccccagagactttatctacttcccacttagaaattctttatcataatacagtagttctgtttactacataccattgatgttactattgttgttagcgatatggagtaacagactttgtccagttttgagagatgggaggaaaatgtgaagtggcagataattatgtataattatatatattagaattatatataaaataataattatagaattctctacgtatagaatttctatacataaaattctataaattctatttttatgttcagtgtatgtaaaaacatctcatagtgtaaagaatagatatagatagaagatttttatcaaaaggaaattgatttttctctttcttattaaataaatgctgaacaattatttaaagaatattggttggaaagactccaagttgttagcctgcccagggcacccacataccttggtacagtcatggtcttataataataaggcagtgtctgagtactcacagttttaaagtacatgacagatccttacatggtatctgctcactcatgcttgatttaataatgcttgtcatgacctagactttgaggttgctaaacacttatgactctgtatgttaagtcacactgtaatatttttttccacaaatatttttacaagagtagacctttcaagtggtgagtagttcattttgacaacaatcaactctattatcaagagtggatattctatttttcaatgttcagaagtgattattaattttttggccataaacgttaaattctagttcttggcaattttcctagagacttagtaagagaagatcttactttcccaatttccaaagtatataaataaatcttcaggtctaaaggagtaatttcaatgaaatgtgatacctttatttgtgtgtgaactcttagatgacacaaattaagttgatttgaggtttgtgctgtgtcaagctatgtatataataaatgcttccagagaatatgagctactgttctgatgttgccagaatttcatttttcacaaaagggatacatagttttctagctaatgttttcttcatgagcacacgtttcaagttcacttatgtgtgtgcacgtatgtgtgtatgtttcaccaaacatgtaagcttgttctttatactgacaagtatatgtaggaatacttgttatatgaaattaggtactacaagacatgtattaataatttggttcagcatataaatattaagtgtagagcaactgggaaagagaaatagcagacggcacaaatcactgaattttaatcgacgtcccctcccctggcagtacttttaagttcctatatgacattcacaaagggatttgatgttaaaatattcagaggaaacaatgatcaggccagctgcagaaggtaaaatgcacttcctagtcttgaaagacttatatttgaattgctgttcactgtagttacataaactaaagttgaattatatatgaatcacattgtgtttatgaattatatatgtaattttatagaccttttgcaacttatacagccttattcatagtatcttcttttttcccccacaattaacatgccatatagatgtatgtatatggcatgttgtgtgtgtgtgtgtgtgcgtgtgagtgtatttaaccctattttataaactaacacttaaggatattgaatgactaacctgaccttacaagtattaagttccatatccaattactggaagactaagaatcttagttaacatctactaagtaaatatataagaattctgcaatatggaaatgaaacaaaccttctagcaaatatatgctgagtacctactgtgtgcaaagcagtgtgggaacctcattttctcagggctcagcagcatgttctaaatcccttgggtgttttatagttgcattttccgtcattataaaggcatgaccctcttctgggcttcaagccaaacactgaacagcatgagataatgtgcaaacgcttattcttgacatctgataatttataaaaacgaagttgtacatgagaaagattcctataaatatattttatataaaatcatttgtagaagattttactttttaaattaaattatttgtttttcacttaaaagattgttgataaatttggcctactaagctgttacagaccagacatccctagtgtctgcaattctccctgggaatgcttgtcactttgtaggaatcatattatctttttgaggccacctgaagatagtttattaatttgttggtttaccagtctcttaattatcctgaaagacttaactccatttccaaaggtgctacagggtgtagcactgtaaatctgatacttgatggtaatttttacattatataaatttctttcatgggaaattccatatgcataactagaagggaatcctgactgggatttttttttcttttcttattatcttcaatttaaagcactttgcttcttttgctcgctgaagagaagaaataacacatatgagttattggtagcaagataggaaaatagcaacatcagaaatctgataattaggaggtttataatggcacatatgtgtcataaactgccaattaatcttgatgagaaatgtaatcaactttagttatgaataatgcctcccttcagaagatttagaaaaatgtcaatggtccatacaatttttatctttgtttctgtttcattggaccactataggcacaccccttcagaatgtttatctgcaggctataggtaatgctggttctagttattgagtgtaatccacacacttgcttatttatacactatatacagcatatgtgtacagcatttggtgaattaatgaggaaatgtatgtaatggaatacattctgagattctaaactgatagctcatatgtgtgctttagcgttttcagaaatagtgtttttaatccccgtatattgaatttacttcagatttacattttcaacgtcagtaattcaaaatctaacctaaaaagaggaaaaatagagtttgcaaagcacatatctttctgttaaaatattttgatattatggagacccttgaaatctcttaacctcccatctgctatccacacttgtctactgcattcacagcccaaggttaagaaagacctgtttatacccaagatttccatgtcctcttttctctttcacccttcaacccactccagtctggtttcacacgaactctccaccaaaatagactttttcatcacttgatgtcaccattcatcatctttcagtcctcttcattggtgatctctcagcaacatttgacctccattgaccacgttctctttcccttatcttttcttcctaccattcccattacttctttcagaattccctgcaggcttgtcctcttaagtctatttcgtgttggacttcctcaagacgaaaaactcctaaataaatatttacaattaaggcctcaaatctaaagagcagatccagagatttcagagcctgtttgatatcttcagttgactctctcatggacacctcaagtttaacaagtctataattgaacaaaatatgcccttcccccaccccttgcccccgccacacacacatggactccttcacatccagacttcctcttccattctgtgtctctgtaaatgacatcactcttcaaccattgcttgagtcaggaaacagagacttactctggatgcccaactttttcatcttctttattaagacatcacttttaatttatgaacacctccttgaattatcctagttccagtttccactgctgtaacctgaattcaagtcactttaacccctacctggcttacagcattggcagattgtaatggagctccatgcatggaatccagcagccatattgcaaccaaagcaaacttttgagaacatagatctacatcatgccagtgccttacttaaaattctgcattggcttcctataattctttaattagtgaccatgtgtttaatatagcccataatgccctttagaatttaatatctgcctcctctccagagaattctgatattctgcaccactcttctcctaagggtctttcagtatatcaagctccttggtatactgttccttggtatacttggaatattacctccaccttgaaagttctctgcatccgttgtaccttacctcatctcccattacctaaactattcttcaaagcttggtgaaaatgtcacttcctcagaagcccttcctgaccattcaggatcttcttgttatcctaactgtcattggcagtcgattcctctctgtcactgaatttagcacaattattaaataatgacttaaataactacttgtttgaagtctttctcatctgctataatagaggctttatgggataaagaactatatgtatattgttcattgctgtacaacacccaaaataataatttgcctgttacagaatttgtatgtatatatgtttaatgaatgaacaaatgaacaagtaataatttcaagagctaataccacgtatttctaaaaccactagcatatagttggcaccaggtaaatatttataaataaatcaacaaatataatgaaaatatacatttttgcttagtgttcctgataaaccttgaaccttgaccatattattaaccatactttttacaaaatggtgtctgctgttttttcctttggcaaaaggaattttctatcctcttgaaaacatacttacgagagaaaagaatttggagtgcttctagttcgacatactaaaggtgagggttgccattttatatctaggaaatgtcttcctgttagagtctatatatttcagattttaacgaaatgaggttgaataaaactttctgcaactcttagatttaactgattttaccattatattattttagttttttttaactgtcaagatttcttgggcaaattcatagtcctttgctgaattgtaacatttcccttaattatgaatttagacaacacaccacactagtaactagctataattgtgacttcaacagttacagaaaacacaaatatttcatatcattttacagttgttacaggcattttaaaatattatttttactcatccctaccttgaaattatggtagctattaaacctgctactatgttttgttacagaatgtgctaagagacatataaatacccatattacatttatttaaaatattgttaacagtattactggttccatcagaattctatatttgtttacttttaatgaattttaaaacattctgggacaatgacttggttcaccagattgccaagagatccctatcacaaaatgatcaagaactacagcattatgctatattttcagttgtgtcagtcattgtgtttagtgttcagaaaaactttttaaggaggagactctagtttttaaaagaaaggtcaaaatgaaaaagaatgtcacaagttgtacatttaaactcagttgtaacacttggtttttcaaatggttgtgcaagtgtcttgccttacttaatgtgcagtattctttttcgtccttactcttctttgcacccaaacccttctcacttcaggctgaaacagattttaatgtagagttgggtcactgaacacttgctacttcacacttctctgcaggaaaataattcttttggattaaattttttcacttctgctgtagggaataagtacatgtttgctgctgatgagaaagaattaacctcaggtttattctgttctggaccacacaaatctatgcttttgaatggaaggaggaaccaagaaccgcccttaacattttgtcacactgagagtggaggaattggtcgaggaatcttttcatggtttgtaaaggacaatcaaatccatccaattaaaataaaaaaaaatgatagcacaattagctctctcttcttaactggattgttttgttttggaatggaaattttcatttctcatggtcattactaatgcccaataggagaaaatatatttgaattctatgattgctattgaaataattatgatttcacttagtatgtccaccatggtacatggtcttcagcaaattagcaagtaatcatttgtctttgtgattgttttcaggtaatagttatttatgtaaatgtagaattttttatatgttgtattgatgaaattatttcaaaatgcagtacatctttccttactttcccaaatagtgtgtgtgtgtgtgtacatatatattcctgcctacattctaaaaatgatttaatcgtgactataagtattacattatgctaaatatggcccacttttcctgacagttgttagaatacaaaaaaatgcaaacaggcattggtattagggaagacattggctttgaagcaacatatctgggtttaacttctggctcctttgttaaacatgcagttttgtgaccctagacaatttatttagttacagcgcagtttactcaactgtaaaaagagggtgttaacactacctcatactacctcattaattgagaggtacatatcaggtacctaataaatgttagtgatagaattagtgtgttgtaaatgctgtcttcaggacaactgaatacttggtgttttttcctataaagaagatccactttagggttcttttgtctacttttag

SEQ ID NO: 1831 - DNA, 3845 bp, Homo sapiens
ctcaggtgtttctgaacaactacgacgcggagaacaaactgaacgacgttctcctcatccaggtgggcgggcagggccgcgagggctcggaggggcacggccagagggctccgggacccccattcctgcagccagcattcattgagcacccactgtataccgggccacgaccgaggccgctgcagcctgggtccagtggcactggccgggggagaccgctccttggacaccaggccactcctcctccccgcctctcccccgcccgcgcctctcccccgcccgcgcctctcccctgcgcgcctctcccccgcccgcgcctctcccccgcccgcgcctctcccccgcccgcgcctctcccttgcccgcccctctcccctgcccgcgcctctcccctgcatgcctctcccttgcccgcccctctcccctgcccgcgcctctcccctgcgcgcctctcccctgcccgcgcctctcccccggccgctcctctcccccgcccgcgcctctcccccgcccgcgcctctcccctgcgcgcctctcccctgcctgcccctctcccctgcctgcgcctccgcccggtgtgctgttcccccagaaagccaggtgccctcgcctcctccggcgcctcccctgacctcactggaagtggcgaggacagccacagccctccccgattcactgttctccactgaaccgcgtgctcctctcattcatggggccctcctagcctcctcccacccagaaagatcagctccccagggcagaggatttttgtctgtgttgttcgttattggactcatgtggcttagaacgggactgggcatacaggtggtgctcagtaagtgcttggggttgggcactgtggctcacgcctgtactcccagtactttgggaggctgggatgggaggatcacttgaggccaggagtttgggagcagcctgaccaacctagtgagaccccatctctataaaagacattttttttttttttttttttagacagagtctcactcagtcatccaggctggagtgcagtggtgcaatctcggctcactgccacctctgccttccaggttcaagtaattctcctgcctcagcctcctgagtagctgggattacaggcatgcaccaacacgcttggctaatttttgtatttttagtagagacggtgttttgccacgttggccaggctggtctcgaactcctgacctcaagtgatctgctctcctcagcctcccaaagtgctgggattataggagagagccaccgcgtccagcctacaaaagaaaaatttaaaaatcaaccgggcatggtagcacacgccaagccactcatgagctgagatgggaggatcacttgagcccaggaggttgaggctgcagtgagctgtgatcatgccaccacactccagcctcggcgacagagcaagaccccatctcaaaaaaaaagtgctttgaagatgaatgaatgggccaggggcggtggctgtaatcccagcactttgggaggccgaggcgggcggatcgcctgaggtcaggagtttgagaccagcctgatcgatatggcaaaccccgtgtctactaaaaatacaaaaattagctgggcgtgacggcaggtgtctgtagtcccagctacttgggaggctgaggcagcagaattgcttgaacccaggaggcagaggttgcagtgagccgagattgtgccactgcactctagcctgggcaacaagagcgaaactccatctcaaaaaaaaaaaaaagaaaagaaagaaagaaagaaaacatgaatgaatggccgggcactatggctcacacttgtaatcccagcactttcggaggctgaggaaggcagatcacttgaggttgggagtttgagaccaggctggccacctcacccaatgggatggctccgggaggttccagtgagccgagatcacgccactgcattccagcctgggtggcagagcaagactccatctcaaaagaaagaaagaaggaaagaaaatgaatgaatacaatagtgacaaatgggacaaagggggtcgtggggcccaggcggagggagcggcatccgcggcgttttgaggtggtgggtgtggtgggtgtggtgggagggcggcccgggcggccaccgtgacctggaagcagcgtctcaccgccgcctgccttctgccccagctgagcagcccagccaacctcagtgcctccgtcgccacagtccagctgccacagcaggaccagccagtgccccacggcacccagtgcctggccatgggctggggccgcgtgggtgcccacgaccccccagcccaggtcctgcaggagctcaatgtcaccgtggtcaccttcttctgccggccacataacatttgcactttcgtccctcgccgcaaggccggcatctgcttcgtaagtaaccgtgcccccaccccgggcaccgggctgccatgaggggaggagggcggcggccagggttccacgccacctcttagctgtgtggcttcatgctgtgcctcagtctccccacctggaaggtgggcacacccaacacccaacgggcaggctcagcggggtgggggcgctcacattgcacctggctgcttgggtgggtctgggggttccctgccccccactcccctctaggaccacaggaaggtgtgggagacccatccgccctcaccggcggccccttccagaatccaggactccaggtatccagcgggaggcccataaatgcccagttcctacgaaagacctcagcccctccctgctcacactttttgtttgtttttgagacggagtgtcgctctgttgtccaggctggagtgcagtggtgagatctcagctcactgcaacctccacctcccaggttcaaggtattctcctgcctcagcctcctgagtaactaggtgcacaggtacctgccaccgtgcctggctaatttttttggtatttttagtagagatgaggtttctccatgttgaccaggctggtcttgaactcctggcatcaagtgatgcctggctggtgctcacacattttaaagaaaattccaggccagcagtggtggctcacgcctgtaatctcagcactttgggaggccaaagcggaaggatcttttgagtccaggagttcaagaccagcctgggcaacatagcagggtggcatctctacaaataatttaaatattagctgggcatggtgatgtgagcctgtaggcccagctactcaggaggctaaggcaggaggatcacttgagcctggggagttcgaggttgcagtgagctatgattgtgccactgcactccagcctggagaacagagcgagaccctgtctcgagagaaagacagccagctactcgggaggccgaggcaggagaatcacttgaacccgggaggcagaggttgcagtgagccgagatcacggcactgcactccagcctgggtgacagagcgagactctgtcgcaaacaaaacaaaaacaaaacaaaacaaaacaaaaggagaaagaaagaaagagatagagagagaaagaaagaagaaagaaagaaaaagagagaaagaaagaaagaaagaaagaaaaagaaagagagagagagagagagagagagagaaagaaagaaagaaagttccatattggaagcattttattctgaaacagctgtggctaccccagcccccttcctggctgcctggggccagcccgggtgactggctgtccccatcctcccgggagactcaggtggcccctgatgggtgactggccgtccccatcctccagggagactcaggtggcccctgatgggtgactggccgtccctgtcctccagggagactcaggtggccccc

SEQ ID NO: 1832 - DNA, 6379 bp, Homo sapiens
ctcaggtgtttctgaacaactacgacgcggagaacaaactgaacgacgttctcctcatccaggtgggcgggcagggccgcgagggctcggaggggcacggccagagggctccgggacccccattcctgcagccagcattcattgagcacccactgtataccgggccacgaccgaggccgctgcagcctgggtccagtggcactggccgggggagaccgctccttggacaccaggccactcctcctccccgcctctcccccgcccgcgcctctcccccgcccgcgcctctcccctgcgcgcctctcccccgcccgcgcctctcccccgcccgcgcctctcccccgcccgcgcctctcccttgcccgcccctctcccctgcccgcgcctctcccctgcatgcctctcccttgcccgcccctctcccctgcccgcgcctctcccctgcgcgcctctcccctgcccgcgcctctcccccggccgctcctctcccccgcccgcgcctctcccccgcccgcgcctctcccctgcgcgcctctcccctgcctgcccctctcccctgcctgcgcctccgcccggtgtgctgttcccccagaaagccaggtgccctcgcctcctccggcgcctcccctgacctcactggaagtggcgaggacagccacagccctccccgattcactgttctccactgaaccgcgtgctcctctcattcatggggccctcctagcctcctcccacccagaaagatcagctccccagggcagaggatttttgtctgtgttgttcgttattggactcatgtggcttagaacgggactgggcatacaggtggtgctcagtaagtgcttggggttgggcactgtggctcacgcctgtactcccagtactttgggaggctgggatgggaggatcacttgaggccaggagtttgggagcagcctgaccaacctagtgagaccccatctctataaaagacattttttttttttttttttttagacagagtctcactcagtcatccaggctggagtgcagtggtgcaatctcggctcactgccacctctgccttccaggttcaagtaattctcctgcctcagcctcctgagtagctgggattacaggcatgcaccaacacgcttggctaatttttgtatttttagtagagacggtgttttgccacgttggccaggctggtctcgaactcctgacctcaagtgatctgctctcctcagcctcccaaagtgctgggattataggagagagccaccgcgtccagcctacaaaagaaaaatttaaaaatcaaccgggcatggtagcacacgccaagccactcatgagctgagatgggaggatcacttgagcccaggaggttgaggctgcagtgagctgtgatcatgccaccacactccagcctcggcgacagagcaagaccccatctcaaaaaaaaagtgctttgaagatgaatgaatgggccaggggcggtggctgtaatcccagcactttgggaggccgaggcgggcggatcgcctgaggtcaggagtttgagaccagcctgatcgatatggcaaaccccgtgtctactaaaaatacaaaaattagctgggcgtgacggcaggtgtctgtagtcccagctacttgggaggctgaggcagcagaattgcttgaacccaggaggcagaggttgcagtgagccgagattgtgccactgcactctagcctgggcaacaagagcgaaactccatctcaaaaaaaaaaaaaagaaaagaaagaaagaaagaaaacatgaatgaatggccgggcactatggctcacacttgtaatcccagcactttcggaggctgaggaaggcagatcacttgaggttgggagtttgagaccaggctggccacctcacccaatgggatggctccgggaggttccagtgagccgagatcacgccactgcattccagcctgggtggcagagcaagactccatctcaaaagaaagaaagaaggaaagaaaatgaatgaatacaatagtgacaaatgggacaaagggggtcgtggggcccaggcggagggagcggcatccgcggcgttttgaggtggtgggtgtggtgggtgtggtgggagggcggcccgggcggccaccgtgacctggaagcagcgtctcaccgccgcctgccttctgccccagctgagcagcccagccaacctcagtgcctccgtcgccacagtccagctgccacagcaggaccagccagtgccccacggcacccagtgcctggccatgggctggggccgcgtgggtgcccacgaccccccagcccaggtcctgcaggagctcaatgtcaccgtggtcaccttcttctgccggccacataacatttgcactttcgtccctcgccgcaaggccggcatctgcttcgtaagtaaccgtgcccccaccccgggcaccgggctgccatgaggggaggagggcggcggccagggttccacgccacctcttagctgtgtggcttcatgctgtgcctcagtctccccacctggaaggtgggcacacccaacacccaacgggcaggctcagcggggtgggggcgctcacattgcacctggctgcttgggtgggtctgggggttccctgccccccactcccctctaggaccacaggaaggtgtgggagacccatccgccctcaccggcggccccttccagaatccaggactccaggtatccagcgggaggcccataaatgcccagttcctacgaaagacctcagcccctccctgctcacactttttgtttgtttttgagacggagtgtcgctctgttgtccaggctggagtgcagtggtgagatctcagctcactgcaacctccacctcccaggttcaaggtattctcctgcctcagcctcctgagtaactaggtgcacaggtacctgccaccgtgcctggctaatttttttggtatttttagtagagatgaggtttctccatgttgaccaggctggtcttgaactcctggcatcaagtgatgcctggctggtgctcacacattttaaagaaaattccaggccagcagtggtggctcacgcctgtaatctcagcactttgggaggccaaagcggaaggatcttttgagtccaggagttcaagaccagcctgggcaacatagcagggtggcatctctacaaataatttaaatattagctgggcatggtgatgtgagcctgtaggcccagctactcaggaggctaaggcaggaggatcacttgagcctggggagttcgaggttgcagtgagctatgattgtgccactgcactccagcctggagaacagagcgagaccctgtctcgagagaaagacagccagctactcgggaggccgaggcaggagaatcacttgaacccgggaggcagaggttgcagtgagccgagatcacggcactgcactccagcctgggtgacagagcgagactctgtcgcaaacaaaacaaaaacaaaacaaaacaaaacaaaaggagaaagaaagaaagagatagagagagaaagaaagaagaaagaaagaaaaagagagaaagaaagaaagaaagaaagaaaaagaaagagagagagagagagagagagagagaaagaaagaaagaaagttccatattggaagcattttattctgaaacagctgtggctaccccagcccccttcctggctgcctggggccagcccgggtgactggctgtccccatcctcccgggagactcaggtggcccctgatgggtgactggccgtccccatcctccagggagactcaggtggcccctgatgggtgactggccgtccctgtcctccagggagactcaggtggccccctgatctgtgatggcatcatccaaggaatagactccttcgtgatctggggatgtgccacccgccttttccctgacttcttcacgcgggtagccctctacgtggactggatccgttccacgctgcgccgtgtggaggccaagggccgcccctgaaccgcccctcccacagcgctggccgggaccccgagcctggctccaaaccctcgaggcggatctttggacagaagcagctcttccccgaacactgtggcgtccgggacggccccacccgtccccccacactccctcccacggggctccgggagacaggccggccctgcacctcaccccaccgtgacctcaataaacgttgaaactccccctggctcctgtctgtccttcccatatagggaggggagggggaactgcccaccgtgacctcaataaacgttgaaactccccctggctcctgtctgtccttcccatatagggagggaaccagggagaggtcccctgggttcaagtccccgagccccaaactcaggatggggggagtcggagcgggggatgggggcccaggttgcagggggtctctctcctggatgctcgtggctgtgggttctaacccggccccatcagggtggccctgggcaggttgttattcatctccgtgcctcagtttcctcatctggaaaatggactcgccccagacgtttcctagaactgtccctgctggctcagggactccttgaggaaggggatggggatggggaagcagcctggggggcttcctggaggaggtggcagtgccagagctgcatatcaaggtgtgaacagaaacatccgaagggctgccaggcagggggcacagtccaggcagagacctgagggctagaggccaggggacggggaggagggcaggcaggggagggatgtgggtgcaggggaggggtaatggggttggagcgctatttctcgtaggaggggtaggcagggcaggagttccctggtagaagcatgagcaatgaactgggtgggggggtggccagaggggaggtccgaggcggggaagaggtgggactcacagtccagctcaaagacgggcaagtggccactagaaggaggcattagccacagagaggggacgacctgctccaggacacgtgtagagaagaaatgaagctcattgctggtgttttttttttctttttaatatttttttgagacagagtctcgctctgtcacccaggctggagtgcagtggtgtgatctcggctcactgcaagctccgccacccgggttgaagcgattctcctgcctcagcctccggagtagctgggactacaggcacagaccaccacgcccagttaatttttatatttttagtacagacagggtttcaccacgttgtccaggctggtctcgaactcctgacctcaggtggtccacccgcctcagcttcccaaagtgctgggtttacaggcgtgagcctacttacttatttacagctggcctacttatttatttttgagacagggtctcactctgtcgcccagtctgtagtgcagtggtgcaatcttggcttaccgcagcctcaacctcctgggctcaagtgatcctcccacctcagcctcccgagtagctgggactacaggtgccaccacacccagctattttcttagtttttgtagagacggggtctggctgtgttgcccaggtgggtcctcagtgactctttacatatgaacacctccaggtcactgtaatcttagcaatctcctggcctcccagaagaccccacgtccccctcggagtctacacccgctgtgaccataacacccctaccttccctgccacagttaatggtgaaccagctctcaaagcaacactttctttttttttttttttttttttttttttttgagacggagtctcgctctgtcgcccaggctggagtgcagtggcatgatctcggctcactgcaacctccgcctcctaggttcaagcaattctcctgcctcagtctcccgagtagccgggattacaggcaggtaccaccacgccaggctaattttgtatttttggtagagacggggtttgtccatgttggtcaggctggaattcccaacctcaggtgatacacccgcctcagcctcccaaagtgttgggattacaggcctgagccaccgcgcccggccagacaacactttcttagctaagaactttatgaacgtgaatttatttcatcctcttgacaggtttatgtgatggatcctacgattataattttacagaggaggaaactgagtcacggagagtttatttcaggggcctgaagttacacagtggccaaatggccacaccagaaccaggatatgaacccagcgtcggcacacttaataatgactgcacgtgagaatgtagtatacagctggtgctcaataaatgcagctgacgccaagtctgatctccgtgctggaggccaagccccttccaaagatacggcgtcccccacccctgaaatccccccacccccgacttgaaacagggctgtgt

SEQ ID NO: 1833 - DNA, 2976 bp, Homo sapiens
aaagcataaggaatcatccaaaaaacatctgtatttgtttcaaaaggaaatggccactgccagaaaaacagcaaagttgttttgtcagaacccagtctgtatttattcctttgtctttgtttaattagattaatccctgaatggtttcccttgggtcggtacaaatcgctcgtggccataaatccccaacaattctaaaaacagtaagaaaggacaatccgcatgaagccaactggcaagcttgctgtttgtgggacagttctgggatgcgagcagtaatcttgcacccgcacataggtgtttggggttcttttagcctcttggagaggggagcaaggacaacaatcactcagatttgtttagaagaggaaagctgaaccgtagggtctcatcattaaagggggagactgactcctggatctgggcaccttccccagggaggattgtggggactttttatctgttaggttcaatgacattcagcctggctgcacactggggctacctgggagctttgacaaacaccactgcccaaatcccaccccctgccagtctgatttaattgtggtggggagtaccttggcatcaagattttcaaaggtcgctgctgcttctgtagatgggagcttgcagttactcacagactcttctgcggatatcccagtctgtcctgaaaggaacaagcatatccttgcctttctctacctaccctgtgcagggaagccttttagaaaaaaagattgttccttcaaggtcctggttccttgcttttgaaatggtactttcaaaagggttcttttgtaacaggttgatttttttgtcttcctccattattataaaagttcctgttagaaaatttgaaatcagacaattataaataaaagaatgaaaaatcacctgtattcacaccactacttggtaaccatggtaggtagggttcctgccagacccctgatggggcaaggcagcatctgcagtagagattgggaggacccatgtggagaagctgctgccacccttccagagctggttccagcatgctggagcgtcacctcccagccatcaggacttcatgcagggacactgcccacccacttagggagcttagagtctagtaagagagacacagtacatccatcgctctataaacacatacgtagttaacattatgattcatgccaggagggaaaagtgcaggggtgggctgacagccgatgggtgaggccaaaagtgtaaagaatgtttaaaggtcctcatagcaagaggttaattttctcatcaccattcaggcaacccaaagctacttcagcccggaactcagaaacctactgctgttcccaagaaagcaatgcttttcattgaactttgctagaggtgcttaaattttcccaggcctgagaggatctgtggtgctgccagacttatccttccgaagcacaacttgggtgaaattgctggtctccctttttaaagtttttcccttgagtggtccccattgcccgctgattggagttcagcctatgcagcctgtgtgcagagatccctctgcctctggtgtcaatggtctttcccatcctctcttctgctacttcccctggaatttccagagcagaattcagctgccacgcctctcctgcttccctcttctgtttactcacgcgtcccaagcctggagtgctgtttctctttctccatacctgccagcctttcccagtccttgctagacttgcagtaatctgtcccaattctgaactcccatagttttcttggcacttctcttagggattcttatcatgtcctacctcgcatgttagttatttaggtggcatctaacaaccactctggcctttctgttcctcaaataggatcagtttgttcttcaggacctttgcattcactgttcttttggccgaaaatactcttcctaaaggttcatgttattaactcctagtaggatacaagctgcgtgacagcagaaaccccttgtctgttttgttcaccatgatatccccaatgcttgggacatagtatgcgctcaaaccgtatttattgactaaatgaatgaatatcgtatgattcagacatttcttatatctggcctagctcatttaggttttgtatttctttgattactcactacgatttttgtattagctgaagttttcttccggttatgggtgttttccttacatctgaatccactgaaaatctacattggactttctggttggagttctcaattggaaatgtgagatataaacttactggtgagaggtaaaagaatctgtgtctataaggcttttttttccatctactttattgatttgggagtgaaacttcttttaggagtttaaaaccagaattcttatttgtagactcttagacctaagcgtttttaaaatgtgatgatgtaagttttaatgtttaaaattgtttaatgcatttaatagagatgttgaatcaaatcagcttttatctttttaaaaatcaatttggatattttatatttatgtaaaagcataataaactatgaaactcaaagatctagaagatgatatgaaaatgtagccattggattcaggaattaatcaagctttctaggtaattaagtttttttaaatcatacctgttgtagtgatagcttttttttgtttgagacagtcttgttctgtcgcccaggctggagtgcaatggtgtgatctcggctcactgcaacctccacctcccgggttcaagccattctcctgcctcagcctcccatcttctgagtagctgggattacaggcgcgtgccaccacgccaagctaatttttgtatttttagtagagacggggtttcaccatgttggtcaggctgatctcgaacttctgacctcagatgatcctcccgccttggcctcccaaagtgttgggattacaggtgtgagctaccacgcccggccagtgatagcttttaaccagagaaaattctctttaa

SEQ ID NO: 1834 - DNA, 1744 bp, Homo sapiens
gtaaagaatgtttaaaggtcctcatagcaagaggttaattttctcatcaccattcaggcaacccaaagctacttcagcccggaactcagaaacctactgctgttcccaagaaagcaatgcttttcattgaactttgctagaggtgcttaaattttcccaggcctgagaggatctgtggtgctgccagacttatccttccgaagcacaacttgggtgaaattgctggtctccctttttaaagtttttcccttgagtggtccccattgcccgctgattggagttcagcctatgcagcctgtgtgcagagatccctctgcctctggtgtcaatggtctttcccatcctctcttctgctacttcccctggaatttccagagcagaattcagctgccacgcctctcctgcttccctcttctgtttactcacgcgtcccaagcctggagtgctgtttctctttctccatacctgccagcctttcccagtccttgctagacttgcagtaatctgtcccaattctgaactcccatagttttcttggcacttctcttagggattcttatcatgtcctacctcgcatgttagttatttaggtggcatctaacaaccactctggcctttctgttcctcaaataggatcagtttgttcttcaggacctttgcattcactgttcttttggccgaaaatactcttcctaaaggttcatgttattaactcctagtaggatacaagctgcgtgacagcagaaaccccttgtctgttttgttcaccatgatatccccaatgcttgggacatagtatgcgctcaaaccgtatttattgactaaatgaatgaatatcgtatgattcagacatttcttatatctggcctagctcatttaggttttgtatttctttgattactcactacgatttttgtattagctgaagttttcttccggttatgggtgttttccttacatctgaatccactgaaaatctacattggactttctggttggagttctcaattggaaatgtgagatataaacttactggtgagaggtaaaagaatctgtgtctataaggcttttttttccatctactttattgatttgggagtgaaacttcttttaggagtttaaaaccagaattcttatttgtagactcttagacctaagcgtttttaaaatgtgatgatgtaagttttaatgtttaaaattgtttaatgcatttaatagagatgttgaatcaaatcagcttttatctttttaaaaatcaatttggatattttatatttatgtaaaagcataataaactatgaaactcaaagatctagaagatgatatgaaaatgtagccattggattcaggaattaatcaagctttctaggtaattaagtttttttaaatcatacctgttgtagtgatagcttttttttgtttgagacagtcttgttctgtcgcccaggctggagtgcaatggtgtgatctcggctcactgcaacctccacctcccgggttcaagccattctcctgcctcagcctcccatcttctgagtagctgggattacaggcgcgtgccaccacgccaagctaatttttgtatttttagtagagacggggtttcaccatgttggtcaggctgatctcgaacttctgacctcagatgatcctcccgccttggcctcccaaagtgttgggattacaggtgtgagctaccacgcccggccagtgatagcttttaaccagagaaaattctctttaa

SEQ ID NO: 1835 - DNA, 11687 bp, Homo sapiens
acgaacatgtagatgactattacaatcgttgtatcatctaagacttgatctcctgtgtgatcaaaccacttctgaggaattgccagtttaccaacacattgctgtatcagtcttggacccacgtaaaacattaatacaacatactgcatgattcagctagatgacattctggaaaaggcaaatctatggagacagtaaaaagatcagtggttgctaggggtcagggtaaggaggggatgaatagtggagggcagaggatttttagggcagtgaaacttaactgtatgatactgtaatggtggatgcatgttattatacattagtccaaacccatagaatgtataacaccaagagtgaactctaacataaaactctgctagggaatgttgatggcaaagtaggttatacgtgcatggggacaagcgtatatgggtaatctctgtaccttctgctcaatgttgctgtgaacttaaagctgctctaaaatataaagcctactttaaaaaaataacataatgagctaacaaagaccacaattctaggtcttcctcagaagctttataaatatgcattaaaaaattattttttgggtatactctggcagaaatacaagaaaaacaaaggcccagaatttttccaggagaatagatccagagcgaacatgaacttacttcacacccagattgagtttcccatgaacatgactcgttctcctgagggagaacccctctttggaaagcatgttcacccaggcatgtttgacacaaggaagactcgaagtctggctcccctggagggatgtgcaccatggaggagccggtgtacttcaggctgggactctgatgcttgtccacactgaccattgggctcttgatccaccttcgtacctgcaatgtgcaaaaggaaagaaaaaacaaatgtgtttgactccctttgatgtttattggggatttggtgggaaatctggtgggatgggagctcatgaaaggagaactcggtctcacaacctgtctatctttcaaactcaacacaattcgaattggtcaatgctgttcagtctctttcctagagtatgcattacatggctggtcatttcatcttgctgagtctgtctccgcatttttttttcacattatttttttcttttctttttcctcctgcttccagtggggttagaatttttttctttttagagataggggggtttcactctgttgcccaggctggtcttggtgttaaaagatcctcctggaccagcctgccaacatgatgaaaccccatctctactaaaaataccaaaattagccaggcctggtggtacacgcctataatctcagctgcttgggagaatcgcttgaacctgggaagcggaggttgcagtgagctgagatagccccgctgcactccagcctgggtgacagagcaagactgtctccaaccacaacaacaacacaacaacaacaaaccctcaaaacccaaaaacaaacaaaaacaattaccctggccaggcgagatggtttatatctaaatagcactttgggaggccaaggcaggaggactgctttagcccaggagtttgagaccagcctgggcaaaatagcgaaactttgtctctacgaaaaaaataacttttttttttttttaaagaaaaagatccttttgcctcttaaagtgttgggatcacaggtataagtcactgtgcccagcctgtctcctcatttgtaagattcaggtaataatatttcctcccaagctgtgaaaatgctaccatgttttacaatgttcaagtactttgcctggcacatgtttggtgcccaatagatagtgactattttactttgacccttattattatgattatgatgacagaaatttagttcacacatttctaaggtgaattactagttattcttacaagggaaaatactaatctcatagtttacaatctaatccattgctaagcaaatacatattcactattattattgttattgagacaggatcttcctctgtcacccaggatggaatgcagtggcctaatcatggctcactgcagtcttgaactgctgggctcaagcaatcctctcacctcagcctctggagtagctgagaccacaggctcgcaccatcacactactaatttttttttttttttgtagagatgaggtctcactaagttgcgcaggctggtatcaaactcctgggctcaagtgatcctcccgcctcccaaagtgttgggattacaggcatgagccactgaatccggcccatatatactactgcacaactttgattataaaagaaattgcttctggctaagaaattagctcaagtttgtttttaaagttctaaaactcaccacttgtcttgcttgcttgtaaaatccctataagatacagaaagaagtataaagctattctaatattaacaggcatggtatttatacagcatttcaaaaatcaaggcactttttaaagtgtttgatgtgtatagtttttaatcctcagaacaggcagggtgaggtggctcacacctgtaatcccagcactttaaactttgggaggctaaggcaggcaggtcacttgaggccaggattttgggaccagcctagccaacatagcaaaaccccatctctacaaaagaaaataaataagtaaatgaagaataaaaaattaattaattagtcctcagaaaagttttataagaaaggtactattttcaatcccattatacagatggaaaaacaaacgcatagagatgtgaagcaaatttccccagggcacagtgttgttatggagtaaaggcgggatccaggcaccttgaatccagagtttataaacatgcaattttcttttctttctttttttttttttttgagacagagtctcgctctgttgcccctggctggagtacagtggcgcgatctcagctcactgcaagctctgcctcctgggttcacgccattctcctgcctcagcctcccgagtagctgggactacaggcacctgccaccatgcctggctaattttttgtatttttagtagagaccgggtttcatcgtgttagccaggatggtctcgatctcctgacctcatgatccgcccaccttggcctcccatagtgctggtattacaggcttgagccactgcgcctggccatgagcatgcaattttctaagaagcactgaagtgttgttaagacttatggtcactggtgcttgaaatttattttgatttactatttcactttcatgctcttcaaaactcctgaggattcttttatattcaaccaattagtgaaattagcctatagcaaaaggacaaagaagtaaaatcacagtactgaattttagttagtgatgctacaattattattattattatttttgttgttgttgttgttaaagggtcttgttttgttccccagattggagtgcattggcacgatgacagctcactgcagccttaacctcctaggctcaagcgatcctcccacctcagccctcccaagtagctgggactacaggcgtgcaccaccatgactggctaattatttttaaattgttttgtagagacagggtcttgctatattgcccagactggtcttaaactcctggccttaggcgatcctcccactttggcttcccaaagtgttgggattacaagtgtgagccaccatgcccagcctgcaattaactttttaaaaaacactgaggataaactaaaattgcaatagcaataatgtttaagcaatttattatattacttgatagaatattttgctatcactaaaattaagtattatgaagactgtgaaaatatgaaaaatatttagaacataattatatgagaaaagccaaatacaaaactgtttaattgctataatcacaaatgtaaaaacatatgtactaactataggccgggtgcagtggctcacgcctgtaatcccagcactttgggaggtcgaggcaggcagatcacctgagcccaggagttcaagaccagcctggtcaacatgacaaaaccccatctctacaaaaaacacaaaaattagctgggtgtagtgttgggcacctgtaatcccagctactcaggaggctgaggcaggagaatcgcttgacccctggaggtggaggttgtggtgaaccaagatcatgccattgcactccagcctgggcaacaagagtgaaaactctgtctcaaaaaacaaacaaacaaacaaacaaaaaaaatatatatatacacatatatattttatatatacatatatattttatatacacatatatattttatatatatacatatatatttatacatatacatatatacatatacatatatattttatatatatacatatatatatatacatatatatatacacagaaacactatagacataaagtaggagagttaagaggcaaaatagaaactgctgtgtttattgttagtatcatgggtgttttatctgtttttacaactcttcgtactttaacttttaaaagaataatattttatcagaatcataaatgtatatatatatatacatttctttaaaaaatagagtctcaccatgttggtcaagccaagctggttagaactcctgggctcaagtgttcccctcccagctcagcctcccaaaatgctgggattacaggcgtgagctaccacatccagccacaagtgtcttttaattgctttatttatttatttctttattcatttatttatatttattaagatggagtctctgattgtcacccaggctggagtgcagtggcgcgatctcagctcactgcagcctcctcctccctggttcaagtgattctcctccctcagcctcctgagtggctggaattacaggcaccgtgcccccacgcccagctaatttttgtatttttagtagagacggggttttgctatgttggccaggccggtcttgaactcctgatctcgggtgatccacccacctcagcctcccaaagggctggtaatacaggcgtgagcaactgcacctggcctatatgtactcttttcaatagccatttaaaatatctttgtgaggccggttgtggtggctcacacctgtaatcccagcactttgggtttgggaggctgaggcgtgtggatcacctgatctcaggagttcaagaccagcctgaccaacatggtgaaaccctgactctcctaaaaatacaaaaattagctgggcgtggtggtgcacacccgtaaccccagctgctccagaggctgaagcagaagaacggcttgaacctcggaggcagaggttgcagtgagcctgagatcatggcactgcattccagcctgggtgaaagaaggagactctgtctcaaaaaaaataaaatatctttttgagtttactatcctaaagttaaaattttgggtttccttaaatatttctgtcactatagggccccttaagcatgttagtaggtatattaagaatgtttcgctgattcattaatggaagtctaaatgaaactttaaaagtttgagactccaatagaatgtatcttcttaatgttagtactaaatgtgtttttgatcagtctaaaaagtgttcaatttcattagagatggataatgttttttattattcttattcagatagttttgggcttgaagtctggtaactgttcttgctttgtctccaacgttgtagtttaaaatcaatctttttactctggcttactttcaatgtctcttttgccaagtagatttaactttagggttactgtgaacaggatttaaacagatgataaatctattcaaatatatttgtaagttgtatgcctggactaagaatctttgtatcttgaaatgtatatctcccctgactccctgaacacccgcactctagagcttgagttatggccaacaaaataaaattttttttaaatattcttttttcatgttatttttatttctttttgttttttatttttatattttctttttcttttttttaatatgttacagtctgaatatgttcatagtgacttttctgtttgtttggttggttttttttacagagatacagtctcactctattccctttgttggagggctgtggcacgatcatagctcacttcaaccaagagctcctaggctcaagctatcctctcgcctcagcctcccagttacctgggactacagatgcgcgccaccacgttcggctatttattttttggagagacggtgtctcattatgttgcccaggctggtcttgaactcctggtctcaagtgatcctcctgccttggcatcccaaagctctgggattacagacatgagccattacacctggccagaataaaattattaaagggacatactatttatttaataaaataagtaaactataagtaagaaggaaaataaagcatatgaatgatcaggatcattgcgggtggagggctcaattttaaacagtatgagccaggatactatcggatactccctctctgtccacacagaatgtagcaagggatatggagaaatactccctttctccagaagcatcagagaaaaagtgttacttacaaaaatgaatccagcaacacatttctaaccggactgttgctgaattttactgcatgctttgtcttaaaaaggttttgtctccattggcttagtccttatactggcttcaacgtgtcccttctttatgactccttgacacttttcaccagctttgaagcctcacaagtgatttttacaggcccaattaaggacagagtttacgatgtttgcttgctcttgagagagtggctggaccgacccagtgaatgcacaggagttaggcaaggtgcccttcaaaactgctgagtagagaaatcctcccacggcccctcggggaattcaagctacaactggcccattgtgtttcctcaggctgcggattgctttactggagggagtagctgactgtgagtggctttgggagcccttcataacaatggctggaggagagctgcagcagctgtgtgtgcgagaaacacgaatgcccggatgccagcggcagcctgggctcctgggcctcctgggccacctgggccctagttttattcagagctacacaactgtttgtgaagcgcattgtaaacaaacatagacggggtgagacatcctctttatcctgaataaatcaagaattcccaggccgggcgctgtggctcatgcctgtaatcccagtactttgggaggaggcgggcggatcacgaggtcagtagatcgagaccatcctggctaacacggtgaaaccccgtctctactaaaaatacaaaaaaaattgccgggcgtagtggagggtgcctgtagtcccagctactcgggaggctgaggcaggagaatggcgtgaacccgggaggcggagcttgcagtgagctgagatcgcgccactgcactccagcctgggcgacagagcgagactctgtctcaaaaaaaaaaaaaaaaaaaattccctcacttggggtttataggagactgttctccaaaccacaccagacttttagaagcaactacctctacagataccggggtgaaccagtaaggcccttcatttaactagacagaaactgagtgaacagtgggtaaacaaaatattcaaccaaattctttgctaaatccagtccaccttggttttattaatgtctttacttggaaaaaaaaaaaaaaaaagccatccaaaagcaatccctcagtctagaaaattgccagatgtgattaaagagattggctggcttctagggattttccacttgtggttttttcctattatctaagagcaaacagatattactattaatttaaaatagtttagctgataatgatatcaaccgatacaggaaaattatagagagtttaggtacttaggtgtgaactcaggtggcaacacctactctcattggcccccgtccttttagggggaagagctgactctcttaaaaagccaagagagcttgaagttgccttctgtaatttccaaacaggcattttttttttttaattatagagaactgactttgcttacttgacgcctcaataactttcaatttcgagagagtcagcccagttttctagtgaaattacttggataggtcaatagattataaaaagggaggccaggtgaggtggaggccgaggcaggtggatcatttgaggccaggtgttaaagaccaggctggccaacatggtgaaaccccgtttctactgaaaacacaaaaattagccaccatggtggcgtccacctgtaatcccagctactagggaggctgaggcaggagaatcccttgaacccaggagccggaggtggcagtgagccaagatcgtgccactgcactccagcctggatgaaagagtgagactctgtctcaaaaaaaaaaaaaaagagagagagaaagtaagagacctgcatgcctatgcctctcccagagggtgcatgctagcaggttagttacggcatgagtgtaatttaggagaaggctcctggaagcaaattcatctcacactgatactggagcctgaagctgcttcatagcatgtctcctaaaatataacagtgctgtaatattcagtaatattaatcagatatcttcaccccagctatatgtcatcatcatgtatctgtcttttctctctctcttttttttttttgagacggagttgtacttttgttgaccaggctggagcgcaatggcgcgatctcagctcactgcaacctccgcctcccgggttcaagcaattctcctgcttcagcctcccgagtagctgggattacagacgtgtgtcaccacatccagctagttttgtatttttagtagagacagggtttctccatgttcgtcaggctgatctcgaactcctgacctcaggtgatccatccaccttggcctcccaatcccaagcctgttgggattacaggcgtgagccaccgcaccaggcctattactgtcttttctctagtgtttgtagtgtttattgcttgtataaaacaacaggacttttatgctaactggtcttgatattaagcctatgtcacctttccaactggatcataagcatgagaatagcttcttaggccttaggaaaaaaaaaaattccagaggctagtgtatgggcttacaaacaaactaggtaataaaaataggaatctcttgattgcttttaatatttacttatagatctcaacaagttttgctaacatcctccatcaaggtaatacagattttctatttaaatatttctctttaacacgcaagacctatcctggagcaggcaccctgagaagatggagtgacttttagaattccctgaccttctatgctgttgtccttgggatctcccagtcctttcctctcaccttgacctagttgcatcctcttctagattctcaggggccaacctgtgtctccaggcctagtccggaggatggagtggtggggaggactctggggaagtgggaaaacggagacgcaatgcgtccatgtaccctatttaatgttgctgctcacagcaggcagcaccccagctccgtctcttcagaggacagtgcttgcctgttcttctagctcagtaagtataaagtctccctcctcatcctccccattgaggaatccaccccaccctgtcccaccccaccccaccctacactgccaagtgttaaatagataaagtgcaggaattcatcaacgtacgtttttctttggaaatacaggtgaagtttttctcatttctttaaattgtgggactctgccaggtgcggtggctcatgcctgtcgtcccagtgctttgggaggccgaggcaggcagatcacctaaggtcaggagtttgagaccagtctggccaacatatagtgaaactccatctctactaaaaatacaaaaattagtcgggcgcgggggcacatgcctgtaattccagctacttgggagactgaggcaggagaatcacttgaacctaggtggcggaggttgcagtgagccgagattgcaccactagactccagtctgcagagtgaaactgtctcaaaaaaaaaaaaaaattgtgggactcattcttttcgtttgaatttgtctttcctcgatatgtactttttttagatataaaaaattgttttaaaaagagaaagtaggaaaattattttaggtactatctctacgggacagtgtatgttatttgcttttggaaattaaggctcagggaaaatagaaatgctggtgtaatcagtggagaagaacctggctatcctgtccgtcaaaatccactgagctttggaaacaacttcctcccctctttcctccaagaaatccccttttccagtgttttttttgtttgtttattttaggttcaagggtacatgtgaaggtttgttacacaggtaagctcatgacaccgggatttgttgtacagattatttcatcacccaggaattaagcctagtacccaatagttatcttttgtgctcttctccctcctcccactcttcaccctccagtagaccccagtatctgttgtttccttctttgtattcatgtaagttctcattccagtgtttttctgtttgtttgtttttttgagatggagtcttgctctgttgcctaggctggagtgcagtgatgcgatcttggctcactgcaacctccacctcccaggttcaagcaattctcctgcctcagcctcccgagtaactaggactacaggcacacaccaccacacccagctgagttttgtatttttagtagagacagggtttcaccatgttgaccaggctggtctcgaactcctgacctcaggcaatctgcctgcctcgacctcccaaagtgctgggattacaggcatgagccaccgtgcccagccttttttttttttttcttgagacggactcttgctctgttgcccaggctggagtgcagtagtatgatctcagctcaccgcaacctcccgttcctgggttcaaggaattctcctgcctcagtctcctgagtaactgggatcacaagtgtgcaccaccatgaccagctaattttttttttttttttttgtatttttagtagagatggggtttcaccatgttgaccaggctggtctcaaacttctgacctcaggttatctgcccaccttggcctcccagagtgctgggattacaggcgtgagccactgcgcctggcctcattccagtgttgttgttgtttttttaactgtctctctctctctaggctactgtctctcagcatattaaacaccttgttcttgcaatatctctaaaagctagcgaacagactgcaagcaaaacatcctctttacacccacaaactcttcctttttcccgcagccacctttcaccaccacccaactcttctctcttagccgagcttcatgaaaaaataatctccatttcctcatctcacattttctcctcaacccatttgctcattaaatggcaatttgttcattaaatggtatttatggattgcttaatatttgcaaggactaaagcgaagaacataataacaaaagtctcatttcataaaatgaagcttgcacaaagatgccaataaacctcattgtcaaatccaatagacatttctctgtgcttacttcatttgcatatactctgcagcatttaaaagctttcacaaaggttcaacaactatttgcctggca

SEQ ID NO: 1836 - DNA, 5488 bp, Homo sapiens
aggatgtggtggaactaagttgtattaggttagatagatcctaactagatttcacaagtatgttatattagcagctgaagtggtatgtacaaatgactcattttattttttaatagctttattgtgatataattaacatgcagttcacccatttgaagtgtacaatcaatgatgtatagcatatgcatagacacgtgcaaccatcaccatacctttagaacatttttatcatctcagaaagaaaccccatatcctttagctatcatccctcatcttccctatcccaaagcaaccactaatttgctttttgtcttgatagttttgactattttggacatttcatataagtaggaattatataatattggtcttttgtgtctgactttttccacttagtataatgttttcaagattcatccatgttgtaacatgtattaacactttctttctttttgtgtaaggctaatataggttgagcatctcaaatctgaaagccccaaaatttgaaatgttccaaaatccaaaactttttgagtgctgacatgatgctcaaaggaaatgctcactggaatatttcagattttggatttgggacactctaccagtaagtataatgcaaatatttaaaaaaactgaaatccaaacacttctggtctcaagcatttcagataagggatactcaaccactaccacattttgtttacccgttcattagttgacagacacttgtttccatctgctggctattttgaacaatgctgctgtaaacatttgtgtacaagattttgtgtggatatatgctttcttttgttgagtgtatgcctaagactggactttctgggtcatatgataactctgtgtttaactgtttgaagaattactaggcttttccgaaagtgctgcactattttacattcttaacagccacgtaaaggagtgctgatttctccctgcctttcccagcactctctgtcttactttttgtttatagtcatcctagtggatgtgaggtggtgtctcattgtggttttgatgtgcatttccctgatgactaatgaggaggaacatcttttcatatgtttattggccatttgtatgttttatttggaaaaatttctcttcagatctctattcacttgtcttaaatttcaacaggtttttgggggaacaggtggtgtttggttacatggataagttctttagtggtgatttctgagattttggtgcacccatcaccagagcagtgtacactgtatccaatgtgtagcctgttatccctcaccccccacccttccccacattgtatcattcttatgtctttgcatcctaatagcttagctcccacttataactgagaacatatgatgtttgcttttccattcctgaactacttcatttagaataatggtctccaactccatccaggttgctgtgaatgccattatttcattcctttttatggctgcatagtattccatggtatatgtatatataccatattttcttttttaaaatattttcaattatgggcacatagtaggtatatatatatttatggggtacatgaaatgttttaacacaggcatgcaatgaataataatcacatcatggagaatgaggtatccatccccaatccattgtgtatatataccacttttaaaatctattcctctgttaatgggcacttactttgatttcatattttggctgtgacattgtaaacagtgtcacagtaaacttggaagtgcagatatctcttcaatatattgatttactttcttttggatatatacacagtagtgagattgctggatgaatctattgttgttctatttttagttttttgaggagttttcatagttttccatagtgagtgtactaatttacattctcaccaatagtgtacatgggcttcactttctccacatcctcgctagcatccactattcccccgtctttttaaataaaagcggtattactctgctctcacgttgctataaagatactacctgagactgggtaacttacaaacaaaagaggtttaattaactcacagttctacatgactggggaggcctcaggaaacttacaatcatggcagaaagagaaggcgaagcaaggcatgtcttacatggcagcaggatcgagagagagagagagagacagagagagagagagacagagacagacagacagagagagacagagaaagggggaagagccacttttaaacatcagatctcacaagaactccctatcagaagaacagcatggggaaaaccaccccatcatccaatcacctctaagcaggtccctccctggacatgtggggattacaattagagatgaggtttgagtggggatacagaaccagaccatgtcaaaagccatttcaactgaggtggtatgacatttcattgtggttttgagttgcatttttctgatgattagagatgttgagcatttaaaaaatatacctgttgcccatttgtatgccttcttttgagaaatatctattcagaacttttgcccatttataaattattttttttgctactgagttgttagctattgagttgtccttatatattcttgttattaatcccttcttagatggatagtttgcaaatatatttttttccaactctatgggttgtcactccactttgttatttcctttgacagcagccttttagcttgatgtaatcccatttgtctgtttttcctgttgttgcctgtgcttttgaggtcttacacacaaatatttgccaagaccaatgtcctagagcatttccccaaggttttcttctagaatgttcatagttttaggtcttagatttaagtttttcatccattttgatttcattttgcataaggtgagagataggagtctagtttcattcttcggcatgcagttatctagtttccccagcaccatttactgaagagactgttccccattgcgtgttcttggtgcctttattgagaatgagttggctgtaaatgtgttgatttatatctgggttctctattgtgttgtctgtttttatgccataaccattctgatttgcttatatagcttcatagtacattttgaagtcaggtagtgtgatgccttcagctttgtttttttgctttggttattcagggtctttcatttaaattttactttttaaaaatatttctgagaagaatatcattggtattttaatagggattgaattgaatctgtaaattgctttggatagtactgtcattttaacaatattaattctttcaatctaggagcacggaacatctttccattttttctgtgtcctcttcaatatatttcaccagtgttttatagttttccttgtatagctctttcacttcgtaggataaatggattcctcagtattttatagtttttgtagctattgtatatgcgattgccttcttgttttattttgtagattattcactgttggtgtgtataaatgctactgacttttgtatgttgaatttgtatcctgaaaatctactgaattagtttatcagttctaatagtttttgggtggagtctaggtttttctaagtataagatcatattgtctatgaagaaggagaacttcacttctttcttttcaatttggatgccatttatttctcttgcataattgctccagccaggacttccaatattatgttaataaaagcggtgaaagtgggcatccttgtcttgttccggatcttagagaaaaggctttcattttttgtccattaagtatgatgttacctgtgggtttgtcatatgtggcttttgttattttgaggtagtttttttttctatacccaatttattgagggtttttttcttatcatgaagtgacgttaaattttatcaaatgctttccagcatttatcgaaatgatcatatggtttttgttcttggttcagttagtgatgtgtcatgtttattgattcatgtatgttgagacatgcttgccttcctggaatgaattccacttgatcatggtgagtgatctgtttattgtgttgttaaattcagtttgctggtattttgttgaggatttttgcatctatgtccatcagtgatattaacctgtagttttctttttttgttgttgtctttgtctggttttggtatcagggtaatactggccttgtagaatgagtttggaagtactcctgcttcaattttcttgaagagtttgagtaaaattggtattagttattccttttatgtttggtagaattcagcagggaagccattaggtcctggaattttctttaatgggagactttttaaatttcagcttttatctcatcattcattattggtttattaaggttttctatttcttcatggttcaatcttggtagattgtatgtgtccagaaatgtatccatttcttctaggttttccaatttgttggtatgtagttgttcataatagtctctaattgatctttgtaattctgtggtcacatttccttttggctgagtacagtggactttattgatggtatgtgacaggatgtggctccctaggcccctctcttttcagggggcctggcatggaaactgtgtcagggggagattctcagtatggtgggagagtgagtgtggcagggactccctagcagctgagaacctctctaatcttcttgtgctcttgctggggctggtggtccaggggctcttactctttggaggccatgtggaccatgaggcctccactaccctgttgccaaattcattgtcataccagggaataagcttgacaaagtagtcattgagggaaatgccagccccagcatcaaagctggaagagtgaatgtctgttaaagtcagaggagacaacctggcactcactatagcccaagatgcccttgagggggccctccaatgcctgcttcaccgcctttttgatggtgtcatatttgtcaagtttctccagatggcaagtcaggtccaaaatgacacagaggtggggatatggaacaccatgctagtgagcttccattcagcttggggatgacctttccaacagctttggcagtgcaagtagatgcagagatgatgttctgtagagccctgtggccatcctgccaacgtttccaagaaggggcacccatggtcttcggagtggtagtgattgcataggctgtggtcatgagtccctccatagtgccaaagttgtcatggatgaccttggccagaagggctaagtagtaggtggtgtatgaggcactactaaggatcttgaggttgttttcatacttctcatgattcacaccccacataaacataaggggcatcagcagagggggcagagatggtggctcttttggcttacccctctaagtgagcctcagccttctccatggtaatggagattctagtgggctcaacaacataatcagcaccgctgtcatttcactcgattttgggggggatcttgctcctggaagataatgatggg

SEQ ID NO: 1837 - DNA, 3043 bp, Homo sapiens
aaggcctaaccatggtgagaatagtgttaacgtcattagggtgagaagaaagagaaataagccgaggatgtctttgattgtgtagtaggggtggaaggtgattttgtcggaatgggaggtgattcctagggggttgtttgatcctgtttcgtgtaggaatagaaggtggagcgctgctagggctgtgataatgaagggcaagataaagtgaaaggtaaagaaccgtgtgagggtgggactatctactgagtagcctcctcagattcattggaccagatctgttccgatgtatgggacggcggatagcaggtttgtaattactgtggcccctcagaaggatatttggcctcatgggaggacatagcccatgaaggctgttgctatagttgtaagtaggaggatgatgccaatgtttcaggtttctaggtaaagaaatgagccgtaatataggcctcggccgatgtgtaggaagaggcagatgaagaatattgaggcgccattggcgtgaaggtagcggatgattcagccataatttacgtctcgggtgatatgggcgatcgatgagaaggcggttgaagcgtctggtgagtagtgtatggctaggaatagtcctgtggtgatttggaggattaggcaggcaccaagaagtgagccgaagtttcatcatgcggagatattggatggggtggggaggtcgataaatgagcggttaattaattttatcaaggggttaattttgcgtattggggtcattagtgttcttgtagttgaaatacaatgatggtttttcatatcattggtcgtggttgtagcccgtgcaagaataatgatgtatgctttatttctgttgagtgtgggtttagtaatggggtttgtggggttttcttctaagccttctcctatttatgggggtttagtattgattgttagtggtgtgattgggtgtgttattattctgaattacgggggaggttacatgggtttaatggtttttttaatttatttggggggaatgatggttgtttttggatatactacagcggtggctattgaggagtatcctgaggcatgggggtcaggggttgaggtcttggtaagtgttttagtggggttggtgatggaagtaggattagtgttatgggtgaaagagtatgatggggtggtggttgtggtaaattttaatagtgtgggaagttgaataatttatgaaggagaagggtcagggctgattcgggaggatcctattggtgcgggggctttgtatgattatgggcgttgattagtagtagttactggttgaacattgtttgttggtgtgtatattgtactagagattgctcgggggaatagattatgtgattaggagtagggttaggatgagtgggaagaagaaagagaggaaataaagtttgattatgcctttttgggttgaggtgatgatggaggcggagatttggtgttgtgagattgttttaggtagtagcttttctagtcaggccaggtctaggaggagtaggggtaggttttggcttgtaagaaggcctagataagggactgtgcggtgtatgatactagggtaaaatccgagtatattagagaagtaaaatgtatacagtggggattttattttgagtttgttggttaggtagttgagatctagggctgttagaagtcctagggaagtgacgcctagggctgtgagttttaagtaaagtgggattgtcatttggggggtggatgtggggagaatgctgttggtgatgagaaaccctgcaaataggcttccgattgttaggcgtttaatggggtttagtagggtggggttgttttcgttaatgttagtgagggctgggaagcgaggctgacctgttagggtgagaagaattattcgagtgctataggcgcttgtcagggaggtggcgatgagagtaatagacagggctcaggcgtttgtgtatgatatgtttgcggtttcgatgatgtggtctttggagtagaaacctgtgaggaagggtattcctgccaatgctaggttgccaatggtgagggaggttgaagtaagaggtatggttttgagtagtcctcctatttttcgaatatcttgttcattgttgaggttgtggatgatggatccggagcatataaatagtatggctttgaagaaggcgtgggtacagatgtgcaggaatgctaggtgtggttggttgatgccgattgtgactattataagtcctagttggcttgaagtggagaaggccacgatttttttgatgtcattttgtgtaagggcgcagactgctgcgaacagagtggtgatagcgcctaggcatagtgtgagagtttggattagtgggttattctctgctagggggtggaagcggatgagtaggaagactcctgctacaactatagtgcttgagtggagtagggctgagacaggggtggggccttctatggctgaggggagtcaggggtgaaggcctaattgagctgatttgcctgctgctgctaggaggaagcctagtagtggggtgaggcttggattagcacttaggagggttatttgttgtgggtctcatgagttggagtgtaggagaaatcatgctagggcaaggatgaaaccgatgtcgccgatacggttgtataggattgcttgaatagctgctgtgttggcatctgctcgggcgtatcatcaactaatgagtaaaaaggatataattcctacgccttctcagccgatgaatagctggaataggttgttagcagtgactaggattagtatggtgattaggaagatgagtaggtatttgaagaattgattaatgtttgggtctgagcttatatatcatagtgagaattctatgatggatcacgtaacgaacagtgctacagggataaatattatggagaaataatctagtttgaagcttagggagagttgggttgtttgggttgttgcccagtgtcagtttgagataatgacttcttggtctaggtatatgaatattgttgtggggaagagactaataacaagggtggatgc

SEQ ID NO: 1838 - DNA, 5155 bp, Homo sapiens
ctcctggaaaaggtattgagttctgttgtaaggagcagtttaattatgggaagatcatttttgccctttcaggcatagttttattcattggtagtagaactctacttttgttttgaatttagtttatgaaccttacccgtacccctatagtggagcctttcttgaatctccaagtgagagtctgagatatgcagtaaattatctccacttcacccaggattaaactccagagtattctttctagcagtagctaatctctggtatcattgttcagcaatcaaccatagagcaggaaatctctgctagaccttgtggaatcttactctatgaaaatgccatctagacgttcgcccaaaattcatggtgaatcctcacacaaactactgccattcccagctcagctcccttttgtcagctaccctacactccaaattttaagcaactcagaagcccagacttttctcgctgcttctcaactcagtgaaacttcagttctactgggctctatttccgtatttgatagtaaaaagtgcatccaagcagaaagtcatggaggttacagagctcattttgagtttttccttctcttaaggattatattcctgtgctatgtttagttcaatgccagtaaaaatttactttagataatgtgtgtaattttacagttgcttattataagagaagtacagaaactggttactttatcacagttggaagcataaatcctaacaagccatttttattgttagataaaagagataaagcagattgccatagatgaggcagaatgagggtcgtgagggaggcaggctcattgagagttaaaatagagcctgtgatgctacgggtattgcaacatactacatacatctgtacttgaaagtaaagcaaaaaaatggagaagagatacacgtcagggattgggtcaacagcacacgaggtgaaaagattttgtaggagacaacaaatctgaatagaagtcagtgcctttctctccttctgccaattaattttcccaccttttgccattaatctttagaaaacagctatcccccaatagctgtcctcgtaagtcataataaaaagaaaccaaccagattttataaagaattgcaaaaattgaagagtaaatgaataaaactccaaatttcagtgaagaacatgaagtgcataaaggaatcacctgagtaaagatatgaaatcaataattcacacaaaagtactctgtttccaaagaaattactgaaatgctatattttaaattgtttttatataataaaatgtcaaaagagttaaaatattttattatgatttgtaagatgatagatgcaaataaaaagcagactgaaaaagatcaggaaacaagtgaactagaaaacagaaataaaagcttttgattgctcttcccctacccaacacacaaatagaataaacataattgagagttataaagaacagatattaaaaatgaaaaaaataagaattgtagagaaaatattaaacgtaaaggcaaattagacaaaaaaggacatagtgtttctaaacaaaataaatggactaaattgaggagaaagagaaaaaaaagtcacaggggaagaaactttcctggaataataaaagtctaggcataataggtggacctttccattagggtatgctgtgctaaaatttctgaacttcagtatttgggaaagaaactgtaagggctcttgggtgtaaacagcaaacgaaccccaaagaaggttggatgggagattggagagactagactgacctcagactttgcagtactctaacagtgaattgtttctccacaaacatttgaggaggtcaggtgacccaagaaattataaccagcgaaactgctgttgaagtactgaataatcattaaactgtataaaagtatggatgcagaggattaatttaaacatatattaaacactaggaagatggggaaggagggacgctgagtttgagctttgtgattacagatcaaaatatgtgatgatttttgatattctaaatttaacaataagatttttttaaatttcagaggtgagtaaaaagaaagtgggaggaacataaatacgttattttccttttttcactatactttttataaatgaaatgttattaaaataatatactttaatatttttcttaatgttatcttttagatagtgatagatcttgtcttgtagtaagaaagtatctacgtgactttcagcaatgcctttagttatacttattttattgttaaatttcatataatttaataatttaccattttaatataataggaataaaattcttaatttttatctctctctttttctctcccacctcacctctctgtctctccatagagctataactacagtaattatactaatatttaaagatgattatttcaagatagtgggctttggaatagaaacttaaaaaatgttcatacttacatttttagattcattaaaaatagcaggtaaaatttgtacataaaacagtaattttttaaaagaaaataacttattctgtaagttttggcactctcctcaaaaaagattaaatgtcataagtaaaacccaagtatactcgtaaatattctaatatattggtatacttcttgggtcagcaaacttttcttcaaagggctatgaattaaatatttttgatttgtggaccatattatctctgttgtggctatgcaactctgttactgtaatgggaaagcagcaatagacaatatgtaaacagactggcatattccaataaaactttatttacaaaaataagcagtcagttctgggtcgtggtttgttgacccctggtatacacatcatcaactttagtgattaaaatattatcagcctatctgtgaaatactgaggtaaggaaactaatacaaaatattcctgatgtattgattttatattcttgctccaaatacttattactgtaatacttagctttgatgagaaagggaagtgttgctaaataatttacatacatattcatatacatgcaaattttcatatcttttgatgtctcaaaaatgctgacatttaagaaaggaagggcatattttgcttcttacagttcatatgtgctgtactcaagctgacttcttccttcccattttacatttctaactttgatctcagaatgtaggagctggacaggatcaccgagtgcatcaggtaaataatttcattcacacaagaagaaaatttacggccactaaagttaaacggttaccatgctagttcttgccaaagtcaggactggaattcagtctcctggctcccattgcagagttttgcccactacactatattattgtacatggcttggttcaagccacagaggaactaatcaaagattaactatctgatttatacatatgtatatatatacttacttatatatatatatttttatacttacatatatatatatatatatatatatatatatttttttttttttttttttttcctcgagagggcatctcgctctgtcacccagtctggagtgcagtggtgtgatctctgctcactgcaacctctgcctcccagattcaagcgattctcctgcttcagcctcccgagtagctgggattacaggcatatgccgccacgtcaggctaatttttgtatttttagtagagatggggtttcaccatgttggtcaggctggtctcgaacacctgacttcaggtggtctcctgcctcggcctcccaaagtggttggattactgacttgagccacaatgcctgggccaactgactgattattatattaggaatgcatttatattgactcctctgttctgagtacttactagttatcctgattctatttgttctctattttaaaagtaggtttataaataaagttatttaagagcaatcagtcattacacatgaggagtggtattgctctatgtatactccgtttcattgagaaacagccttttcgtaaaatggcaaaaaaaacacagctgcagttatccctttcttctgggtcatttctaatagtttagatcagtggttctcaaactttaacatgtatcagaatcacttgaagagcttgctaaaacacagattgctggggcctcctccagagtttctgattcaataggtttgggatgacgcctgagaatttgcatttcagacacgtttccaagtgacagtgatactgctagtctgggtaaaaaattttaaaaaccactgggtttaaattctcagccctaaaggcatattataattaccaggagaggcattaatccactaattaattcccaggctccatcatcaattggcatagaatgtctagggcttgagactgggtatgagtattttgtcttttttttttttttttggtttaagtaattaatcggtgcattaataattgtacatatggggtacaatttgatgtttcaatacatatctgtggtgtagagagatccaatcagggtagtgactgtatccatcacttcatgcatttaccacttctttgtggcgagaactttcaaaagcgtttcttctagctgttttgtaatatacaatattttaatgttaaccatagtcaccctactgtgcaacaggacaccaaaatttattcctcctatctaattgtaactttgtacccactgaccagtctctccctattctcccgtctcttttccctcccccagtctctggtagccactgaagtgcctcaggtgattctaatatataaccaagtcggagaagcaattaagaaaagtaatgactgaaaaagtttattttgtctgatgaattagtgcaaaattttttaaacatattcctctattatgtggggataatttttatactgtcatttcatggtaaagtataaatgagatagtataaagatgactttaccaagtgattccataaattgaaggtaatttgagtgtagttttatgctactaatcgtataaagtgctgagaatataaggtagctatagaattttacttttaaaatgttgttattgtaaaatttttgccattaataaaattatttcatgcctcagttccttaaattatttttattagcattgtatagacagcatagatactaactcctaaaattcttaatttctctctttatagtgaaagatgcagatgta

SEQ ID NO: 1839 - DNA, 22915 bp, Homo sapiens
ggggctcagattgtattggatttactcaatttattctaaaagtgccaaatgcatgtttggacagtagttcattttaaatttctttaaatatctctagtgtcatatataataacaaatgaattataatgtatattcaatgactatatttagtgtcatcctgcttttccttctttagaattttattagaccaccttacataaaaacagcatcatcaaattctgatgtggtatgattttctctgttgaataaatatttcaaaaaagccaggggcattagttaagaggagcattaaaaaaacaacccaaatgtcaatccaagttagtatggataaataaaatgtagcatatctatgcaatgcaatgcatccaatgatggaaatgaatgagcacagagcaaaataaaatgtgcagtgaaagaagtaaaaccaaagaatacatatcctatgattcttttttataaagagttcaaaatcaggcaaaactgttttatatcatttagaagtacatactataaagagcttcacagcaagtcaaaaaaagggggggccataagtgttagcatagaggtttgcctccaggagggagaacagcccctggaaatagaaagtggcacaagagggttatcttctggggtgttggcaatagtctctttcttgacctgagggcagttacataggtgtttgctttacaataacacattaatctctgtagccttctgtatatgtgccctaattctcagtaaaaatagataataatgatgatgatgatgatgatgatgatgatgatgatgatggtagaatagatggatggatggatacatagatgtaaaaggaaagggaataattaaaatcaataaaactaggatatttgatctattgctgtctatttcaaccaagaggtacagttggactgccatagaaggtacatcataaagggtcatggtacatactttggaaagaagtctaagacaggaactaaaaagttgggtctagaatccagatctatactttgacacattctgtgtatatcatggaaatgatcacttcaattctttgtgcatcagggttcttatctgcccactgaggtaataaccatttatagaaaagtctgtgataatttcaatgagattatacaaattatttggataataatttttcatctgcatctttctcccaaatcctccaatcctgtacatgaggatgtaaaaaaaattatgaggtataattaccagtaagcaccatctacttttacatatttcatgtatgcagttttttgttcgacaaacttttgtggtttttttaattattttgagttcaggggtacatgcgcagcatgtacaggtttgttacataggtaaacatgtggcttgctacacagatcatcccatcacctagatattaagcccagcatccattaactattcttcctgatgctctccctcctcccacctgccacctttcaataggccccagtatgtgttgtttccccccccatgtgtccatgtgttctcattattgagctcccacttataagtgagaagatgtggtatttggttttctgcttctgcattaccttactgaggataattgctttcagcaacatccatgtccctgcaaaggacatgatctcattcctttttatggctgcatagtattccatggtgtatatgtaccacattttctttatcaaatctatcattgatgggcatttaggttgattccatgtctttgctattgtgaatagtgctgcaatgaacataggagtgcatgtatctttatgatagaattatttatattcatttgggtgtatacccagtaatgggattgctgggtcaaatgctatttctggttctaggtctttgaggaattaccacaatgtcttccacaattgttgaactaattgacacttccactaacagcataaaagaatccctttttctccacaacctcactggcatctgttgtttatttgactttttaataatagccattctgactgctgtgagatcatatatcattgtagttttcatttgcatttctctaatcatcagtgatgttgagctttttttcatatgtttgttggatgcatgtatgccttctgagaagtgcctgtttatgtcctttgcccacttttgaatggggttgtttttttcttgtaaattttcaacaaacttttgttgagcaaaacactgtggtcatgaataaggaaaagggttttattatttttatgttgcatacacacatagtcacacatgttcacatgcacacatgtacatgtaccacacacacacacagaggcaattttttatttcttaattcccttttatgaattggtgtctctaaacatgataagggaagaaaagtatcaactaatgattatgcaccacttttcagaaatattgaggtcatagtctggaatattatgaaagattctttcaaattatgaccctcttgaaaataatttggaaataaactgattttgcatttaagtgacactgatggattaataagttaatgtatacctagattttgtgatattcataaaaagattgtaactgaatatttgtgtagtattgatttgattttagatacctttaattaatagcaacctaagtccaacagcacattttgcaaaagcaaatttatacacctgaaataaaatgtaagttgattttattaaatgaaagtccaaacttacttaatatgagtccattgagtccaaactcaatgatttaaacatattttctccaataaataatgccccatagctttcttaaattaatatttactcctgaaataaatattataccatatttattggtatgatatttaatagaaggtaaagaatttaatgtgcattttcttcctcaaataaataaatattgaacttaacttgtccttcgagcattgagatgtcttccactaaacacctacagctttaaacacacctcctggaaccctgcatagaatgatttaatagttacatattgagaagaattttaaaaagtgtctctgacaccctctttattccattgaagaacttaccactggtgggacagaagaattgtctgtggtcgccaaggtttttttttaacaattactaaaaatttactttttacatcttcatgcccattggcaaagtaataccaaattgcaaggtttaaactatgtaggttttatttttttatacaaacaacatttatttccaataatgcaattaaattatttgttgtctttatgtattatagctatgacaacagtacaatatatacccaactctatcatttcattctacaaccagtagtacaattagaatttgtgtctatctcttagcttattttgaactaattttcaggacacagcagtacaatgtgtagagtacagtgtggtgggcatcaatggttattctgaggaagaaaatgggcattaaattcttacctcctatgaaagaaacatagtaggggtgtaaatatatttatttcattcataactttgataactagggcctacccatctgccagactatattattgtgtaaatagctcccatctgagctaggtgtcttgctaactcagatcaattagtacttgtaattgaagctcaataataattactgctacatctagtgagcatttaattcctgtgtgccaggcatagctatagatacagtttaagctgctcaagtttaacacagtaaaaatgataagagcataggtgcttataaagaattactattacaaggaaactgggtatgaatacagtttttaagggtataattttgggccaggcttggtggctcacgccacactcccaacactttgagaggcctagtcgggtggatcttctgaggtcaggagttcgagaccaacctggccaacatagcgaaacctcatctctactaaaaatacaaaaattagccgggcatgggggcgggcacctgtaatcccagctactcgggaggctgagacgtgagaatagcttgaacccaggaggcagaggttatagtgagccaagatcgcaccattgcactccatcctgggtgacagagcgagactccgtttcaaaaaaaaaaaaagatacaattttgaattcactgcctatatctaatttcccagcatttattacgattcaccaaataaggtagcaatcatatatagggatttttagatcatgaggtttttaggtgtcttctggattcagatgagttccttgaaatcatcttgcaaactgaaagtgactgtgatataagaaataaccataaggctatggcaaagctgagagtgacagagtttatgcaattttccttaggaaaactgcatgatatctattttgaatcctccacctggcattactcattttatttatggaacgcattctccccagagtgacatcttctttccgtatccataatgtataattgtgatccttagaccttatcatgaaaggacaggtggaatattattttaagcaccaggatatttcttagtaaatatcatatgtagagtattgaccctttcagggacagcaatcacatagcaaaaggaaagcacaattttatctcttgttcaatcacattgttattctctttattctctggatttagggtctgttcctataataggtaacacttctaaagataaagaaagcacttaagagaattttgggatgtgttccacaagagacctggaccacattttcagttaatagtgtttgataaattgaccatgaaacattaaaaaaaaaacacagatcttaattcattaattgctgttagcattttattcgtaagataattaccatacatgtaatcattaatgatctacgctcatggagaatgtctttacaggatgatatttctgagatgttttaagactcctacattactgaatttgtaaagggaactgtgatttttgtttcaaaaatttaataagttaaatgattaatacatatagtcctcccagaaaaaaggaaaaggcaaatcatagtcatctctttcattactgtaaaatgtggtaataatttagagaccaatattttgttgattcaatttttgtcatttactaaattaaacaataatatgtataacataattccagttatgagtttactcttgggagtaactatatctttacttcatctcatttcctctctaaaaagtcatctggatgtgaaagtatacacacaaggtaaaatatatagtatattatagtgtaaaagtatgatttttaaagaacttggaaaaagaaagaagtttaatgggacttatattgggttctatagatgcagattaaaactaatagttacagtagttttaattcctatgtttcatgtatagaaaccatgctatcattcttctaaatctgtaagctttttgctgtagatttaggatttagagcattatatctaattctaaaacaaacatttgaattatgaagaagttcttatgctgcagaaatttatttaaatttagactgtcattagcatcaagaatattttttattccattaacaacttttaattaatcatacaatttgcttttatttcagaaaataccacgtatctttatagactaggagctcagatatattatttccagctttcttgatgttacctcatattgaagttgccaatggtaggactgcacaatctgaatacatatgatgagatattttatgcctcgttttccatctgcttgagttagcaccctttcaccattggccatttcatactacccaatttccatgtaatttgtctctctaatcttgtcagccccttgaaatgaaggtgcactttattcagggattattttcatgctcaagatcattttgtgaattattttatatcattataaataatcctactgttaccttttcaatacaagaatttgatttcccagcattaatgggttcattcaatagtagtgccaagttcatacagcaacactgtaattgcattttaatcagaaactagtaatatatgctgaagatactttgttaaattaacattattgctgtgattaacaaagcacactgttaagtgaatattgcatgaattaaattacatactagatcacttacatagtttaggatttcatgtgctatctagctacctcttcccacaaaatctacatccttatctgttttactcataaaaatgtaattcttgaagctcataagcatagctacttaaatgattcctttgcttaatagaaacatctttgttcactacaacaagcttatctgcactacattttttaggaataaaggatatgtgatatgtattatttgaaaactggcattcaattgccacacttggctgttcaccataaaactcctatttgaaatctaactttgaggacttctttgaggatactagagttatagttctgaaatagttacttgcagaaatgctatctattaatttaaattttggtttaaaaaactcataatatttttttttgagacaaggattcactctgttgcccaggctggagtgcaatagcacagtcagagcatattgcagccccaaacttgtggcctcaagtaattctcctcctttagcctccagaatagctaagactacaggcaagcaccaccatgcctggctaaatttttttttgaatgttgtagaaatggagtgccactatgttgcccaggctggtcacaaattcctgtcctcaagcaatcctcccaaagtgctaggattactggcatgagccactgcacccagccttaatcatttttagtgcacagtttagtggtattaattatagtcatgttgttgtaccacagatctctagaactttttcattttgcaaaactgacactctgtacccattaaacaataaatcctcattttcaaaatgagatagcttctctagatttagtaaagctctcttctttttcattattttgcttttctgtgaaaggggacttcaaatttattttgaggaaacaaatgtaaacactcatcttaaagtatgtatattaagactattttaataatcagagcaaactttcatttatttagctattttcagtttgcagcctaccatgccaaacattactttattgctgttccctgcagtccttttgacaaggatggagcactgtcagagctgcactggagctggagacagggatagaggacactcaggatgacagcccccacccagaatcctggagaggaaagttgctattgttgaaaacataatggatctggttgttattaaagtacctgaagtcagctgcataaattgggaagcatatgcacgcttctgctttactgtggcaatttaaaacaatataaatttcataaaattctcattgaaaaaaaatgaccaagaaaagccctaaaaatagtaggaaatgttacccatcattacatcctccaccatcaaggccaagtagtcaatacccacgccagataagcactgtgtgcctatgtgaggtggtcattaaagaatgatgaggaaaggaccacagaaatcaactggtgtcttcccaaagtcctggggacgctgaggaacacacatgggtctcataatgtccatgtccttcccttatacctcaatgctctttccaccttgccctggtggaaagtcttgtccatatcacctctaatccagcattctcaaagcagcacaaaactgtcttcagaagactgaatgtttctacattccttcatattaattccaggaaaagaattcccaagtcaaataattcaaatgctaagtgtattttttaaaattgtttttaggcactttctcttaggaatgtaaactctttgagggcagggtctatgtcctttcatcattgtgttcatcaggctttatcattgtctagcatatggtggatggataaacaaccatctccgtaaagatatctgatttctattccaactacacaagctccttttctagtatacacagccaccaaaataatgcttaaaacatatgtctcagaatgacaatcaagatagaagtcttaaagcaagaaagatgttttccttgtttgttcttctataaattctctaaagattcataaaatttagctatacaatctacttcagataatggcttctagatgctatgtagaaattggcccattatgcaagataaaaatcatctaagattataatgcaaatcagtcatcataaaaaatataaagatctagaatttatagaaattctactgagcatttattttatgtgaaagaaaaatacatccacagtacatacataattaaatgtaaatgtatgctgaaaaagttcataatcatgaaaaatacatatcttgatggactacttttatttggcaacctttaccttccaatatctgtcataatattagagtagattagaaattatatctacagtctcaactcattttatgaaatatgagtaacggtaggtatagataatttattttccctcagctgtacataaagatggataattacatctttctaaaaaaatgaagctgaccaggcgcggtggctcacgcctgtaatcctagcactttgggaggccgaggtgggtggattgcttgagctcaggagttcaaaaccagcatgggcaacacagtgaaactctgtctctactaaaaatacaaaaaaaaattagccgggtgtggcgatgtgcgactgtagttcccagttattcgaaaagctgaggcaggagaattgcttgaacctgagaggcggagcttgcagtgagcggagatcacgccactgcactccagcctgggcgacagagcaagactccgttgccaaaaaaaaaaaaaaaaaagaggaagaagccattaggtctcttctaacctttacctttgcagactttaatgttgtcagctagtccaacatcattatgcactattatttgaaggtgctcatccattttcccagcatcttttgtgttgtcataacccttacatgcagtatcagtaaatatggctttattgtttgacaacataaattccttagtgacgttttcaaaagaataagagtttttaaccatttagttaaatagaaataaattgatgatgggaaatgtctgcattctatgtttaatttttctatcaatctaaaactgctctaagaaatagaattcattaactaaagtaatgatgtaggaaaagtttaaactaatttactgtttacttaaactgcaatagcaaaggcaggagaataacttaacaaccttacagttaattattttacaggatatgttacctgcctttcatcttccctgagtataagacaaggaagcagacttaaactctcatgagagaaatgtaagttgtataaaaaaaaaaaaattctgatggtcagagtctgctaatagtattgaaacttctggatttcatatcctggatgcaggtgattaaattgtctggtatagcttaacattctcttgcctagaaagaagaagataaattagtcagcacttggaaaactgatccaacttcttgttactataattctatatttctcagactggtttgctaagcccattagaacaggggcttcatgaaattaaggtcacaggtctaattcttatttcaacctattagcttccctttcttctgagggactttacttcaaacatcagccaatcatcttgtaactttcacccagtcacgaaactcacaagacaacatacatggagtggtcaggcacctactcattcccataattctctggaacatacttcagtgtgggctggactatcggtgtcacaagaagatacatgacaccgcagagatggcccagtacagtttttccttgtcaaaatcataaaaagactatggtaatcctacaaattctgattcacccgtgtcaaagaaaggaaggaagcttcagaaggttgttttcttttctccttcagagacttacaccaaattattttgaatttgcatttttttccagtctttaattcttgaccagtaagaagtctctcaactctagtcattgaatctaccaaaatattttgtttcaaaaaataagaaaaaaatattgcatttttctacatttttgagtagaagaatctccctaatcattggttataaaaaatgaaaatataacactgaacaagttaatattacaaataacaaaataaatgcccactgtgtaaaaataatgcaaaattcatatttcaaagttaccataatttgaatacataggtctcttagagtcaaaaacctcataaaatgtgtgatgacatttttcaggacatatgtagcatcttctaatcagatgctaaatgtgatctattaactatcacttgggttgctgcagccctacatcgattgttttatcctgttgataaaataaaaatttacctcaggaatgactcactggttagtaaaactgaattctcttaagcttaggacttgggaaaatcaataattggaaagataaatgttttgagtcataatgaaaagcatgtataataaaatcctgtataagagcctgaggcatcatccaaatttatagaagtggtaactaagtgttcaaagacaggatagaggaaagagcctagaaacctggttcaatgtctggaaatatttgtctctttagagtgataaatgagttttaatcaaattgactgtagaaatagaaccaaaaggaacattattctaagtggtatcggtaatcaaggaagaaaagcctggtattaagaacttaccatcttttcagtggtcccttaagatgaaccaacgatttgaagaaaacaaacttgattataatatacaagcttgcctatatttatttataaaatattctcaaagtgtagtttaattttaataaacctctctctctgagtcagggctcataaaatttaactatagtacctggcctaatttttttgagtcatatgttaatgtaaatcattaattaatctcatatattgatgagtatagtatgaattatctttttataatatctttgatatataaatattcacataaaaggttataatgtgttctaaagaattaatttctgactatacattatatactactagtgtctagtttaagactatatatcacttcttgtttgggaatttatgtttatatttaaatgtcaataattatcttcactagctcaccaattacatgcaattagtgattacaggcaaataatttcctaaaaatttgaatgaaatgatcttttaaattgtgttatgaaatatcaaacaatatagagtttggattggcaacagtaaatagaacagagcatctccttctacccatagcccttctctgacatcctacaaataggaatgaaggagttcctcaaatctgcacagtcaccttagggcctgggtcaggttttacccccaagacacatatacgacagaaagacaggaaagtgtaatgtgatcaccagtaatgtttctaaagttcaaatttaaaactttcacagccatttataaattcttatataagtaattttaatcgtaatgcattgcgaataacaaaaactcctactgtaatagctttcttgggaatccactcaatcagttacatatgtataggaaataaaggaatgccttcaaattataaaaaatactgaaaaatatttaaattggatatatttaaaataattacttttttatatagaatgccatagatcagaatccatatgaaaattgaaaacatgacctattatttatcagctcccaatgcaattataaatagatttaattggcactgggatttaaggcttacttactagtgtgtaactaattaatagaattttcagctcactcagcatgtgacttcttcaatgataagctgaagttccgaaaaaaaaaaaaaagacttaaaatgactatgcacatgatttttaaattactctccatgtttatggagtaattgagaaacaaactaagtttcatagtttctgaggccctgataggaagccaagtaaggatttaatatgataaaaaacaaacccacaaaaaatcatacattaaaatactagtaagataaataattgctgtaagtgagcttctatattattaaaactttttggaatgtaattaaaattaattttagagaatttttaaaaatagttatgtaagaatcaatttctattttgaaaagtgtattatgactactaatgctccattggtttaaataaataacactggaattctatattttatcataatcatctttgttactaatatagctgattattatactttcattaatgccctttattcaacgtatatttttattctttgtacactcaacaagactttgtttagaagtttctgtagtcttaacctgcctacctcttctgaaatgtctccttattctctttttatctctaagctttctattaaaaagtatgtctaactcaatgctttcttaactacatttccaaaccttttactatgccaggacattcttcagattcctagaaccattggttgctgttctcatgttccagtgtccttgaattactattgtctgaatctgcattctatctataaattatgcatgtcttcaaatagcacctataaacttctacttctgcatgctgttccataattgccaaattactgcacaagaatattattctgactatacagcagcattctgaaatcacggatttaggatttatatagatttatgtagatgcttttaatatccacgctattcccggcatatttttccaccctatatgctgcagttccctgattacctggcacttctccaccatctctttcccctagtccccaatgataatgcaattgtcttccattaaactgccttctgcaccaccttttgtagggcctaagtcctgtatcttaatggtacatttttataatttgaaaaattagatgtttaaaaaaggtattaaagaaaatataagtcattgagcatttttctctatacaatcaaaagaattaataatatattggctgaatgctttagagaaagacttggaaatagtctgaaacattttttctttaaagaaaactattttgtattttaaaagaacctatttttcacacataaaggggacagacttttgttttataaaatatactaaacatacattctagtgtgtacccaaggcagtgtctgaccatctgctggtaaaatttaagggcatttcaggtcaactcaagcaaataattttcagttcttcaaattaggtattcctgtcaatattgtattacatttgacatttgcactgttttattgggttagagccctaagcagaggaatttttttaaatttacctgatatgtgttcaaatattccctagtacacttcaaagggcctaaaacgtacgttttgaatgaataaataatcaaatgcataaatttgcactgtggaatttacatgcacagttaagccatcaaatgtaaagacagatttctagtatacgcccccattgtatgggtattgcagattttccatacctggtagtcatttggtatgcttggaaattcccaaggatacaacttatattaactgtttctaggtcctgaattttcttctagaaacctgttgacaaacaaaaaaaaaatgagagggaattaggagatatatgttgtctttctacctctgcctctaacagagggactttagacaaatccctggactccgtagtttacaaacgcacaaattatgaggacattgtttttctcttagtggctatggcagattcagattgtattttccaaagttggcagtagcaatatttctcatccaacattctcttccacaatgtcacgatgacattcctctcattgagaggtgaaatccatgatccctccctttgaaaccgggtgggcttggaactcccttgttactaatagaattgacagaattaacattgagtgacttctgaaggttgattaggaaaagccaagtaatcaaggctttgtatatggaagcacttatgctggaaccctgagcatactataagcccttgactatgcttagtccactgtgctgcaaagaagcccaagttatattccagagaacaaccaagcagagcagccaggcagtcctcagcttccccagccactcaccattgcagcttcagctaatctctaactgcagccacaggagagactttaagctaaaaccacccagccaagtcctttctgaactccagagctttggggaatgttaaatataatagaatactttttgctttcagctgctatattttggagatatttttaatgcagtatacagtatcattccttaggtaaagaaaaatgattccatgccacaaattgcttctttattctttgaaaaaaatataacctttctaattgactacataaatgtttttgtcagagatatgttagttaagtgccttgaattgtttcaggaaaacatgctataacaataattttgtttatcatatcatgaactcattaaaaataaaatgttttttagttttaattacaccaagacacaacactgcatcataggagtaaaccacttgtaaattgtaattgaaaatgtaatttttgagggctacaggctgggtgtgtatagtctactctttgtggctttaatcctagccttcttgaatcttcattagtgaaatctataaagaatgtaatcatgtatctcagaagaatcatttgttaagtgcgactgagatgatatattccatcatgaatataaccaaaagaatatcttttaggatattcttttatatcttttttccaaaaaaaaagaatcttgaatagattcatctgaagtctaataggttttgttttatattctgtttttacatactggattagtgtggatatctagaatgttaggagcctctcaagggacataactaatattcatcaatggatccttcacctttactaaatattgtccccatagtagatggtcagtaaatgtttgctgactgaataaaagcctacaagaaacagtgattaattagagtgtgactttaaaagctaatcatacaaagtatgtagttatatactttggttaagaagataaaagtttatagtttgagatgcttcttctactccaaggtcaacacactctctgcaaccatagctttatagcaaacattggactaggtatatgggaggacaggtacattttcatgaatccaaggtgaaataagaacagctgatgtgacaaaaaatcaacgagatccaggcatggtggctcatgcctgtaatcccagcacttcaggtggccaaggcaggaggattgcttgaggtcagaagtttgagaccagcttgggcaacagagtgagaccctgtctctacaaaaaataaattagcggggcacggtggtatgcacctataatccaagctactcaggatgctgaagcagcaggatggcttgagtctaggaggttgacgctgcagtgtgccatgatcacactattacactccagcagggacaacagcaagtccgtgtctcaaaagaaaaaaaaatcaacaagaaatcatagaagttaaatttatagtcattaaaattaaaaaacacaaaatagagcaatctctagttcagatataaaagtatattaaggaattcatccagaacacagaaaacaacataaagaaacataaaaatattgacactatgcatctaacaagagtgctggaactaagaggttagaggaaattttattcactccagaaatatttactgaatacctgctatgtgctgggtactattcttatattattattattattattattattattattattattattattattattgagacagagtcttgctgtgtcgccaggctggagtgcagtggcacaatctcagctcactgcaacttccactccccaggttcaggcaattcttctgcctcagcctcctgagtagctgggactgcaggcgtgtgacaccacacccagctaatttttgtattttttagtagagacgggatttcaccatgttgaccaggttggtcttgatcttgtgacctcatgatccacctgccttggcctcccaaagtgctgggattacaggtgtgagccaccatgcccggccgtgctaggcactattctaagcacttgattttgcaatgaaaaagccaacaaaaagtcctcctgagattttaattttataagatggtgggataagataataaacaaatgaacaaataagtatataaaggagagaagcaattgatactatacaaaaattaatgcataataagagaatagcaagtgacaaagaaagcgatatttgagacaagatggtctaggaaggactctcagatatagttaaatttatagaaaaactggaacgatctgatgatataagttttgcaaatatctgggagaagactgttctaaaaactggaaccacagcagataaaagttttaaggcaagaatagttttggcatacttgaaaaacaaaagactagtatggcagagaaagcatatttaaggaaatgataggtaagtattttcagaattgaagaaaaccatgagcccacagattgatagcaccctctgaaggcaaagaaatataaatttatacccaaacacactatgtgggactgaagaatgtgaaaaattaggaaagaaatcctcaaagctatcagagctatcagaaaaactaccagaaaattcagacagattgcccacaatcaagtaccagataaaggccagtaaacaaagtagagttattttgaaagtcatgatggacaaactaatccagatttttgtgaacataaaaatgcattttcaaattcaaaagtgaagccaaagtaaagacatttttcagcataaaagttgactgtttaccacccacagatgtacactagaagaaggagaaggaagaggagggaaaggagaaggaggaaagatagggatggggaggagaagaggaaggaagaggacatggggaggaagggaaatcagaaataacagtactcacagaaatgaataacatgtcaacaaattcatttaactagtaactgtaaaaaacaaattatttttatatgacaagtaaacacgattgacaataagatggaaagtaaaatcacactatgatttgcatcacatttagcaggaaaataaaaataatggaaaagcacgtaaacatttaaaactgtttagactgatacacatggtggatataacagtatttctagtagtagtaaaaagtttagttcaaagatttaaatttttaaaattataaatattgctgatttggagcctcctaaatacataacattttgagaaaaagtagattgaagtactatattagttagaagaagactagctatgttacagtaacaactaaaactctaatctcagtgctttagcctgatgaaagtttatttttcactcacgtactgtctgatgtgactagctagctcttcttggtagctttcttccaatgatgactcaacaattcagttccgctgatgttcactttgcaactcaaacattgtgaattttcttccagccatgaggttaggaaagcacagaaaacttactttatttcttaagtgcctcagaccagcaattacatatcagtttcactcacattctcattgacaagaattattcacatggccataacccaactgcaagaaagtctgtaaagagaggaacactcatagacatttgataagcattctctctgccacatttattgacagttatttatcatttcacatgaaaaagttacatatgtttctgaaaaataaatctcaaagaaagttaaaagtaactaaatctcttcaatgtgtaaatagaaatcattcagaggggaatattatggatttttggatataattttatgttaaatatattttaagtatttacaaacaatataagttagcaaaatgaatgaattcacaaattctctaataattattcagtttctcaaacctaatcatattgaataaattcaatattttagtatgtacagaaggaagaaaacaagttaaaagctttctaattgttaattcaataaccttttgtaaaataaaaaataccttttaaatttgcaatataaagtaaaattaaagctcctttagaaaaatatataaatatttatatatttctatttatatattatatatttatatattatatctatatataaagaaatatatataatttatatatatttctaaaggagctttgagatatatatatatatatatatatatagagagagagagagagagagagagagagagagtcaaacttttaagtttagaaaggcaaagcagagtttaaaccagaagcacttttgttattcgtttctctaaaatgaattgtctaattttctcagattttgattattttgatggtttgttccactttataatgtcagaaaaatatgctacatcatattaaaaaaatagaaatttagcttcaaactacctttgccattaaaaagtctttttttctatctaatatgcacataaagcactattgttttattacagctaatgaatacagttaaatggaaacatttaaagatttctttttcccttacctgggacatattttttaatgttctttcctatgataagttactatgtatattgtaacattgtgaataaatacaagttagggtttgggtgaatatattttcacacacacacctgcacacacacttaaaattttactcagactttgagacctgagtaaatctaaggctacagatttacttgttgcagaaagaaaaaaaaaaagtcactgcaaagctatggaagaagtatgaggtcaatttcaagaattaaaagtaataataataggcaaaagataaagactagaagaactgagggtttgcttttcctctcacatttatttctgtgacacaaaaatgaatatttcttaaaaatctttaataaccttaataactgagtactagtaataaaaattatcaataactgagtacagctgataaagattatgacaagtcttatgtggttatatttcatgtgctaatgctcaatatatgtaaaatttgattttaaaaatgatcagttagcaaattcatttcatgttttgtgagtaaggatgcacattactgaatttcatggttttctcatttacgtatttcaagaacaatgtcactgcatggggcttcctctgtgtccaagaaacgtactcctataaagtgcttgcttgctttgattcactgcctcagacatgttccactatatctgtttgcatctgttttttagttcaaggttaaattattcatacctgaaatacagcacaaattgctgaaaagtagggtctaagtagccaaggggatgtttatttctgtctgctgaaaatgttagacgtaaaacactgataaagtagtagaatgcctttagtttgtttccttttaaattctgaggaattgcatcagactaataatcttaaatgaattgatctgatgctttgaatattattattttgcttttatatggatgattttaaaagatgtccactctctaagtaaaattttattatgtctggtcataaaaatatgctcagaggaaagtatttcccattttataggccaagtctgtaaaaataaaaaatgaaattctttgaaatttttggaaccacgtttgtttcccaggggcagtatggaatgatggtataaagaacactggatttgcttgcaaaacctaatatgttgacattttgtgaaatagaaatattccttttttttaattttgtagctctaactttgttttttattttaattttttattattatactttaagttctggggtacatgtgcagaacgttcaggtttgttacataggtatacacgtgccatggtggtttgctgcacccatcaacccatcatctacattaggtatttcccctaatgctatccctcccctagccccccaccccacgacagaccacagtatgtgatgttcccctccctgtgtccatgtgttctcattgttcaactcccacttatatgtgagaatgtgtgttttttggttttctgttcttgtgttcgtttgctgagaatgatggtttccagcttcatccatgtccctgcaaagaacatgaactcatccatttttatagctgcatagtattccatggtgtatatgtgccacattttcttaacccagtctattattgatggacatttgggttggttccaagtctttgctattgtgaatagtgccgcaataaacataagtgtgcgtgtgtctttatagtagaatgatttataatcctttgggcatatacccagtaatgagattgctgggtcaaatggtatttctaagttctagaaccttgagaaatcgccacactgtcttccacaatggttgaacgagtttacagtcccaccaacagtgtaaaattgttcctatttctccacttcctctccagcatctgttgtttcctgactttttaatgattgccgttctaagtggcatgagatggtatctcattgtggtttggatttgcatttctctaatgaccagtgatgatgagctttttttcatatgtttgttggctgcataaatgtcttttttttttttgagaaggatctgttcatatccttcacccactttttgatggagttgtttattttttttcttgtaaatctgtttaagttctttgttgattctggatattagccctttgtccaatgggtagattgaaaaaatattctcccattctgtaggttgcctgttcactcctatgatagtttcttttgctgtgcagaagttctttagtttaattagatcccatttgtcaattttggcttttgttgccattgcttttggtgttttagtcatgaagtgtttgcccatgcctatgtcctgaatggtattccctaggttttcttccagggtttttatggttgtaggtcttacgtttaagtctttaatccatctttagttaatttttgtataaggtgtaagaaacgggtccagtttcatttttctgcatatggctagccagttttcccaacaccatttattaaatagggaatcctttccccattgcttgtttctgtcaggttcatcaaaggtcagattgttgtagatgtgtggtgttacttctgaggcctctgttctgttctattgatctatatatctgttttgataccagtaccgtgctgttttggttgctgtacactcatagtatagtttgaagtcaggtagagtgatgcctccagctttgttctttttgcttaggattgtcttggctatgcaagctctcttttgggtctgtatgaaatttaaagtcgttttttccagttctgtgaggaaagtcaatggagattgatggggatagcattgaatctataaattactttgggcaatatggccattttcatgatattgattcttcgtatccatgagcatggaatatttttccatttgtttgtatcctcttttatttctttgagcagtggtttgtagttctccttgaagagatccttcacatcccttgtaagacgtattcctaggtattttattctctttgtagcaattgtgaatcggagtcactgatgatttggctctctgtctgttattggtgtctggttttgcacattaattttgtatcatgaggctttgctgaagttgcttatcagcttaagtcgattttgggctgagatgatgtgattttctaaatatacaatcatgtcatctgcaaacagagacaatttgacttcctctcttcctgtttgaatgccctttatttctttctcttgcctgattgccctggccagaacttccaatactgtgttgaataggagtggtaagagggggcatccttgtcttgtgctggttttcaaagggaatgcttccagtttttgcccatttagtatgacattggctatgggtttgtcatacatagctcttactattttgagatacgttccgttaatacctagtttattgagagtttttaacatgaagggctgttgaatttaggcgggctgtatatcttaaaacaatcggtcagcttagtcagtcagtagtgtttgagagacctgaatagccaaattaggaaaaaggattgcaagttgatgtgagttctttgagaatgaagacagtttcccactgagtttcgttgattctttccttacttaatcttttgtttctatttgtttgagaaaacgatgtaaaacttaggtgttactattttaaacaaaaattaattacagtcatatttataactaggctaggagtaaaagatatatttagttgggggaaaactcatttttattttctaattttgagaggtatttttaaaactaagattggttttttttatgaattgtaaaaatcttttgatgttattcttttaactgaaggatgtaagaccaaaagtaaaataaaataaaataaagaacactggatttggaattgaaaaccaggatccagtgctggttttgacacttgatagcctgaggggataatggtgtaacttcctgcatctataaaatgtgaggaaaacgcattttaatatgcatagtaaactaacacagtcttccattaccaatgcttattatcattgttgctttaatatgaaagtattttcactatatcaaagttactagcataaaatcaatcatcagtgaatccattatcaatctaatcagtgtctatctggcatctttgtcttgctagtgtacccacttcctccttttggtggtataactgggtctttccttcagggaacacattctgtgatgtgggcagatttatttcttctgtagccaaaagcataagaattaattagaatgtctgtcactctggccctgggatttttctaacgtaaagaaatgttgaaaaatgttaatgctgagtagccatctcccaccaccttcaatccacaatcaacattttattatagctaatttatccatttatctatcttcctacccttacatcaatgcatcttatgttttgatgcatttaaaatt

SEQ ID NO: 1840 - DNA, 1475 bp, Homo sapiens
tgctgcaatatatactaattattccaaccaatactactactatctaccaaactatgtgcattcctgaaaggacctttgtgaagttacattacttttcattaattttaaggactttcttttccctggatctttaatttacatgtgtcagagtgctcccaaggattcgattacttttcattttattctagaatgttgataagatatatttgggaacatttatctaagctgccatttcatttttagtaaaattaggacataaacatgcaaacattatacctccttgtaaggcttaaataggtcagtgtactgccctggcacatagtaagaattgcataaatattatctagtttgaaaagtttttataattcctactaattaacattcactagtttaaagtatttctacaaataatttttatatttttctcttttttcacatgacctctttgcaattcttctatccatattcttctccaagttctttggttttatttccaaaataaaagtcctgaaatgaacaatcagatctaaataccacattcaggataatgaccatgagcactgaatggcagcataacatttaatgttttattcttttgtttttaatttttaaccgctttttttcttctatacaactaaacaatggctcgtatctttattagctgcctgaaatgactcctaagtattctaaagagattattgctaattcaaaatatatgattatgcactggtaattattccaaataaatctacttaatagtagcattattgatttgtcaacttgcagcattgtatttgtatctaggcctaataattttgtatttatttccaatttttctgtggttcagtgactaacattgcattgttactacaaactagatgaactgaaaatcagcatgcacatggtcagttgcttctggaaataattttaattttgccttgagttatactttcttagaaatggaattattaccatcccatgaatatcatttttcacatacttaacatattttttcataagttagttccatttatgtaaatatggttgtagctgcctagtgttaaaacttatggatgacaattagcacaaatattgagttacatttacttatataggatttctaaaagtgctttgggaaaccccaagtttatactaagtgctaactttaatcttgtttccaagttctaaaacatgaatgacatcatgaagtctcattctgaattttcagtgttgatatttattcagcaataggagcaaagaccctacagtcagtctctgtgggtttgaatcccacccttatcactcactagagaaaccttaggaaagttacttaacatcttctcaaataccttgttgaatttggaatgactgcttttaggataaatggaggtaagaaaagaggatattccaataaagtggaacagtttaataaaggcatgggcaggagacccaaagaagtaattgattaagttagg

SEQ ID NO: 1841 - DNA, 171 bp, Homo sapiens
gacaccactgtatcactataaaacccagaggaaacaaggaacaagtgcaagtccggggagagggaccactgtcacgcagagaggtcactgttatcaaaacgctcctggtcgtacacttcagccaccaccttgcggccagcaaaccagcggccattgagggcctggatggcc

SEQ ID NO: 1842 - DNA, 1756 bp, Homo sapiens
aaagaactgccctaaaatatgcttttccagtgcacttaatgtctttccaattacatccagatgtgaaaagctgaaggaacagttctcaggactggacaagatgacataaatcttgcagctgacagagatcccactgagctcagttggggaaactcacagagaacttgtttggggccagaaaagcggctgggtataaagacagatgtgtacactcggattcaaaaaaatatgttaagagagagaaagcgttcctctaacacagtgcctacaaatacggctgaggcatgaagcaggctgggctacccaccccccgcaactagatcaaaggaggtgattgaaaaggctttggagagagcagaccaactcagcgatgcttcctggtctccttaattgctcttctcagggtgaggaaggtgggcactcctgacagaccttgctggaggagaacaagggctgtttgtgcagctgaggacttggcttttatttttttaatgattaggttttgtacactttccagaatgttccttttaaaaatagtatattcttccttctcttctccagatgctaggaagtgcaggttcaacccaaaccgtgtctatttcaaagggacacaaaaacccagagctggagttaaaggagcttggcggcatgctgcccaaggactgaaggctttggttttcttttaccttcccaagtaattttgtttttgaaggttggaaaacaaattccacagaaggatcagcttctgcaggatacagcctggagcaaggcagagcaaggagctgggtgcagggctgagccaggaccagggcagacacggtctctcagacaggtgccgccctagacagacagctcctgatgcatccaggggctcgctttctagtatttcaggttcccaggggaggaactgagggttttcttttttctctcaagaggctccctccaattatccactgcctcttctctaactcttctctctctctctccctatcatgacacccggctctgtgacagaggacagaggggcttcgctgcacacttgctctgaggaggctcaaagggcccatttgcagcacctggtcagggccactcttgcaaacctcgcctgggcccagcccacccagtgctggagaagccctgtcctccttggctgagaccttttgcttttcctgccatgcatcccacggaaggcctgatgatggtgcatttcattgacaattttatgaccctggccatttccccctgtaacaatatctttaaaatggctccttgtcttcaggtgggtgagagcagggctgtgctcttccctctccttcctgtcactaaacgtctgtgccttaagcaataacactgaagtagtagaatgtgagttctggatcacagaactgcacacataactttgaccacttttgtttccatcctgagataaaagccaaaacgtattttttaaatttatgttttacatcttttagttgggcattgcttttctgagtgaattctaagtattgtaaagatgtcttcaaagacagacaacctcgactctaaagaaattaatgcaaattacagtgtatctcagtgacatgctaatttatagcaccgtaaaggtacagttcaaagctccaacgagccagaagaaagtcggtggattgatggtttgcagtaagaaaggtttagaaacaataaaatgtaactaggattttagtttggaaatgaactaggggtccatttgttccacgttactgagtttttaatttag

SEQ ID NO: 1843 - DNA, 25359 bp, Homo sapiens
acttcagtccatgtttatcattacctgtaatactgatggctgttattgtctacttggcacttaatctttaccatcaaattacgtgttcatatataagactgtaagacactcactgaaagggacaatgttttatttctcttagatatgtaaaaagcaagtgttaaatatatcatggtggtggtatgctactaatgatcaaccagtattctgaagaggcttttaaaaattaaagaaatggacaatcttttaggaacttcaaaatgaagagaataagttttttttctattgtaataatattttggcttatttaagcttaataaatactgcaatcagttgaacagaagcagagacttgcaatcagaaagccatggattctgcagagtagtccttgaaagagcagagaatgtcaacctagcacagaccacatgagaatgaaacaagtgtctatgtgatttgattatgaatataaccaagtagagaatgattaaatacattttagagttattgttgacaggcacaaaatctttcttaacctccataacaaaaatatctaaggcgaaattaatattgactagaaggtaaccacttgaattaatcagttaacaaatgaatgagtaaatggatatatggctggtactaaagttatagtaattccattaacctaatgttatcaattaatacactatgtccaaaatacaggtttgcctttcccaatagataacgggacatatagattcactgaggtcacccggagaaaatgatggatatcaggcaggactaacttgaggctcccactcaggacaaaacagcatgtggagactcacagtgtaaactctgctccaagaaccaccacaagaacataccaggaaaactgaaagaattcacagaccctttgaaagaagcagcttgccgctgcaaactccatgagacagccaaaacaccgtgagtgcccaaagtgtgagagggggaaagtctgcctccaaacacacatcctcactggggaacctgaaaatccagatcacagaagaatttaaccttacctaggactgaaacaaatttagagagctgagcgaaatataaaagtagaagaagcaggccaggaatggtgggtcatgcctgtaatcccaacactttgggaggccaaggtgagtggatcgcttgagcccagtttgagacaagcctggctaatatggtgaaaccctgtttctactaaaaatacaaaaaaaaaaaaaattagctgggcaaggtggtgcacacctgtaatcccagctacttgggaggctgaggcaggagaattgcttgagcccaggaggcggaggctgcagtaagccaagatcaacgccactgcactccaacctgggtgacagactgagactccacctaaaaaaaaaaacaaaacaaaaacaaaaacaaaaactagaagcagcagcgataagagacccctgtagacactcccagtccctagggaagccattttttttttttttttttttttttttactttcatctcacagtggtccttggggaaggcagtcagtggaactagggaagtaccacagtgagaaagacttctagctgaacgctgtcataattttgactgaatgcaaattttcctgggcagaatctgggtggggggtgggggaggaggtgggaatagggggccggcgggaatagggggccaatggaaagtacagatatgagaacagaagccactgcaggcatggaagggcaaggcctgaaagccctgcttgctttcttagcaggaagacttctagcctagggcaaatgctttttctgcagacactccccaataccagcctggagtccagtagctccactgggtagctagacccagaagaaaaataaccatcgctgcagttcagctctcaggaagccccattcatagggaaacggggagagaaccacatcaagggatcatcccgtgggataaaagaatctgaacagcagattcaagatcttgcctctgacacagtatatccaaatgagaagaaaccagaaaaacaattctggtaatatgacaaaacaaggttctataacaccctcaaaagatcacactagttcaccagcgatggatccaaaccaggaagaaatatctgaattaccagaaaaagaattcagtaggtcggttattaagcagctcaaggaggcactagagaaaggtgaaaggcaacttaaagaaatttttaaaataatacaagacatggatgaaaaaatttccagagaaatagaatcataaataaaaaagagtcacaacttctgaaaatgaaagacacacttagaggcatgcaaaatatactgcaaagtttcaacaatagaatcaaacaagcagaagaaagaacttcagagctcaaagacaaggcctaatcaaattaacccaatctgacacagacaaaggaaaaagaattttaaaaaatgaacaaagcctccaagaagtttgggattatgttaaatgaccaaacctaagaataagtggtgttcctgaggaagaagaaaaatctaaaagtttggaaaacttagagggaataatcaaggaaaacttcctggccttgctggagatctagacatccaaatacaagaaggtcaaggaacacccagggaattcattgcaaaaagatcatcacctaggcacacagtcaatcaggttatctaaagtcaagtcaaaggaaataatcttaagatctgtgaggcaaaagcaccaggtaacctataaagaaaaacctatccgataaatagcagatttctcagcataaaatctacaagccagatggaattgaggtcctatctttagcctccttaaataaaataattatcagtcaagaattttatgtccagtgaaactaagcttcattaatgacggaaagataaaagtctttttcaggcaaacaaatgctgagagaatttgccactatcaagtcagcactaaagaagtaataaaatgaattattaaatcttgaaacaaagcctcagaatacaccaaaacagaacctccttaaagcataaatctcacagggcctataaaacaataacacaatgagaaaaaacagacaaaaggtattggggcaacaactagcacaatggatagaatagtacctcacatcttaatactaatgttgaatgtaaatggcctaaatgctccacttaaaagatacagaatggcagaatggataagaattcaccaaccaagtatctgctgttttcaagggactcacctaacacataaggactcacataaactgaaggtaaaggggtagaaagagatatttcatgcaaacagacaccaaaagccagcaggagtagctattcttacatcagataaaacagactttaaagcaacaacagttaaaaatgacaaagagggacattacataatgataaacggactagtccaacaggaaaatatcacaatcctaaatataaatgcacctaacactggagttcccaatttataaaacaattactactagaccttaataaatgagacagagggcaaaataataatagtgagggacttcaatattccactgacagcactagacaggtcgttaagacagaaagtcaacaaaaaaacaatggacttaaactataccctacaacaaatggatttaacagatatatacagaacattctacccaacaactgcaaaatgcacattgtattcatcaacacatggaacatattccaagacagaccacataagccacaaaacaagtcacagtatatttaagaaaatcaaaattatatcaactactctctcagaccacagtggcataaaattggacatcaactgcaaaaggaacactcaaaaagcatgcaaatacatggaaattaaataacctgctcctgaatgattgttgggtcaacaatgaaatcaaaatggaaatttaagaatttgaactgaatgataatagtgacacaacttatcaaaacctctgggatacagaaaaagtggtgctaagagcaaagtttacagcactgaatgcctgcatgaaaaagtctgaaagagcacaaataagacaatctagggtcacacctcaagaactagagaaacaagaacaaaccaaacccagcagaagaaaagaaataacaaagatgagagcagaactaaatgaaattgaaacaaaagaaatacaaaagataaataaaacaaaaagttggttctttgaaaagataaacaaaattgatagaacattagcaagattaaccaaaaaaagaagacagaagatccaaataagctcaattagaaacaaacaggagatataacaactgataccagagaaatacaaaatatcattcaaggctactatgaacacctttacacacacaaactagaaaacctagaggagctggataaattcctggaaatatacaacccttctaggttaaaccaggaagaaacagaaactctgaactgaccacagcaagactgaaatggtaattttaaaactgacaacaacaataaaaaaagcccaggaccagacggattcacagctgaattctaacagactttcaaaaaaagaactggtattaatcctattggcactattccaaaagacagagaaagagggaatcctccctaaatcattcaatgaagccattatcaccctaataccaaaaacagggaagtacataacaaaaaaagaaagccacagaccaatatccctgatgaacatagatgcaaaaaatcctcaacaaaatataagctaactgaatccaacagcgtatcgaaaaggtaattcaccatgaacaagtgggtttcataccagggatgcagggatagtttaacgtccacaagtcaataaatgtgatacaccacagaaacagaattaaaaacaaaaatcacatgacatctcaacaaagaaaaagcattttacaaaatccagcatccctatatgattaaaaccctcagcaaaatcggcatagaagggacataccttaaggtaataaaagcatctataacaaacccatagccaacgttatactgaacagggaacaagttgaaagcattccccctgagaactggaacaagacaaagatgcccactttcaccacttctattcaacacagtactggaagtcctagccggagcaatcgacaagagaaagaaataaagggcatccaaatcgataaagaggaagtcaaactgttgctgtttgctgatgatatgatcgtatacctagaaaaccctaaagactcaaccaaaaagctcctagatctgataaatgaattcagtaaagtttcaagatacaaaataaacgtacacaagtcagtagctctgctatacaccaacagcgaccaagctgagaatcaaatcaagaactcaaaccctttcacaatagctgcaaaaaaatgaaatacttaggaatgtacctaatgaagaaggtggaaagaactctacgacaaaaactacaaaacactgctgaaagaaatcatagaggatacaaacaaatggaagcacatcccaaactcttggatgggcagaatcaatattgtggaaatagcatactgccaaaagctatctacaaattctatgcaattcgcatcaaaataccatcatcatttttcacactactagaaaaaacaatgctaaaattcatatggaaccaaaaaagagcccacataactaaagcaagactaagcataatgagcaaatctggaggcatcacattacctgacttcatactacattataaggctatagtctccaaaacagcacgatactgctataaaaataggcacatagaccaatggcacagaatagagaacccagaaataaagcccaatacttagagcaaactgattttcatcacagcacacaaaaaatataaagtggggaaaggacatcctattcaacaaatggtgctgggataattggcaagtcacatggagaagaatgaaactggatcctcatctctcacttgatataaaaattaactcaagatggatcaaagacttaaatcaaggcctgaaaccataaaaattctagaagataacattggaaaaactcttctagacattggcttaggcaaaggcttcatgaccaagaacccaaaagcaaatgcaacaaaaacaaagataaacagatgggacttaattaaactaaaaagcttctgcacagttaaataaataatcagcaaagtaaacacacaacccatagagtaggagaaaatcttcacaaactatgtatctgacaaaggactaatatccagaatctacaaggaactcaaatcagcaagaaaaaaataatgccatcaaaaagtcagctaaggacacgaatagataattctcaaaagaaaatatacaaatggccaacaaacatgaaaaaatgttcaacatcatgaattatcagagtaatgcaaatcaaaaccacaatgcaataccaactgatatggtttggctgtgtccccacccaaatctcatcttgaattgtaatccccataatctccatgtgtcaagggagagacaaagtggaggtaatttgaatcatgggggcggtttcccccttgctgttcccatgatagtgactgagttctcacaagatctgatagttttgtaagggtttggcaagttcctccttcagtctttttctctcttgccaccttatgaagaagatgcctgcctcccattcacctttaaccatgactgtaagtttcctgaggcctctcaagccatatagaactgtgagtcaattaaacttcctcctttccttcataaattacccagaatcaggaagttctttatagcagtgtgagaacagactaacacaccaccttactcctgcaagaatggccataatttaaaaataaaaaaataaaggatgttggcgtggatgtggtgaaaagaaacactttttttttcttttttttttttttgagatggagcctcgctctgtcaccaggctggagtgcagtggtgcgatctcagctcactgcaacctccgcctcccgggttcacaccattctcctgcctcagcctcccaagtagctgggactacaggggcccgccactgcccggctaattatttttgtatttttagtagagacagggtttcaccgtgttagccaggatggtctcgatctcctaacctcgtgatctgcccacctcagtctcccaaagtgctgggattacaggcatgagccactgcgcccagccaaaaagaaacacttttacaccactggtgggaatgtcaactagtaaaaccactatggaaaacagtatggagattccttaaagaactaaaagtagaactaccatttgatccagcaatcccactactgggtatctacccagaggaaaataagtcattatatgaaagagacacttgtatacacatgtttatagcagcacaattcacaattgcgaaaacataaaaccagcccaaatgcccaccaatcaacgaacggataaagaaaatgtggtgtacatatataccatagaatactactcagccataaaaaggaatgaaataatggcatttacagctaactggatggagttggagaccattattctaagtaaagtcacacaggaatggaaaaccaaatgtagtatgttctcataaatgggaggtaagctacaaggacacaaaggcattgagaatgatacaatgggccgggcccggtggctcacgcctgtaatcccaacactttgggaggccaaagcagatggatcacgaagtcaggagatggagaccatcctggctaacatggtgaaaccctgtctctactaaaaatacaaaaaaattaggccaggcacagtggctcacacctgtaatcccagcactttgggaggccggggtgggcagatcatgaggtcaggagatcgagaccatcctggctaacacagtgaaaccccgtctctactaaaaatacaaaaaattagtcaggcgtggtggcacatgcctgtagtcccagctacttgggaggctgagggagaagaattgcttgaacccgggaggcagaggttacagtgagccgagattgcaccactgcactccagcctggtgacagagcgagactccccctcaaaaaaaaaaaaaaacaatggattttggggatctgggagaaggttgggaggggaatgaggggtaaagactacacattgggtacagcatacactgcatgggtgatgggtgcaacaaaatctcagaaatcatcacggaagaatttatcaatgtaaccgaataccacctgttccccaaaaactattgaaataaaaaaaaaaagataatgacatataatgttgttcgtattgtatgcaattagaacaactctttaaaattattcttaggagcttaaaattagaacagtaatttacttagcagtattttacatgcaggtggtttgcggaatttgtgatggggtttctttcttttttttttttcttttgagacagagtcttgctctgtcgcccaggctggagtgtagtggcgtgatctcggctcactgaaacctccgcctgccaggttcaagcaattctcctgcctcaacctcctaagtagtggggactacaggcacgcgccaccatgcccagccaatttttgtatttttagtagagacggggtttcaccatgctggccaggctatatataaatatatagttttatatattatataaatttatataaattatatttatataattatgtataattatataatatatacaatatattataaattttttaatttaaatataaacttaaatataaattaatttaaatataaattaatttatatttctattaatttacatttataaaaatttatatttatatttataaatataatttatatttatatttataaatataatttatatttataatttatataatataaatataatttataatttatatttataaaaataatatatttatatttaaattaatttaaatataaatatatatttataatatataaatatataatatataaaataaaatatatataattatataatatataaaatatagttttttatatatataactatatatttaaactatatatttaaaaagagaaattaatcattttttgtaattttttttttgcaggggtagaaacaaggtcttgctatattgcccaggctgctctcaaattcttgggttcaagcaatcctcttacccaggcctcccaaagtgctaggattacaggtgggagccactgcaccaagccactatcatttttgtttgtttgttttttgagacagagtctcgctctgtcgcccaggctggagtgcagtggcacgatcttggctcactgcaacctctgcctcccgggttcacgccattctcctgcctcggcctcctgagtagctgggactacaggcacccgccaccatgtccagctaatttttttgtatttttttagtagagacagggtttcactgtgttagccaggatggtctcaatctcctgacctcgtgatccacctgcctcggcctcccaaagtgctgggatgacaggcgtgagccaccgcgcccggcctactatctttactttaaaaaaaaaaaactcagtcaaattttctgtgctttgtattcaaatatgtttttgccaacattaaaaaagtaaacaatgcacttttatagtatccactaaagcaaattttaaaaacaattacaattactttcttcatcctctcaccttcattttttttttttttttgagatggagtttcgctcttgttgcccaggctggagtgcaatggcgcgatcttggctcactgcaacctccatctcccagattcaagcaattctcccgcctcagcctcctgggtagctgggattataggcacctggctaattttttatatttttagtagagacagggtttcaccatgttggccaggatggtctcgaactaattacctaacatgatccacccgcctcggcctcccaaagtgctgggattacaggcgtgagccaacgcaccaagcctccttcagttatttttatgctaccgtgtgtgtgtgtgtgtgtgtgtgtgtgtgtgtgtgtgtgtgtaggtatgggcatatgtgtactattaatacttgctcactctgttactagcctactataaatgaaacatacaacaagcagaacacacatagcagacaacataacagaaggagtcactgccatacctgggttattgttaacattacttttgggtggcttctgaactggtttgggaagcgtagattcagtcaaagctttattggcaacagcctgctgagccttctttatactgctgccttcggattcccatgtctgctcaccaagactcagctgcactgagaacatcttagaaaaacataaatagacaaagaaaacattaagacttttccaagaaataaaattggctgtctgagagaaaaataaacatcatagaatcagaattttagagctagaggtgaccttacctacagatcatctgcaacaaaatcttactctacctagtgaagaaattttaagagagtaccaaattctgttctatcctatccaaaagcttagtagcagatctaggtgtacattctgggtagaataaatcaagaagcaatctttcctctaaatggaatcacaatgttaatgtcattcaaatggtcctcacaaaagcagaataagtagaaataataagagaaactgtaagagaagccaaaagaccatgtgtctataatactttcataaaatctaattccttgaatgttacatttagcacaatctaggcaatgagtcaggcaattctattaaatattatactaccaaaaaactctgaatctccacaacaaacattgagccaatcactaaattctgtccattttaacatcataaatatttctcaaatcttcttcctctctctgccaactggatccagcctttcatcatctttagcttggacataatattcttccagctgatcactgctaaaactatctttctaaaacacaaatccaacttcatcaccccaatcaacatcaggttaaaacccttcaactgttcctgttttagcatggcacaaaggctctacctgtgcatcctcatctcacacacatccttccactaacatgctctgaattccattctcactgtatttccatatgagcccccaaacctattcttcacctttaaaattcagaatcaagttacatgatatgcgcataattggtttcactccagactgcatattactttctaggaatactaagtattaacttaaaattacttattacaaaaaaatatatattattgtagaaaggagatcagatagaaaataccttcactaagttagcatcaccaataatcatacaaattgacgtcatgtgccccctgatacaatccagtgagaagtatatatcaacaaccatgtacaattcttggccaaaaatgtttaatctgaatctaatcacagggaaacaaccagagagatctagattatgggacattctataaaacaaatggcctaggctccaaaaatgtcaatgtcataaaaggaaaaaaaaaacaaagaatgcagggaggacactaaagagacatgaaggccgtgcacagtggctcacgcctgtaatcccagcactttgggaggctgagatgggcggatcacaaggtcaggagattgagaccatcctggctaacacagtgaatccccatccctactaaaaatacaaaaaatttagccagacgtggtggcgggtgcctgtagtcccagctactcgggaggctgaggcaggagaatggcatgaacccaggaagcggagcttgcagtgagccgagattgcgccactgcactccagcctgggtgacagagcgagactctgtctcaaaaaaaaaaaaaaaaaaggaaaagaaaagagacatgaaaagacatgataaataccatgcatgatccttcattatatctaaaatgggaaggggaaaaaagctgtaaaggacattcagaggacaactggggaaatgtgactatgaactatacattaagtaataggtttagccaggattaaatttcttgtgtgattaacagtattgtgattatgaagaacgtctttagtcttacaagatagatatgtaagtatttaagagtgaagtgtcatggtagctgaaatttactttcaaattgttcaaggaaaaattatatgtcaatatagagggagcaagaaataaagtaatgtggcaaataaattaacgatcggtgaatctaaaccatacatgagtgtctattacaccactctttccattttttctgtagatttttaattaatcaaaatagagaattgggatttgtcatttgaaattcacaacataaacatacctgtttaaagtgattaaattttcttttattctaattcagtttaaaatatatacctaaaatgtatctttaatactctctctggtttcagaatgatttttcaatgactagctctttttcttcaaattttggtatttaacaaagaactttgccacaaagtaagaaagttcaaaggtttcacatgatatatataatatacataatcttgcatatagctcatatgcttgaaaacagaaatacccacataaatgaccttgagattcctgattgcatcaggaaagcatattaaatttactctgcatgtctccagacctgacctctcctaaacaacaatcacataaatctaactgtctacttggtatttccacaaactcaagaggtaaaaggtcaaacaaaacactgcctcctccactctaccccctccaaatcagttcataccccaaaatgtttaatccattatctcccaatagttcaggttcaaacctcattagtttcgtttatccttgccttcctaaggcttatttaacatctcataactcttcgttgtaatttatattgtcacctccttggtctaaggtttctataaactcagactcagtatacttcatttagctcctatctctaatctttcctgcctcctaatcatccagatgtcaccattttcccaatctcatgagccagacacctttgagaggtcttcccttctctcctgcttgcaattaacaactactgactcaacttaaatgtttttcagacctggcctcctctctttatactaagatatatacatgcaccaatgtctttatactaagatatatacatgcaccaatgatatgtggacaatatcagtatctctcccctaaactaccacaacaccacctgtggtatataagaaatatgtatttggtctccggccctggttcctaacacagagctcccaaaaccttgtaatttccggaaggacaggagaactaggagcatttttgttctaatatttggtctttgatcccaatttctaacacagagctcttaaattccttggaatttcctgggtgataggaaatttttattctaatgagccaactcttggcaggcccctggatagagagctagtctgagggccagtcaccagaaaaactaagccatggttagaaacttcatttttagccccatcccattcctatccaccacggaggaaagaggggctggagactgagttaataatcgatcatgcctatgtgacagagcctccataaatatccctaaaagatagggtacaaaaagcttgcaggctggtgaacacactgaggtgctgcagggtggcacacccagacagggcttggaagctccatttcccttctcacacacttcatcctacgtacttcttttttttttttttccccggagatggagtcttgctctgtcgccaaggttggagtgcatggcacaatctcgtctcattgcaacctccgcctcccaagttcaagtgattctcctacctcagccccccaagtagctggcatcacaggcacaagccaccatgccgggctaatttttgtatttttagtagagacggggtttcactatgttggccaggctggtctcgaactcttgacctcgtgatccacccacctcagcctcccaaagtgctgggattacaggcgtgagccaccacgccggccctcctatgtactctttatctggctgttcacctatatactttagaatatcctttataataaactagtaaatataagtatgtgttcccctgagtcttgtgagctgttttaacaaattatggaacctgagaagagggtgctgagagcccccggtttatagccagttggtcacaagtttagaagacccagatttgtgactgtcatgtgaggtgagagcagtgttgtgggactgagcccttaacctgcagggtctgcactaaccgtgggcagttagtgtcagaatttagttaaatagtaggacatccagtcaatgtatggggacaattgcagaattcgctggcgtggaaaaaaaccccacatatttagtgtcagaaatgaagtgttacagccaggtgtggtggcttatgcctggaatcccagcactttgggaggccaaggtgggaggatcacttgagctcagaagttcgagaccagcctgggcaacacagggagacctcagcactaccacaaatgtaaaaaattatccaggcatggtggtgcgcacctatagtcccagctactgaggaagctgaagcagggggatcccttgagcccaggagatgaacgctgcagtgagctatgactgcacaactgcactccagcctaggcaacacagcaagaccctatctcggaaacaaattttttaatttaaaaaaaagtgggctgggtgcggtggctcacgcctgtaatcccagcactttgggaggccgaggcgggcggatcacgaggtcaggagatcgagaccatcttggctaacacggtgaaaccccatctctactaaaaatacaaaaaaaattagccgggcgtggtagcaggtgcctgtagtcccagctactcgggaggctgaggcaggagaatggcgtgaacccgggaggtggagcttgcagtgagccaagacagcgccactgcagtccagcctgggcgaaagagtgagactccgtctcaaaaaaaaaaaaaaaaaagtgttggaagtatagaaaaaaatttctttttactatcttaaagcagttcccttaatatgaccttcccattcaaactaccattcttaccaccatcgacatgaacattctgtaaaaccatcaacatgaacattctgtaaaatataagtatttccaaggcaatcctatgcttttctacaatctctcttaagattcctactacagtaaaaagtgtagtagttttaagacggaatgctggagacacactgtttatgaatttaagccttggcttcgccatttactatgtacaacactgggaagttaattattctttctaactctcagcttcttacctctttagtgaaatgaggctaataagaacacatggttagttgtgaaaattagaacaaaatggtgtaaacacccccacttgaaagtcagagattgtcaaactagataaaaatgcaaaatcaaactacatgctacctacaaaaactgtacttcaaatataaaagcacatatagttttaaagtaatgagaaaaacatatactgacataaatcaaggagaaattagaatggctatattaatatcagactaagtggattccagagtaaagactattaccagtggtaacgaaggtcatttcatatgaataaagaaagcaattaagaagacattgatatcctaaacatttaggcacctaataacacagcttaaataaatgaagcaaaaactgacaaaacttaaactataaaattgacaattaaagtcagattcaatactccttatcaaaaactgatataacaagcaaaaaaaatcaccaagaatatagtacagttgaacaacactatcagccaacacaatcttatcaacactgttagaatactccaaccaagaaaagcagaatatacacttgctctcaattgttcacaggacatttaccaagacagaccatattctgggccataaaataagtctcaataaatacaaagaattcagaccacacacaaagtatgttcattgggtaaagttacagaagagggtagagtaaaattacagaggagggtagagcaagatggtggaacaaaagcctatatatcattcatcacccccagtggaacaccaaattttaacaactatggacacaaaaaagcaccgttacaagaaacaaaaatcaggtgaacaatcacagtgtctggctttaacttcatattgccaaaagaggcattgaggagggtaggagagtcttgaatcaccaacatcaaccctctcccacactcccagcagcagccatgtggcgtggagagaaaatctgtacactttgagggaggagagcacggctattggaaaacagtacattaaactcagtgctgccctgtcacagcagacaatgaaaatgtgctggactcagccagcacctgcacagggagggaggatttggaccagcactagctggaggggaattgcccatcatagcagttggaacttgaatttcttggcaagacttgccaccacaggctgaagtgctccggggtcctagataaatctgaaaggcagtctaggacacgagactgtgcttcctaggcaactcctagtgtgaggctgggcttagagccagtgaactaggatggcacgcaacctagggagacaccagctggaatggctaagggagtgcttatgccatccctcccctaaccccaggaagtgcaacttgtagcaacgaaagtatctacttccttctgcttaaggagaggagagtgaagaaaaaagagaactttgtcttgcattttggatatcagctaagccaccataggataaggcaccaggcagagccgtgaggcccccattccaggccctagctccaagataacatttgtagacacaccctgggccagaaaggaacccactgccttgaaggtaaggactcaatcctggcaggattcattacctgctgaccaaagaaccaatgggtcctgaataatcaccactgatacccaaggagtatgcagtgggccctgggctctgacatgtactggcttcaggggtgacccagcacattcccagctgtggtggctattgtgaaagactcctgtttaagaaaagcagacagaaaagtaaagggaacattgtcttgtgccctaggtaccagctcagccacagcaggaagagcaaaaagcaggctcttggggtccctgagtccacacctacgctggacagcatttccggatctacttcagggagcccactgccctgaagaatgagcccatggaccagtggtggtgttggtggccacacaaggagaggttcctctgcctgtggaaaggggagggaagagtgggagggattttgtattatggattgagtgccagcttagccacaatagaagaaaacatcaggtaaattgctaaggtttttgactccaatccctggctctcagacagcacctctggacacacctggaacccagggaaaaacccgccaccctgaagggaagggccttgggcaaggccagtgctgtgctggcttcaggtctgacccagagcaatcccagggatgatgaccacagaggtgcctgcatcaccacacccccaattccaagtggcttagcactccatttgtttgggagaaagtaaagaaaaagaacaacaatctctgcctggtaatcctgagaattcttccggatcttatccaaggctgccaaggctgtacctctaacaagtctccaaaagccacagcattgttgggcttggggcccaagtcccttcaaattcctgggaaagccttcccaaggacaggcataaacaaactcagactctgaagactacaataaatacctaactgtttaaagcccagacaccaacaagtatctacaaccatcgacaccattcaggaaaacatgacctaaccaaatgaactaatataaagcacaagggatcaatcctggaaaaacagagatacatgacctttcaggcagagaattcaaaatagctgttttgaggaaactcaaagaaattcaagacaacacagaaagggaatttggaattcttatcagataaatttaaccaagagatcaaaattaaaaagaatcaagctgatattccagagtttaaaaatgcaactgacatgatgaggactacatcaaagtctcttaacaacagaaatgattaagaagaattagtgagcttgaagacaggctatttgaaattacacagttagaaaagacaaaagaaaaaaattaaaaagcaatgaggcacaccaaaaacatctagaaaatagcctcaaaggggcaaatgtaagacttactggccttaaagaaaaggtagaaaaagagataacagtagaaagtttattcaaagggataataacagagaatttcccaaacgagaaagataacattcaaatacaagaaggttatagaacaccaagcagatttaacccaatgatgactacctcaaagcatttaagaatctaattccctaaggtcaaatataaagaaaggatcctaaaaacagccagaaaaaaagaaataaataacatacaatagagctccaatacaactggcagcagacttttgttgttttgttttgttttgttttgttttgaaacagagtctcactctgtcacccaggctggaatgcagtgatgcgatcttgcctcactgcaacctccacctcccaggttcaggcaattatcctgcctcagcctcctgagtagctgagattacaggcgtgcaccaccatacccagctaattggcagcagacttttcagtggaaactttaaaggtgaggagagtgtggcaagacatattttaagtgctgaaggaaaaaaactttcacctagaatagtatatctggtgaaaatatcctttaattatgaaggagagataaagtctttcccagacaaacaaaagccgaaggatttcatcaacaccagacttgttctacaagaaatcctgaagggagttcttcaatctgaaagaaaaggatattaatgaaagaagaaatcatctgaaggtacaaaatgcactggtaacggtaagcatacagaaaaatacagaagagtataacactgtacctgtggtgtataaactactcttaactgaagtagaaagactaaataatgaaccaatcaaaaataatagctacaacaacttttcaagaaatagtgtaataagacataaagagaaacaacaaaaagttaaaaagctggcagcggggacaaagttaaagtgtagagttttaattaactttctttttgcaagtttgtttctgcaattgtgttaagctgtcatcagtttaaaataatgcgttataagtattagtatttgcaccggcgcagtggctcacacttgtaatcccagtactttgggaggccaaggcaggtagactgcttgaggtcagaagtttgagaccagccttgccatcacggtgaaaccccatctctactaaaaatacaaaaattagccaggtgtggtggtgcacacatgtaatcccagctacttgggaggctgaggcatgagaatcgcttgaacctgggaggcagagattgcagtgagccaagatcacgccactgtactccagcctgagagacagagcaatactctgtctcaaaaaaaagaaaattaatttaaaaaagatagtatttgcaagcctcatagtaacctcaaatcaaaaaacatacaacagatacacaaaaaaataaaatgcaagaaattaaagcataccaccacagaaaatcactttcactaaaaggaagacaggaagaaaggaaagaaggaagaaaagactgaaaaccaccagaaaacaaataacaaaatggcaggagaaagttcctatttagcaataataacactgaatgtaaatgaactaaattccccagtcaaaagacatagagtggctgaatggagaaacaaacaagatccaatgatctaaacacaccccacctatgaagacacacacagacagaaaagagagggatggagaaacatattccatggcaacggaaaccaaaaaagagcagacacagctatactcatatcagaaaaagtagtatagatttcaagacaaaaactgtaaggagagacaaaaaaggtcattatataatgataaaggggtcaattcagcaagaggatataataattgtaaatatatatgcaaccaacactggagcactcagatacataaagcaaatattattagacctaaagagaaagacagaccccaatacaataacagctggagacttcaacaccccgctttcagcattgcacagatctcccagaaagaaaatcaacaaagaaacatcagagttattctgcactatagacaaaatggatctagtagatatttacacatttcatccaatggctgcagaatacacatttttctcctcgacacatggatcattctcaaggataaaccatgttaggtcacaaaacgagtcttaaaacattaaaaaaaaaaaaagagagagagagagaaaaagaaaaaagaaagaaaacctaaaataatatcaagcatcttcactgaccacaatggaataaaactacaaatcaataacaagaggaattttggaaactacacaaacacatgagaattaaacaatatgctcctgaatgaccatttcaatgaagaaattaagaagggaattgaaaaattccttgaaacgaatggtaaaccaaagcctatgggatacagcaaaagcagtactcagagggaggcttatagctacacacacctacatcaaaaaagtggaaaaatttcaaacaaacaatctaacaatgcaccttaaagaactagaaaaataagagcaaactaaactcaaaattagtagaagaaaagaaataataaagatcagagcagaaataaatgaatttgaaatgaaaaaattatacgagatcactagaacaaaaagttggtgtttgagaagataaacaaaattgacaaacgatttagccagactaagaaaaaaagaaagaaggcccaagtaaataaaaccagagatgaaaaaggagacattacaatggatacaacagaaattcaaaggatcgttagtgactaccgtgagcaactatatgccaaaaaattgaaaaatcttgaagaaacagacaaattcctagacacatacaccctacaaagattgaacccggaagaaatccaaaacctgagcagaccaataacaagtgaggagatcaaagcagtaatgaaaagcttcccagtaaagaaaaggccaggacccaacagctttactgctgaattctaccaaatatttaaagtggaactaataccaatcctactcaaactattctgaaaaatagaggaggacggaatgcttccaaactcattctgtgaggccagtattaccctgataccaaaaaccaaacacacatcaaaaaaaaaaaaaaaaaaacctacagaccaatacctctgatgaatattgatgcaaaaaccctcaacaaaatactagcaaacctaatccaacaatacatttaaaagatcattcatcatgaccaagtgggatttatcacagtgatgcaaggatggctcaacacacacaaaccaatcaatgtgatacatcacatcaacaaaatgaaggacaaaaaccatacatttcaattggtgccaaaaaagcatctgataaagttcaacatcactttgtgataaaaaccctcaaataactgggcataaaaggaacatgcctgaacataataaaagccatatatgacagatccacaactagtatcataatgaatggggaaaaactgaaagcctttcctcttaggtctgtaacacaacaaagatgcccactttcaccactgttattcaacataatactgaaagtactagctagagcaatcaggcaagagaaagaaagaaagggcatccaaattggaaaagaagaagtcaaattatcattgtttgcagatgatatgatcttatatttaaaaaaacctaaagactccaacaaaaaactattagaacagataaacaaatttagtaaagttgcaggatacaaaataaatatactaaatcagtagcatttctatatgccaacagtaaacaatctgaaaaagaaatcaaaaaagtaatcccatttataatagccttaaataaaatttaatacctaggaattaactcaaccaaggaagtgaacgatctctacaatgaaaactataaaacactgatgaaagaaactgaagaggacatgaaaaaataaattggaagaatcaaagcaacctacagactcaacgcattccctatcaaaatatcaatgacattcttcagagaaataggaaaaacaattctaaaatttatatggaatcacaaaagaaccagaatagccaaagctatcctgagcaaaaagaacataactggagggaccacattatctgacttcaaattatactacagagctatagaaaccaaaacaacagggtactacataaaaataaacacacagaccaatggaacagaagagagaatccagaaacaaatccacacacctacgatgaactcatttttgacaatagtgtcaagaacatacactggggaaaagacagtctcttcaataaatggtactgggaaagctagatatccatatgcagaaaaatgaaactagacccctatctcttgccatacacaaaaaaaatcaaatcaaaatggattaaaggcttaaatctaagacctcaaactatgaaactattacaagacgacattaaggaaaattttcaggatgctggagtgggcaaacatttcttgagtaataccccacaggcagaggcaaccaaagcaacaatggacaaatgggatcacatcaagttaaaaaccttctgcacagcaaaggaaacagtcaacaaagtgaagaaacaacccacagaatgggagagaaatatgtgcaaactatccatctgacaaggtattaataatcaaaatatataagaagctcaaataactctataggaaaaaaatctaataatccaatttaaacaacaaacaggtatatgaaaaggtgctcaacatcactgatcatcagagaaatgcaaatcaaaactacactgagatatcatcttgctcaagttaaaatggcttttatccaaaagtcaggcaataataaatgctggcaaggttgtggagaaaagggtaccctcatacgttgttagcaagaatgtaaattagtacaaccactatggagaacagtttggaggttcctcaaaaaactaaaaatagaactaccatgcaatccagcaatcccgctgctgggtatattcccaaaagaaaagaaatcagtatgttgaaaagatatctacactcccatgttttttaggagtgcttacaatagctaagatttcgaatcaacctaagtgtccatcaatagatgaatggataaagagtggtatttatacacaatggagtactattcagccataaaaaagaatgagatcctgtcatttgcaataacatggatagaactggacgtcactatgttaagtgaaataagccaggtacagagagacaaacatcacatgttgtcacttatttgtgaggtctaaaaatcaaaacaattgaattcacagagatagagaatagaaggatggttactagagattgggaaaggtagcaggaaggttgaggggatgggaagatggttaatgggtaccaaaaaaaaattagttagaaagaatggataagacctagtatttgacagcacatagggggactacagtcaataataatttaattttacactttaaaataactaaaagagtataagtagattgttcgtaacacaaaggataaatgcttgaggctttggatacccaatttccattatgtgattattatgcattgcgtgtctaatctatgtgaaaaaaagattagtagctgcctggggtctcaggtacaaagagagatgattacaacaaggaatgagaaaattttgtgggacaatggaaatgtttgttctttttcttcacatagatattttggtacatgcaacataccaaatacgttgtatgcattgggtataccaaaatatctcatgtacttcataaatatatatacctcataaatatatatacctactatgtacccacaaaaattaaaaataattttttaattaaaaaagagacaaagaatattattattgataaaagggttaattcatcaagaagataaaacaattataaacatatgcaccaaacaacagaataaagaacttctcaaaactgaacaataaaacaaacccaataaaaaataatgggcaaagatctgaacagacacttcactaaaggtatacactgatgacaaacacacaaaaagatagccagcattatcagtcactacggaagtgcaaactgaaaccacaatgagattccaccacatacctattagaatggctaaaattagaaaggctgactatataacctgtaggcaagggggcagaaaaactagaactctcatacaccgctgaggggaatgtaaaatggtacaactatattttgcaaaaaaatttggcaatgtcttaaaaagttaaacatgcacctgctatacattcctgacactcttattaccaaagaaatagagaaaataaaatagagaaagagaaaaggtaatatatgtctgatatggtttggatccgtgtccccacccaaatttcatgttggattgtaatccccaatgttggaggtggggtctggggactggatcatgggggtggatttctcatgaatggtttagcgccatcccttggtactgtcctcacaatagtgagttatcatgagatctggtcatataaaagtgtgtgggacccccccaatccccacattgctcctgcttttaccatatgacatgccttttacttccaccatgattggaagcatcctgaggcccccccaaaagcagatgctgctatgcttcctgtagagcctgcagaaccatgagctaactaaacctcttttcttataaattagccagtctcaactatttatagcaatacaagaatggactaatacaatgtctatatgaagacttgtatatagatgttcaaattagctttattataatagcaaaaagctaaaaacaaccaaaatatccatcaacagatgaatgtccaaaaaacaaagtgtgctatatacacataatggactactcctcaataataaaaaggaagaaatactgacacacacaaaacatgagcaaactcaaaataactatgctaagtgaaaatagtctggtaggagtacataccactatatgattacatttatatagttttagaaactgcaaactcatctatagtcacagaaagcagattagtagctgtgtggggtcccaggtacaaagagagatgattacgacaaggaacgaaaaaatgttgtaggacactggaaatgttt

SEQ ID NO: 1844 - DNA, 7597 bp, Homo sapiens
ccattaacctaatgttatcaattaatacactatgtccaaaatacaggtttgcctttcccaatagataacgggacatatagattcactgaggtcacccggagaaaatgatggatatcaggcaggactaacttgaggctcccactcaggacaaaacagcatgtggagactcacagtgtaaactctgctccaagaaccaccacaagaacataccaggaaaactgaaagaattcacagaccctttgaaagaagcagcttgccgctgcaaactccatgagacagccaaaacaccgtgagtgcccaaagtgtgagagggggaaagtctgcctccaaacacacatcctcactggggaacctgaaaatccagatcacagaagaatttaaccttacctaggactgaaacaaatttagagagctgagcgaaatataaaagtagaagaagcaggccaggaatggtgggtcatgcctgtaatcccaacactttgggaggccaaggtgagtggatcgcttgagcccagtttgagacaagcctggctaatatggtgaaaccctgtttctactaaaaatacaaaaaaaaaaaaaattagctgggcaaggtggtgcacacctgtaatcccagctacttgggaggctgaggcaggagaattgcttgagcccaggaggcggaggctgcagtaagccaagatcaacgccactgcactccaacctgggtgacagactgagactccacctaaaaaaaaaaacaaaacaaaaacaaaaacaaaaactagaagcagcagcgataagagacccctgtagacactcccagtccctagggaagccattttttttttttttttttttttttttactttcatctcacagtggtccttggggaaggcagtcagtggaactagggaagtaccacagtgagaaagacttctagctgaacgctgtcataattttgactgaatgcaaattttcctgggcagaatctgggtggggggtgggggaggaggtgggaatagggggccggcgggaatagggggccaatggaaagtacagatatgagaacagaagccactgcaggcatggaagggcaaggcctgaaagccctgcttgctttcttagcaggaagacttctagcctagggcaaatgctttttctgcagacactccccaataccagcctggagtccagtagctccactgggtagctagacccagaagaaaaataaccatcgctgcagttcagctctcaggaagccccattcatagggaaacggggagagaaccacatcaagggatcatcccgtgggataaaagaatctgaacagcagattcaagatcttgcctctgacacagtatatccaaatgagaagaaaccagaaaaacaattctggtaatatgacaaaacaaggttctataacaccctcaaaagatcacactagttcaccagcgatggatccaaaccaggaagaaatatctgaattaccagaaaaagaattcagtaggtcggttattaagcagctcaaggaggcactagagaaaggtgaaaggcaacttaaagaaatttttaaaataatacaagacatggatgaaaaaatttccagagaaatagaatcataaataaaaaagagtcacaacttctgaaaatgaaagacacacttagaggcatgcaaaatatactgcaaagtttcaacaatagaatcaaacaagcagaagaaagaacttcagagctcaaagacaaggcctaatcaaattaacccaatctgacacagacaaaggaaaaagaattttaaaaaatgaacaaagcctccaagaagtttgggattatgttaaatgaccaaacctaagaataagtggtgttcctgaggaagaagaaaaatctaaaagtttggaaaacttagagggaataatcaaggaaaacttcctggccttgctggagatctagacatccaaatacaagaaggtcaaggaacacccagggaattcattgcaaaaagatcatcacctaggcacacagtcaatcaggttatctaaagtcaagtcaaaggaaataatcttaagatctgtgaggcaaaagcaccaggtaacctataaagaaaaacctatccgataaatagcagatttctcagcataaaatctacaagccagatggaattgaggtcctatctttagcctccttaaataaaataattatcagtcaagaattttatgtccagtgaaactaagcttcattaatgacggaaagataaaagtctttttcaggcaaacaaatgctgagagaatttgccactatcaagtcagcactaaagaagtaataaaatgaattattaaatcttgaaacaaagcctcagaatacaccaaaacagaacctccttaaagcataaatctcacagggcctataaaacaataacacaatgagaaaaaacagacaaaaggtattggggcaacaactagcacaatggatagaatagtacctcacatcttaatactaatgttgaatgtaaatggcctaaatgctccacttaaaagatacagaatggcagaatggataagaattcaccaaccaagtatctgctgttttcaagggactcacctaacacataaggactcacataaactgaaggtaaaggggtagaaagagatatttcatgcaaacagacaccaaaagccagcaggagtagctattcttacatcagataaaacagactttaaagcaacaacagttaaaaatgacaaagagggacattacataatgataaacggactagtccaacaggaaaatatcacaatcctaaatataaatgcacctaacactggagttcccaatttataaaacaattactactagaccttaataaatgagacagagggcaaaataataatagtgagggacttcaatattccactgacagcactagacaggtcgttaagacagaaagtcaacaaaaaaacaatggacttaaactataccctacaacaaatggatttaacagatatatacagaacattctacccaacaactgcaaaatgcacattgtattcatcaacacatggaacatattccaagacagaccacataagccacaaaacaagtcacagtatatttaagaaaatcaaaattatatcaactactctctcagaccacagtggcataaaattggacatcaactgcaaaaggaacactcaaaaagcatgcaaatacatggaaattaaataacctgctcctgaatgattgttgggtcaacaatgaaatcaaaatggaaatttaagaatttgaactgaatgataatagtgacacaacttatcaaaacctctgggatacagaaaaagtggtgctaagagcaaagtttacagcactgaatgcctgcatgaaaaagtctgaaagagcacaaataagacaatctagggtcacacctcaagaactagagaaacaagaacaaaccaaacccagcagaagaaaagaaataacaaagatgagagcagaactaaatgaaattgaaacaaaagaaatacaaaagataaataaaacaaaaagttggttctttgaaaagataaacaaaattgatagaacattagcaagattaaccaaaaaaagaagacagaagatccaaataagctcaattagaaacaaacaggagatataacaactgataccagagaaatacaaaatatcattcaaggctactatgaacacctttacacacacaaactagaaaacctagaggagctggataaattcctggaaatatacaacccttctaggttaaaccaggaagaaacagaaactctgaactgaccacagcaagactgaaatggtaattttaaaactgacaacaacaataaaaaaagcccaggaccagacggattcacagctgaattctaacagactttcaaaaaaagaactggtattaatcctattggcactattccaaaagacagagaaagagggaatcctccctaaatcattcaatgaagccattatcaccctaataccaaaaacagggaagtacataacaaaaaaagaaagccacagaccaatatccctgatgaacatagatgcaaaaaatcctcaacaaaatataagctaactgaatccaacagcgtatcgaaaaggtaattcaccatgaacaagtgggtttcataccagggatgcagggatagtttaacgtccacaagtcaataaatgtgatacaccacagaaacagaattaaaaacaaaaatcacatgacatctcaacaaagaaaaagcattttacaaaatccagcatccctatatgattaaaaccctcagcaaaatcggcatagaagggacataccttaaggtaataaaagcatctataacaaacccatagccaacgttatactgaacagggaacaagttgaaagcattccccctgagaactggaacaagacaaagatgcccactttcaccacttctattcaacacagtactggaagtcctagccggagcaatcgacaagagaaagaaataaagggcatccaaatcgataaagaggaagtcaaactgttgctgtttgctgatgatatgatcgtatacctagaaaaccctaaagactcaaccaaaaagctcctagatctgataaatgaattcagtaaagtttcaagatacaaaataaacgtacacaagtcagtagctctgctatacaccaacagcgaccaagctgagaatcaaatcaagaactcaaaccctttcacaatagctgcaaaaaaatgaaatacttaggaatgtacctaatgaagaaggtggaaagaactctacgacaaaaactacaaaacactgctgaaagaaatcatagaggatacaaacaaatggaagcacatcccaaactcttggatgggcagaatcaatattgtggaaatagcatactgccaaaagctatctacaaattctatgcaattcgcatcaaaataccatcatcatttttcacactactagaaaaaacaatgctaaaattcatatggaaccaaaaaagagcccacataactaaagcaagactaagcataatgagcaaatctggaggcatcacattacctgacttcatactacattataaggctatagtctccaaaacagcacgatactgctataaaaataggcacatagaccaatggcacagaatagagaacccagaaataaagcccaatacttagagcaaactgattttcatcacagcacacaaaaaatataaagtggggaaaggacatcctattcaacaaatggtgctgggataattggcaagtcacatggagaagaatgaaactggatcctcatctctcacttgatataaaaattaactcaagatggatcaaagacttaaatcaaggcctgaaaccataaaaattctagaagataacattggaaaaactcttctagacattggcttaggcaaaggcttcatgaccaagaacccaaaagcaaatgcaacaaaaacaaagataaacagatgggacttaattaaactaaaaagcttctgcacagttaaataaataatcagcaaagtaaacacacaacccatagagtaggagaaaatcttcacaaactatgtatctgacaaaggactaatatccagaatctacaaggaactcaaatcagcaagaaaaaaataatgccatcaaaaagtcagctaaggacacgaatagataattctcaaaagaaaatatacaaatggccaacaaacatgaaaaaatgttcaacatcatgaattatcagagtaatgcaaatcaaaaccacaatgcaataccaactgatatggtttggctgtgtccccacccaaatctcatcttgaattgtaatccccataatctccatgtgtcaagggagagacaaagtggaggtaatttgaatcatgggggcggtttcccccttgctgttcccatgatagtgactgagttctcacaagatctgatagttttgtaagggtttggcaagttcctccttcagtctttttctctcttgccaccttatgaagaagatgcctgcctcccattcacctttaaccatgactgtaagtttcctgaggcctctcaagccatatagaactgtgagtcaattaaacttcctcctttccttcataaattacccagaatcaggaagttctttatagcagtgtgagaacagactaacacaccaccttactcctgcaagaatggccataatttaaaaataaaaaaataaaggatgttggcgtggatgtggtgaaaagaaacactttttttttcttttttttttttttgagatggagcctcgctctgtcaccaggctggagtgcagtggtgcgatctcagctcactgcaacctccgcctcccgggttcacaccattctcctgcctcagcctcccaagtagctgggactacaggggcccgccactgcccggctaattatttttgtatttttagtagagacagggtttcaccgtgttagccaggatggtctcgatctcctaacctcgtgatctgcccacctcagtctcccaaagtgctgggattacaggcatgagccactgcgcccagccaaaaagaaacacttttacaccactggtgggaatgtcaactagtaaaaccactatggaaaacagtatggagattccttaaagaactaaaagtagaactaccatttgatccagcaatcccactactgggtatctacccagaggaaaataagtcattatatgaaagagacacttgtatacacatgtttatagcagcacaattcacaattgcgaaaacataaaaccagcccaaatgcccaccaatcaacgaacggataaagaaaatgtggtgtacatatataccatagaatactactcagccataaaaaggaatgaaataatggcatttacagctaactggatggagttggagaccattattctaagtaaagtcacacaggaatggaaaaccaaatgtagtatgttctcataaatgggaggtaagctacaaggacacaaaggcattgagaatgatacaatgggccgggcccggtggctcacgcctgtaatcccaacactttgggaggccaaagcagatggatcacgaagtcaggagatggagaccatcctggctaacatggtgaaaccctgtctctactaaaaatacaaaaaaattaggccaggcacagtggctcacacctgtaatcccagcactttgggaggccggggtgggcagatcatgaggtcaggagatcgagaccatcctggctaacacagtgaaaccccgtctctactaaaaatacaaaaaattagtcaggcgtggtggcacatgcctgtagtcccagctacttgggaggctgagggagaagaattgcttgaacccgggaggcagaggttacagtgagccgagattgcaccactgcactccagcctggtgacagagcgagactccccctcaaaaaaaaaaaaaaacaatggattttggggatctgggagaaggttgggaggggaatgaggggtaaagactacacattgggtacagcatacactgcatgggtgatgggtgcaacaaaatctcagaaatcatcacggaagaatttatcaatgtaaccgaataccacctgttccccaaaaactattgaaataaaaaaaaaaagataatga

SEQ ID NO: 1845 - DNA, 6153 bp, Homo sapiens
atgaattttagcataaattcatttaaagagggacaacaaataaaatcttttgtgaagactaaaaatttcttttgtacaatacaaaagatgaaacaaaatgttggttctttgaaaaaataaataaaattgatagaccattggcatgattaaccaagaaaagaagagagaaaatccaaataaccccactaagaaacaaaacaggagatattacaactgacaccactgaaatacagaagatcactcaaggctactatgaacacctttacatacataaactagaagacctagaagagatggataaattcctggaaaaaatacaaccctcctagcttaaatcaggaagaattagataccctgaacagactaataacaagcagcaagattgaaatggtaatttaaaaattgccaacaaaaaaagtccaggaccagatggattcacagcagaattctaccaaacattcaaagaattggtactaatccttttgaaacaataccacaagatagagaaagaaagaaccctccttaatttattttatgaagccagcatcaccctaataccaaaaccaggaaaagacataacccaaaaagaaaactacagaccaatagccttgatgaacacagatgctaaaatccttaataaaatatttgctaactaaatccaacaacatatcaaaaagataatctgccatgataacgtgggtttcataccaaagatgcagggatagtttagcatatgcaagtcaataaatgtaatacaccatataaacagaacgcaagtcaataaatgtgatacaccacataaacagaattaaaaacaaaaatcacaactaagagcagaactgaaggaaatagagacacaaaaaacccttcaaaaaatcaatgaatccaggacctggttttttgaaaagatcaacaaaagtgatagaccactagcaagactgatgaagaaaagagagaagaatcaaatagaggaaataaaaaatgataaaggggatatcaccaccaatcccacagaaatacaaactaccatcagagaataatataaacacctctatgcaaataaactagaaaatctagaagaaatggataaattcctcgacacatatacccgcccaagattaaaccaggaagaatttgaatctctgaatagaccaataacaggctctgaaattgaggcagtaattaatagcttaccaaccaaaaaaagtccaggaccagacggattcacagccgaattctaccagaggtacaaggaggagctggtaccattccttctgaaactattccaatcaatagaaaaagagggaatcctccctaactcattttatgaggcaagcatcatcctgataccaaagcctggcagagacacaacaaaaaaagagaattttagaccaatatccctgatgaacatcgaagcaaaaatcctcaataaaatactggcaaactgaatccagcagcacatcaaaaagcttatccaacatgatcaagtgggcttcatcgctgggatgcaaggctggttcaacatatgcaaatcaatgaacgtaatccagcatagaaacagaaccaattacaaaaaccacatgattatctcaatagatgcagaaaaggcctttgacaaaattcaacaacccttcatgctaaaaactctcaataaattaggtattgatgggacgtatctcaaaataataagagctatttatgacaaacccacagccaatatcctgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgctgatgacatgattgtatatttagaaaaccccatcatctcagcccaaaatctccttaagctgataggcaacttcagcaaagtctcaggttacaaaatcaatgtgcaaaaatcacaagcattcttatacaccagcaacagacaaacagagagccaaatcatgagtaaactcccaatcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttatagattcaatgctatccccatcaagctaccaatgattttcttcacagaattggaaaaaactactttaaagttcatatggagccaaaaaagagcctgcattgccaagtcaatcctaagccaaaagaacaaagctggaggcatcatgctacctgacttcaaactatactacaaggctacagtaaccaaaacagcatggtactggtaccaaaacagagatatagaccaatggaacagaacagagccctcagaaataatgccgcatatctacaaacatctgatctttgacaaatctgagaaaaacaagcaatggggaaaggattccctatttaataaatggtgctgggaaaactggctagccatatgtagaaagctgaaactgaatcccttccttacaccttatacaaaaattaattcaagatggattaaagacttaaatgttagacctaaaaccataaaaaccctggaagaaaacctaggcaataccattcaggacataggcatgggcaaggtcttcatgtctaaaacacaaaaagcaatgacaacaaaagccaaaattgacaaatgggatctaattaactaaagagcttctgcacagcaaaagaaactaccatcagagtgaacaggcaacctacagaatgggagaaaatttttgcaatctactgatctgacaaagagctaatatccagaatctacaatgaactcaaacaaatttacaagaaaaaaaataaacaaccccatcaacaagtgggcgaaggatatgaacagacacttctcaaaagaagatattaaacagccaaaagacacatgaaaaaatgctcaccatcactggccatcagagaaatgcaaatcaaaaccacaatgagatatcatctcacaccagttagaatgtcgatcattaaaaagtcaggaaacaacaggtgctggagaggatatggataaataggaacacttttacacattggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaacaaacccaaatgtccaacaatgatagactggattaagaaaatgtggcgcatatacaccatggaatactatgcagccataaaaaatgatgagttcatgtcctttgtagagacatggatgaagctggaaaccatcattctcagcaaactatcacaaggacaaaaaaccaaacactgcatgttctcactcataggtgggaattgaacaatgagaacacatggacacaggaaggggaacatcacacaccagggcctgttgtggggtggggtgaggggggagagatagcattaggagatatacctaatgttaagtgatgagttaatgggtgcagcacaccaacatggcacatgtatacatatgtaacaaacctgcaccttgtgcaaatgtaccctagaacttaaagtataataaaaataaataaataaataaaaatcacataatcatttcaatagatgcagaaaaagcattcaacaaaatccagcattactttattattaaaactctcagcaatgtcggcaaacaagggacatatcttaatgtaataaaagccatgtatgacaaacccacagccaacacaatactgaatgggaaaaagttgaaaacattccttctgagaactggaacaagagaaggatgcccactcccaccactcctcttcaacatagtactggaaatccttatcagagcaatcaagagaaagaaataaagggcatccaaattggtaaagaggaagtcaaactgccactgtttgctaacaagatgattgtttaccttgaaaaccctaaggattcctccagaaagctcctagaactgatataagaattcataagtttctgggtacaagattaatgtgcacaaatcagtagctcttctatacaccaacaatgactaagtgaagaataaaatcgagaactcaacaccttttacaatagctgcaaaaaaagaaaaaatacttaagaatatacctaaccaagaagttgaaagacctctacaaggaaaactaccaaacactgctgaaagaaataataggtgacatgaacaaatggaaacaaatcccatgctcatggatgggtagaactgatattgtgaaaatgaccatattgccaaaaacaatctacaaatcaatgcacttcccatcaaaataccaccatcattcttcagagaattagaaaaaacaattctaaaattgatgtggaaccaaaaaagtgcccacatagccaaagcaagattaagcaaaaagaagaaatctgaggcatcacactacctgatttcaaactatactataaggccatagtcaccaaaacagcatgggattggtataaaaataggcacatagacccatggaacagaatagagaacacagaaataaacccaagtacttacagccaactgaacttcaacaaagcaaacgaaaacataaagtagggaaaggaaccctcttcaacaaatggtgttgggataattggcaagccacatgtaggagaattaaactggatcctcatctctcaccttatacacaaatcaactcaaaatggattaaagacataaacctaagacttgaaactataaaaattctagatgataacatcaggaaaacccttctagtcattggcttaaacaaggatttcatgaccaagaacccaaaagcaaatgcagtaaaaacaaagataaatagctcggacctaattaaactaaagagcatttgcacagcaaaaggaacagtcagcagagtaaacagacaacccacagagtgggagaaaatcttcacaatctatgcatctgacaaaggactaatatccagaatctacaacaaactcaaatacaacagtaagaaaaaaaaccatcccatcaaaaagtggtctaaggacatgaatagacaattcccaaaagaagatatacaaatgtccaacaaacatatgaaaagatgctcaacatcactaatgataaaggaaatgcaaatcaaaacttcaatgcgataccacctcactcctgcaagagtagccataatcaaaaaatcaataaaacagtagatggtggtgtggctgcagggaacacttttatactgctggtgggagtgtaaactagtatagctgctatggaaaacagtgtggatattcctttaagaactaaatgtagaactaccatttgatccagaaatactgctactgggtatctactcagaagaaaataagttattattcgaaaaagatatttgcacacgcatgtttgtagcagcatgattcacaattgcaaaatcatggaaccaatccaaatgcccatcaatcaatgagtggataaagtagctgtgatgatggaatactgcacagtagtatatgatggaatactacacagccattaaaaggaatgagttaacagcatttgtagtgacctggatgagattgaagactattattctaagtgaggtaactcaggatggaaaaccaaacatcatatgttctcaccgatatgtcggaactaagctatgaggacacaaaggcataagaatgacacaatggactttggggatgtgggggaagagtgggaggggggtgagggatagaagactataaatatggtgcagtgtatactgcctgggtcatgggtgccccaaaatctcacaaatcaccactaaagaacttaatcatataaccaaataccacctgtacccaaataatttacggaaaataaaataaaagtcaatgtaccccaggatatgggggaacagaaaaaaatgta

SEQ ID NO: 1846 - DNA, 3129 bp, Homo sapiens
tggtctgctacacaaagagttaagcatccactcatgtgaagtcaagtaagtatgtcattgtgatgatgacatcacaaacatcatatcagaaaaaaaattctcatagacttttctacattgagtactctgtaatatctgcagtggtgattatttgaaaagtttgaataatattcatgtccaactaatggctatgttaatcaaggatgataactaattctttgctgtgtaaagaacataagcagtagagaatgttttctcttttattaggttggtgcaaaagtaattgcggtttttgcagttttttttttttttttgttgttgttgttgttgtttgttttgttttgttttgttttttttaaatggcaaaaaacacagctatttttgtaccaactaatattgttgcacctcatttatttctcctaagggccaggctgttttctcactggatatccttacgttgccttgttcaggtttattttatttatttattttgctcaaaattattattttttattattttaaaattttttttactttaagttcctggatacatgtgcagaatgcgtgcatttgttacatagttatacatgtgccttggtggtttgctgcacctgtcaacccatcacctaggttttaagctccacatgcattagctatttgtcctgatgctctccctcccctcacatgcccccgccaacaggccctagtgtgtgttgttcccctccctgtgtccatgtgttctcattgttcaactcccacttatgagtgagaacatacagtgtttggtttttctgttcctgtgttagtttgctgaggatgatggcttccagctccatccatatccctgcaaaggacatgatctccctttttatgactgcatagtattccatggtgtgtatgtaccacatttcctctttctttttttttctttaattttactttaagttctgggatacatgtgcagaatgtgcaggtttgttacatagatatacatgtgccttggtggtttgctgcacctgtcaacccgtcatctaggttttaagccccacatgcattaggtatttctcctaatgctctccctccccttgcccctcaatccccgataggccccagtgtgtgatgttcctctcgctgtgtctatgtgttctcatcgttcaactcccacttatgagtgagaacatgcagtgtttggttttctgttcctctgttagtctgctgagaatgatggcttccagtttcatccatgtccctgcaaaggacatgaactcattcttttttatggctgcgtatttttcatttctataacgatccatcagtaggactgcttatgacaaattcaaataaagtcattttaattgttaatttgtcttatttattctttgtttaaacatcatcagaacgctgcatagcatttatttgatttttaggacatgatctgcttatgagttctgtgtatgcagagctgtccgagggaaagctaaattgacggaaaagtgcttcttgctttctgttccaaaatgcctacctgtgctgtccatagcattatttcgctgaatgcaaggctattttccttttgtgtcctatcagtgatagatcgtagagttacatatataaaatatgaatttccacttttttgtttgttttttgatacagtcttactctgtcacccaggctagagtgcaatggcgcgatctcagctcactacaatctccgcctcctggtttcaggtgattcttatgcctcagcctcttgagtagctaggactacaggcacgtgccaccatgcccagctaaattttgtatttttagtagagacggggtttcaccatgttggccaggctgatgttgaactcctcacctcaagtgatccatccacctcagcctcccaaagtgctgggattacaggcatgagccaccacccccagccagtttccagtttttttttatgatctttcagtgaaagcataagaagtcattttctgttttctgtacattaaataattgtaggtcttgtgtataaaaattctcagtgaacccttagcaaacacattatcctgagtacatgcattttcttaatggagaagggttaaccttttttttctttttttttttttttttgagttggagtttcgctcttgttgcccaggctagagtggaatggcgctatcttagctcactgcaacctctgtctcccgggttcaagcaattctcctgcctcatcctcccaagtagctgggattacaggtgtatgccaccacgcccagctaatttttgtattttttagtagagacaagatttcaccatgttggtcaggccggtcttgaattcctgacctcagatgatctacctgcctctgcctcccaaagtgctgggattacaggcgtgagccaccgcgccaggccaggttaaccttttaagtatcacagcttctgattgtgatggaaatctctgaaaagtttgcattgtcttactgtttcaagtgcattgttgtgtggtgcagcccaggtgactgtttattgccaccttacgctgttcctatacagcatctccccagatacatttacgtggaataataatgtctttaaaagctttgggcttttgaggtgcagtgacacaggtatctgtttggactctttcaggctgttattcatctcttctcttctgttgcagtgtctgtagcttgccattctggcacttctagtagtctctgcttacactgctgaatcttctctctctctctttcccatctcctcttctctcgacatttcctttcaccctgccttgtgtgtctggtgtttccttttatggtcagcactaaccaatcgaaactctccatttaatcactacttattctagggattatgttaactattaatacttcacacgtatcatttcattgaatccccactacaatcgtatggggcaggtattgtatttccagtctacagagtaagaaactgaaaattacagagtaatctgtgaaggagctagatggaattcactctgggcctttgaagcctcagaacctgaactcttcacttatacttacagtgcatgtgctgcatctcctgctaaaatacgcacataggttagtaggaatcatgttggcagtaaaattaaaatgttggct

SEQ ID NO: 1847 - DNA, 7217 bp, Homo sapiens
cccttcttagagagatgtccaaaaacttccctacaataactgctttggtaagttacaatttaagaatttaatagcttatttaggtatatatgtatgtggtgaatgttttgcttaagcttgaatcaaaatcattactgccaatgtcatttttttggttaaaaatgtgtgttcagagaagatgatctaaataaatggagataattcttattttcttggataaatcaacctaatatcatattagtgcaattccaattcaagtttcatttggatattttgaggaatatggtaaacatattcaaaaatgtttatgaaagaataaaggtcctaaatagctaagtcatccttgaataaagaggagtaaatgtgggaggtgtgggtggggttggcccttcctacctgatattagtacatcttacaaaaccatggaaataaaatcagtattgtattggcacaagaatagaaagtgagtcaacctaataaagagctcaggaacagacccatgaatatttggggacttaatatacagtaaagtagcacaaatcaaagaggatggacagactgtgtagtagacggtgttgggaaaactgtctcactttatggagaaaaatacttgatctctacttaataccgtatagagaagtgagtgtcacaggactaaagacctaaatgtaaaaatgtaaagctataaaattgaatataacaaaatacaaaatattgctgtgacctagaggcaggaggagacatcagaagctcaaaccaaaaggcaaaaaaaaaaaagaaacaatgcatttaattaatcaagattaatgctttttgtttgatgaagatgtcaaagttaaatacagaagacattttgggaaaacaaattttccagtgtctaaatttaactagaaactcctgcaagtcaacagtgaaaaaaagcgggaaccctagtgagaaaatgaacaaagtctgtgaagagctaatgagaggcagagaaacctaaaaggccaacaagccatataaaggaatgttcaaactcatcagttttcagagatgttcaaaccatgatatggatctaccgtttagactaacaaaaactggacagccatatagtgttaagtacgggtggaacatagggtatgggaatccttgtgcattgctggtaggaatgtagaccaatgcagccattctgtaaagcacgctggcagcacttgggcaaacacagacatcttctgtgtccgctgagctcttggtcgtaaatgaacttttgcaaggatattgactggtgtgttttgtcatgatgtgagtttggagaccatctgtgtgtttttactgagagaggagacagattaacaattggctgatgcacccatggagtattacgtagcatgcagaaacaggaggaagaggacttaaatacagtggaaagagtaagaaacaggatgaagtatatatatatatatacacacacacacacacacacacacatataaacacaatactatttaggtaaattagataataactacatgttaagaacttatacatatgcgaggatattggactaaaaggctttacaataggtggaatataaaagaatatataaataaaacaagtgattttggaggaatctatggatgataaaggaccctggttcgagaactgtgattgtcttatcgtgtgcacataagagatgggggaggagacgaggaataggcaatactatcattgaattcattattttcattttgtaagtattttataaaaacatcaaaaggtcagaccttttggaagtttgccataaaagctccaattaaaatgcattcatttagcctttctctaagtaggtaaaatctaaagaacaaatgtggattcatgtgtagtaataataaatgatactgggcagtggtgtgtgtgcccagctcttctggacgattctttgacagaaggaaacctagcacttctaggtttgtctgcatttgctttacaggagtggtcaccatctcacaacttgaagagcctgagaaagaagcaacttgcaactcgagaggccatggcccgccagaccgtagtctcagacacagagctgagtattgttgaatcatctgtgatcaggtacagtacagtgtttcttgacactgtcatttgtgccattagcatcatgtctgggaagttgacaagtatcatcggaaggtgtctatggtagcaagttggactctgcttttgaacatacttagtttcatctttcagtacatacccagattactaaaaagataattttatcatttttagtattgtactatactgtttgttataactaataacatatgcagtaatattcacccatcagcatctagtagtaaatgtgctcattccgagtgcccttctactccatacacttcagcttctgaaattcaaatgaacatagcatagacatacagatagatcatattatcatttatacacaccaaagaaaatgtgttgggaatcctaaatttgtgtatcatccccatccataccaatcttacagataaaaggcttcagagataatgttgggtcactgtacagcctcccttctgttgagcacagttctatagccaaaatctctatgaattttatttttcttgtgttaagtttagatcaccatttctctctgtgcagggtaaacttcctctgatgttgtggctgttaaggagtgattcatgtttacccataattagctgggcaaatattagtttcagacttttaaaaaaatagttttggacctcctcttaatgcgtctgtactttgggcaagttaattaattatgagtatcactctaggggaaaaaaaaacatctttatcatatgtttcactatcccaaagcttgctgcaggaggcagaaagtaaatctgaacttagtcagaacatctctgcccgggaacattttgtatttaccgatattgatggccaagtgtatcatctcactgttgaaggaaactcagtaaaagacagtgctcggattccaccagatgtgagtacaaccttgattaaatcttcatcaagaagattttgttttgttggttccatatccagtgaaggcatagttaagttggaaacttcagaaaagcctaatgtaaataaactttatttaaggagatattatcgattaaacttgttccatactgctagagaataacgctgtaactattttgattaaatgtttactgtgtgctactcatttttatccctgtaataatccatgaggagttatctccattttacccataacaaaactgtgggagaataagtaactttcccaaagttatccagcttactcatatggcagagcagtgttttaaactcaggcctgtctgacttcagtatctgtcttctttccatttcaggcattaccctgaaggatttgacttacaatctagtattatttttggataatagtaatcaggttgtaagtgtaatagtattattaacatttactaacttacatatattcttatggccttgtggaatctgtaactaaagttttgccattaatcatttgtgtcagcatgcatctcatagatagtttttaatagatggatcatgaaaatgtttatgttaattaatgcaggctattataatggttaaatgaaggcatgaggggattttttaaaataggtatatttattttaaattgctatctaaaaatggaatgctctagtagaatgccaacccccataattttataggtggctttggggtctcataaagttacaatctagatgttggctgtggctacagtcttttgaagtgtaatgggacagaaggatctatttccaagttggctgcctcacaggctattgcacattaatgctggctgttgacgagggaccttagttcttcatgtcgatctttccataaggctgcttgagtgtcctcacgacatgacaactggcctcccctagagtaagtgatctgataaagcaagaaggaagttgcagagtctattatgacctggtttcagaagtctcttcaaaggcaacttcttaattaaacattctattttatggctaggaaagtagatatcttaaaatgttgcttcatattatatacagaatttcatttctttaatatttttttttattaatggactttattataatattgatttttaaatccagtttttgttttgtttcttgactattaccagagtttttacggtattcagtgtgtgtgctagtccactaatggtcaattattcaaaccactagagttttcttactttttaccatggataccatttgaatttttatgttgtacaataaatgcaaaaataaaatttcttttaataaatagagaagtaattgagcagtaatattatttaatagctaacatgtattgactatttactgcatggcaggcattgctttaaggcctttgcctttataaatttattaatactagcaacaactcaagtttcatgaacttaccctactttatggacaataaatccaagacagaaaggttaagtaaacatgcctcaaatcacataccagtttcaagctgggattcaagcccaggcagtgtgactgcagagcccaggctgctgagccctccatgataccacctctgagcatctattagaactgcaagttcctttcttcctccaagttagattgactacagcagcatttcattcttatgttgtgcttctatatgtaacttctgagcaaagctttctgtgaatttaaactgcatatgcctttagtaaacagcatctcttcaccttcatgattccacaatgttccaaaacgtgtcagtgaagctctggatccttttttcaatagaaaaatcacggcacaattagttataaaagagctttaagtttcccttggaatggatttagttatccttttgcagtgagagataagtttgagttggctctctggaaaaccttccctttacttctctgtttttcttactttaatttcccccttttttttttgaggtatttgttcctcaaaagacatcccctctctttaaatctagttccagtaactacttaatgtctatgaagttgaaatctcctatttcttcatagttgaaattgataggcaatgtagctctttgttagtgtctaaagtctgttttaggatttgatgactaaaagcatactaaagcacagccctttaaattaagttttattaaaatatttattataatgtcttatacagcatagtgaaatttatatttgtttgttgctgttgttttctagggaagtatgggtagtattacctgcatcgcttggaaaggtgatacattagtgcttggagatatggatggaaatttaaatttctgggacttgaaaggcagagtatccaggtataagccaagaatgaaatcttgttatttcattaaaaaaaagaaatgaaatctttttgttttgttttgttgagatggtgtcttgctctgtcgcccaggctggagtgcagtggtgcaatctcggctcactgcaagctctgactcccgggttcatgccattctcctgcctcagccacccgagtagctgggactacaggcacccaccaccacgcccggctaatttttttgtatttttttagtagagacgggatttcaccatgttagccaggatggtctcgatctcctgacctcgtgatccgcccacctcggcctcccaaagtgctgggattacaggcaggagccagcacacccggccaaaaaatgacatcttgatatggttccattagaggcttgtgacttggcaagaaggatcagtaaactcgtggaggtgtagcttggacccttgggtcccttcacctaaacttgggaggatgggccttgagccaagcattcttaggagatagttatctgcaagtggcccctgcagaagtcttagctgaccttaaagggcaggccctttctgtcagatgtggcccccagtcccagcaagtaaagggttctcccatcatcagacctgttagaaatggaaatagtgagagatgttagacatagcttctggtgaccagatctcactctacattgtattgatgtttttgtttctttgtcttcagaggaatacccacacaccgaagttgggtgaggaagattcgttttgctcctggtaaaggaaatcaaaaattaatagcaatgtacaatgatggagctgaagtgtgggatactaaagaggtaggccctctccatgaggataaaacgtaaataaattgttagccataggaactgtgctttgttaaaaaacttctttctgatttagaaatgaaaagtacttaatgagttcgtcaagtttcccataacaaattattttctttactttacagtatttgtgttctaaaggtaacaactcaagatttatttatttatttatttatttatttttattttttattttgatatggagtttcactcttgtcgcccaggctggagtgcaatggcgcgatctcgacttattgcagcctccacctcctgggttcaagtgactctcctgcctcagcctccctagtagctgggattataggcatgtgccaccacgcccggctaatgttttgtatttttagtagagacagggtttcgccatgttgggcaggctggtctcaaactcctgacctgaggtgatctgcccgcctcagcctcctaaagtcctgggattataggcgtcagccaccgcgcccagccgatttatttattttttaatattatcactgtctctgagacctttaaaatgctgcctatttgtggaagatagattgccagaggctgttcagttctaaacttgaactgggcctttgccacagactgtcttccttgaccatttaatctagaataataaagatcttccttttctgtctggaagtgatgcccaaattcactcttgaaggttcagatggtgagcagtttaagaagtggcagaaatgtgacctttcgtatattggatgtggactggtgtacgtcagataaagtgatcttggcctcagatgatgggtgcatcagagtcctagagatgtctatgaagtctgcgtgctttagaatggatgaacaagagttaaccggtatggaatcctaatgatagggggctttgaaacctgtctttactttgccacaagctcttgtattttggggagagagctgctgcttctgtttcatttcagtcttattttcttagaatctgagtttaagaaaatatattaacttgaagcttgagtgtttttactgctgagatg

SEQ ID NO: 1848 - DNA, 1117 bp, Homo sapiens
gaacgcaaagatgaccgttccaagtcttttttaaaagaagggaaaaacccagtcacgctcctggagcctggttcccacgggagcaggccgggctgtccacgacggaagcctcgaccctggctggggctgtcggccgggcagcgcgggagagccagggccagagccggggccgggaaccctagtcccgccgcctacgcgggatgcagcgaccaccgcccgccgcccccgggccggcactcacctccgtggaggggcagcggcgccagcacctggccgcggacctcggccttgggggagtcaagcccgtagcgcccgcggtcgatgcgaaacgtgagcggggcgccgcggccgggctcctgcaccgtcacgttgatgagcgccgtgtagtactcctggctcgcgttgtctgcccgtgccggccacaggctgcaggtcagcagggcgagcgcggcgagccgggcagggcccgcccgccccgcgcagctcatcgtccctccggcagccgccgctgctcgcggaccgggctccggggccggcgcctagaggcggggcgggcgcggcccgggcggcggcgggagcgcgcgcgcgcggcctgcgcggggccgagcccgagcgcggccctcctggacgccgcggccccgccgctcgccgccctcacgtccactgcccgcctgtggggacgcgcccatgggccctcggcgagggcggcgtctcaggtcgcacgcgggcgtctcttcggggtcccaggagggttgtagaagcgtgccccctccatccccccgggtcggtcccaccgaatgggaggcgcctcgcaaggacgcggcgggggaggggaagggcggcacgggaggaagcgccccgaggagggtcagcggaacacaaagtccctctcgcgcggctgccgcctgaggcgcgtgtccgccgccgccccgcccccccgctggtctagcggcaacgcgcaggcctaaggcgcagtcccgccccgagcgcatgcgtgccagggcctgtccgctcccgcccgcctgcacgagggcccgggcagccgggtcagccgctggtgctggttgtttctctgtcaggcgtgatagccgcagggcgtggagcccgggagatttgc

SEQ ID NO: 1849 - DNA, 1268 bp, Homo sapiens
aaaatgacactactagttgacctttccataagactcaacaaacacaaagtgtaactcctgccctcaaagccttcatggtctaggctgaggaaaaagcctcctaagtagatcgttaaaacacgaactcaagaagtgcgacaattcagggatcactgagaagtgagacttcccaaccatctggggagtcgggggcagttagagtgtggagggcacagcaactgggttttgaagaatgaagagcaactaatctgaatcaggaaggcaaaggcctttcagagccacatagaaaggggtgacagcgcggggagtcaggagtgtgtatggggctgtgtgggacgggtcccagaggcaaacgccaacggccgagtgaccccagtaactaccacaggaagggcttggttcgcaaaaaagacttgcgcaaacaagggacagccgagccgcccagggaagtgcggctcccgagaagcctccgcgcaaggtccgggcctgctgcccaaggtccgcgtaagcgccaacgcccgaccgttcccaggcctcccaggctccggcgcccggtgcagcggcggacgacccacccatcatggctgcgcgtcgcaaaagtggcggcgcgcgcccggctgccccgcaacgactcacccgtggtgtgcaggaagcgcagcccctcggtctccagggccggccgcgcggacagagactcctcttggcgttccatgaccgccgccgccgccgccgcccagccctgccgccgcgcctccagccgggcgcttccggtgcgctcctacgcacacgtggcgcgcccggacgcggtcgtggtcccggccaatcgcaggccgaccccgccccgtcgctgggccaaacgcaggggggcgtggccgaggggcgtggcgggggagaaatcccggctacgctcgccggggccgggacagcgcgtgtgggaacgttctgtgctatctcttggcttgagtcgggggtggaggacggacctcgttcacggatttcttaccgaatttctactttcttttttttttctaattggacactgaagccaaggaagtcagtggtcgcccggaagcaggatttgcacccacatccttgcccggggcacattggacaacagggctcagttggttgacgactcccagcatttgagggttgcagccaacgtccaccccaagtgaagacacgaaatgtgagcagcctcctgctcctgctgctggtgatacctttcaggccaagaaagtccccaccgatcctcaaggttctttctc

SEQ ID NO: 1850 - DNA, 539 bp, Homo sapiens
ttcagtctgctggcattttcgttagtgggcttcctcatacttatttttgaattgatttttggaaattgcttcaaaattacagaatatttgcaaaaataaaaatagtagaataaatatatatggtgcagtgagttgtatgtggtttgtccccaccacaactcatggtgaaatttaattgccagtttaacggtattgaaaggtggtggggcctttaagaggtgtttggttgtggcatctctgccctctcgaatggcttatgcagactgggttagttcttttggactgggttggttctcgtgagatcaagttgttataaaacaaggcttcctctgatgtttggcctctttgcatgcacttgctttcccttcctctttctgctgtgatttgaagcagcatgagaccatcaccaaatgggctaccatccaacctccagaattgtgagccaaataaacttttttgtaaattacccagtctcaggtattctgttatagcaatacaaaacagattaagacatatggcatatatgttattatataaat

SEQ ID NO: 1851 - DNA, 7457 bp, Homo sapiens
ttcagtctgctggcattttcgttagtgggcttcctcatacttatttttgaattgatttttggaaattgcttcaaaattacagaatatttgcaaaaataaaaatagtagaataaatatatatggtgcagtgagttgtatgtggtttgtccccaccacaactcatggtgaaatttaattgccagtttaacggtattgaaaggtggtggggcctttaagaggtgtttggttgtggcatctctgccctctcgaatggcttatgcagactgggttagttcttttggactgggttggttctcgtgagatcaagttgttataaaacaaggcttcctctgatgtttggcctctttgcatgcacttgctttcccttcctctttctgctgtgatttgaagcagcatgagaccatcaccaaatgggctaccatccaacctccagaattgtgagccaaataaacttttttgtaaattacccagtctcaggtattctgttatagcaatacaaaacagattaagacatatggcatatatgttattatataaatggcatcataaaatgacctactattttacttagtttgctttatcatttattcatgtgctcttttgcatgcatacccttcctccttccttcccctttctcagtacatatgtatgtatgtgtatatgtatatgtatgttcatatgtgtttgttttgtttttgtctttgtttttgtttttgttttttgagacagagtctcgctctgtcacccaggctggagtgcagtggcacgatctcggctcactgcaacctccgcctcctgggttcaagcgattctcctgcctcagcctcccaagtagctgggattacaggtgcacgccaccatgcctggctaatttttgtgtttttagtagagacagggtttcaccatgttagtcaggctggtcttgaacacctgacctcatgatctgctcacctcggtctcccaaagtgctgggattacaggcgtgagccaccacccccggcctgtaagtgtttgtttctgtgaattttctaagaatgtcgatattgtctcatataaccacagtgtggttatcagcctcagtaaacttaactttgatacagtcattttgcctgttatctaccattcgtattataattttgtcaacatatagaataatatggttttttactttccagaacataatctagtccaaggttagttagttcattttcatgtcatgtctataattattattaagggaagggaattattatttcaataatctttctctgtcttttataacattgacatttcatttgtttatttaattttagattcagagtgtacatgtgcaggtttgttacatgggtatattatgtaatgctggggtttggggcttctattgaacctatcacccaaatagtttacatagtacctgataggtagtttttcagcccttacctccatcctttttcccctgttttggagtccccagtgtctattatttccatctttatgtccgtgtgtacccattgtttagctcctacttgtgagaacataggttatttgattttctgtttctgcattgattcacttaggatgatggcctctagctgcatccatgttgctgcagaggacatgatttcattcttttttatggctgcatagtatttcatggtgtgtgtgtaccacattttatttatccagtccactattgatgggcctatacgaagattccatgactttgctgttgggaatagtgctgcgataagcatacgagtgcaggtgtcttctggtagaacaatttattttcccagtcttgggattgttggattgaatggtagttctatttttagttccttgagaaatttccatactgtttgccatacaggttgaactaatttacatgaccaccaacaatatataagcattccctgttctgtgcatcctcactaacatctgtttttttgtttgtttgtttgtttgtttaactttttaataatagccattctgactggtgtgagatggcctatcttcttgtgggttttcttttcccatccttcactggtaccaagatctctttgtggttgtaatttgtatttctctgatgattagtgattttgagcattttttatgtttgctccctgtttgtgtaccttcttttgagaagtatctgtttatgtcctttgctcactttttaatgaggttatttgggtttttgttgttgatttgtttaagttccttatgtttctgcatattagtcctttgtaagatgcatggttcgcaaatgctttctcccattctgtaggttgtctttttactctgttgattgtttcttttgcagtgcagaagctcttttgcttaattaaatcatatttgtccatttttgtttttgttgcaatcgcttttgaggacttagtcataagttctttgccttggccaatgtccagagaagtttttcctagttttcctttaggaattttatagtttgaggtcttacatttaagtctttcatccatcttgagttgatttgtgtatatgagggggaagggtccagtttcattctcttgcatgtggctggacagttttcccagcatcatttattgaatagggtgtcctttccccattgtttatttctgtcagctttctcgtagatcagttggtagtaggtgtgtggttttatttctgggttctctgttctgttccgtagatctatatgtctatttttgtacttacaccgtgctgtttcagttaatatagccttgtagtatagtcaaagtcaggtaatgtgatatttccagctttgttctttttgtttaggattgctttggctagtcaggctttgttggtcccatatgaattttagaattgttttttctagttctgttagaatgttagaatgacaaatgatgttggtaatttgataggaattgcattgaatctgtagattgctttgggcagtatcatcattttaactatattgattcttaacaatctatgagcatagaatgtttttccctttgtgtcatctgtgatttctttcatcagtgttttgtagttctcctcgcagagacctttcacctctttggtttgatgtattcttaggcattttgtgtgtgtttgcattcgtgtggctattgtaaatgggatcttgttctttatttggctctaagcttgaatgttactggtgtatagaaatgctattgatttttgtacattgattttgtatcctggaactttactgaatttttttttttaatcaggtttaggagtcttttggagggacctttagagttttctaggtataggattattttctaggtataggattttctaggtaaaggattcttggcgaacagagataatttgactccctcttttcctatttggatgccttttatttctctgtcttgcatgattgctttctctaggacttccagtactaagttgaatacgagtggtgagagcagacatccttttcttgttccacttcttagggggaatggtttcagctttcgcccattcagtatgaagttggctgtaggtctgtcacagataactcttcttattttgaggtatgttcctttgatgcctagtttgttaaagatttttatcatgaaggggtgttggattttatccgatgctttttttacatctattaagatgatctttttttttttttttttttttttttgtttgagacggagtcttgctctgtcaccctggctggagtgcagtggcgcgatctcggctcactgcaagctccgtctcccaggttcacactattctcctgcctcagcctctctgagtagctggaactacaggcgcccaccaccaagcctggctatatttttgtatttttttagtagagatggggtttcaccgtggtctcaatctcctgacctcgtgatccgcccgcctcagcctcccaaagtgctaggattacaagcatgagccaccacacctggccggtttttgtttttaatcctgtttatgtgatgaatcacatttattgaacactgacattttagaatacaattcctcagttctcactttttttttttttcttttttgagatgaagtctcactctgttgcctaggctggagtgcagtggcgcgatctcggctcactgcaacctccacctcctggtttcaagcagttctctgcctcagcctcccgattagctgggactacaggtgcgtgccaccatgcctggctaagttttgtatttttagtagagacaggatttcaccatcttggccaggcttgtcttgaactcttgccctcaggtgatccacccaccttggcctcccaaagtgctgggattacaggcgtgagctaccgcgcctggccagttctcactttttaaaatagctttactgaggtataatttacatgccataaaattacttattgtatgtatacagttcaatatatatatattttttttttgagatggagtttcactgttgtagcccatgctggagtgcagtggcacaatctcggctcactgcaacctctgcctcctgggttcaagtgattctcctgcctcagcctcccgagtagctgggattacaggcatgtaccaccaggcctggctaattttgtatttttggtaaagacagggtttctccatgttggtcaggctggtctcaaacttccgacctcaggtgatccgccacctcagccttccaaagtgctgggattacaggcgtgaaccgccgcacctggcctgtgtgtgtacagttcaataatttttagtaaacttatagagttatatgattgtcacctctattcaacatttctgtcacaccagaaagttctcatgtgcccatttgcattcatccgtcctcccatcagaggaaaccattgatttgtttactgtctatagatttgctgtttctagacgtataagaatggcattgtgaaatatatagtcttttcttttttttttttttagatggagccttgctctgttgccaggctggaatacagtggtgttatatcggctcactgcaacctctgcctcctgggttcaagcaattcccctgcctcagcctcctgagtagctgggactacaggtgcacaccaccacacctggctaattttttgtattttagtagagacggggtttcaccatgttggccaggatggtctcaatctcctgaccttgtgatccacccgcctcagcctcccaaagtgctgggattacaggcatgagccaccatgcctggcccttttcattgtttattaaccatttgcatatcttttttagtaaaatgcctattcaattcttttctttattttaaaattagattgtgttcttattgaattgtaagaatttttagtatattctagacacaagtcctatatcaatataggattttcagatatttctccctgtctgtggcttatcttttcattttctcaatggtgtcatttcaggcacaaaagttttaaatgctgattaagtttaacttaccaatttttaaaatgggttgtgcttttggtgttgtaactaagaactttattcttaactcaaggttatgaagattttcttcactggtttcttctagaagttttacagttttagctcttacatttagagctacaatccattttagttaatttttatgtatcaaatgaggtgaaaatctaaattcattttcttgcatatgaatattcagttgtccttacaatctcatataaagagtatccttcctcccattgaattaccttggcacctttatcaaaaatcagctgactgtgaatctaagtgttcatttctagtctcctgattttgttccatgatctccatcttcctcctatgacagtagcacactatcttcattactgtagctttatattaagttttgaagttagaagtatacactccccaactttattttctttttcagaaattgttttgtctattttatgtcctttgaatttcaatgtaagttttaggatcagattgtgaatttccaaaagggaaaaaaaccaaaagcctgctgtggttgtgataccatgattatgttgaatctgcagataaattttggtgagaatcaccatcttaataatagtaagccttccaatctatgactgtctccctatttatttggagctttaacttcattcaacaatgtttgttaattttctttttaaaaatctttcttcttttcctcctttcctttccttttctctttctcttctctttctttcatcccactatgttgcccaaactggcctctaacttctggcctcaagcaatcctcccacctcagcctccttaagtgttgggattacaggcatgagccaccgtgcccagccttaattttcagtttacaaactttgtgctactttgtcacatttattccttagcattttattatttttatgctatcgtgaatagtattgttttctcagtttcatttttagaatagtcattgctagtatatagaaatataattattttttatatatttatcttatatgacctaagtacaattatgacttctagttgcttttttgaaattttatgcttacaaaattatataatctgtgaacaagagattttttttacttcttcctttctagttaagatgcctttcatttattttctcctcattttgtttgtcttctccttttttttttttttttttttgagacagagtctcactgtgtcaccaggctggagtgtggtggcacgatctcagctcactgcaacgtccgcctccggggttcaagcgattctcctgcctcagcctcccaagtagccgagactacatgtgtgtgctaccatagccagctaatttttctatttttagtggagacagggtttcgccatgttggccaggatggtctcaatctcttgacctcgtgatctgcccgcctcggcttcccaaagtgttgggactacaggcgtcataagtttttgagaacacgtgcaatatttgccacttcttctttcttcttctccttttccttctcctcctcctcctccttcttcttccttcctttctctttctcttttctgtgtctccctcttttgaattcaaccccttaaaaaggtaaaaaccatttttagctggcaggccatacagaaacaggtttcaggctggatttggcctgtcaggtgagtttgccaactcctgcaatagaaaatgtaatgcatagggctagacacagtggcttatgcctgtaatcccagcactttgggaggcttaggctgacctgaggtcaggagttcaagaccagcctggcaaacacggtaaaactctgtctctactaaaaatacaaaaattagctgggcgtagtcttggacgcctgtaatcccagctactcgggaggctaaggcaggagaatcgcttgaaccctggaggcggaggttgcagtgagctgagatcgcaccactgcactccagcttgggtgaaagaaagactccgtttaaaaaaaaaaacaaaaaaacaaaagaaag

SEQ ID NO: 1852 - DNA, 18196 bp, Homo sapiens
aacaactacaactattataataattaatggatacacaatataaaatactttaataagcaatactgtatatgtctcaataaattatgtttgtttttttgagacagagcctggctctgtcacccaggctgtagtgcagtggcatgattttggctcactgcaacctccaccttccaggttcaagcaattctcctgcctcagcctcccgagtagctgggattacaggtgcctgccaccatgcctggctaatttttgtattgtttagtagagacggagtttcaccatgttggccacgctggtcttgaactcctgacctcaggtgttctgtccacctcagcctcccaaagtgctgagattacgggcgtgagccaccacgcccatcccaaataattttttacattttacattacttagcatttcaattcagaaatctattagtgtttgaggtatcttaaaataaaggaggtgtaaattataagaaaagagaaatggaagacatggaattaacagttatcagttacagttacctgttacattctagactctgtgtttcagatccttcacaaagattttggcacttacacctcagaaaaaaagccttaatagaagtgtcattgatcccatagcatagataacagtctcagggaagatgagtgaattgtgcaggatcttttggcttttaagtagagaagctaggatggaaatctaaatctgtatactttcaaaatgtatcatctttcggctgggcatggtggctcatgcctataatcctagcactttgggaggccgaggtgggcggatcacctgaggtcaggagttcgagaccagccttgccaacatggtaaaaccccgtctctactaaaaatacagaaattagcggggcatggtggcaggcacatgtaatcccagctacttgggaggctgaggcaggagaattgcttgaatccaggaggtggaggttgcagtgagctgagatcgcgccattacatctcggtctgagaaacaagagtgagactctgtctcaaaagaaaaaaagaaaagaaaattatcatctttcaaatttaagctaatattttaggtatttactagcctaaaatatttacacagataaagagtttcatcatctttattactgccctgattccagaaccagagacaacacagcattcgcatccaacccccatctacctgtttttgaggctaagtccttggcaagtctatttgagagttggaggctcccttttaccactcaagacctacttgtgaaataggggccctgccttggatgcagcaaacagagaagatgggggccctgaccatccttgcctggttcatgaggcagtggctcattgtgtggggaagtaatccaaagaacctcagactggtgctcctcctcactgagctctcagttaccagtgggtgcctgaagcttcagggcagggtgggtaacctgccattgtttccacccacaattccagaaccctgcctcagagattttaccttggaggagaaacaggccatgaaatggagaaaacccattcaaaaaattatatgtaatcccaagggacctgaatagccaaaaaaatattgaaaagaaagaccaaagttagaggtctcacacttctagaattcaaaacatattacaaagctacagtaatcaaaatagtttggaagtagcataaagacagacatgtagaccaatggaatcaaatacagagtccagggttaatccctccttacctattcttctgttgatggatatttgggttgcttccatctctcagctactgtggataataatgcaatttatatggctttacaaatatctaagtaagaccctgctttcaattctttcagagaaagaggattgttagatcatatggtaattttattttcaactttggagaaaccacctatattagtctgttttaacgctactgataaaagatatacccaagactgggaagaaaaagaggcttaattggacttacagttccacatggcaggggaggccttagaagcatggtgggaagtgaaaggcacttcctacatggcagcggcaagagaaaattaggaagaagcaaaagcagaaacccctgataaacctgtcagatctcgtgagacttattcactatcacaagaatagcacaggaaagaccagcccccataattcaattaccttcccctgggtccctcccgaaacatgtgggaattctgggagatatgattcaagttgagatttgggtggagacacagccaaaccatataaccaccatactgtttttcatagtggttctagatgagaaaaagataaaactctattgaaaaaatcagggactatctaaataaatggagagacattccatgtacatggatagaaagactcaatattgtcaagatgtcaatgttccataacttaacctatgtattcaccacaaccccaatcaaaatttcaccaaattattttgtgaataataacaaattaactccaaaatttatatgaaaaggcaaaagaactagaatagccaatgcaatattgaagaagaacaaaattggaagacatactattcaacctcaggattcactgcaaagccatagtaatcaaaacagcgtggcatgggcaaaataatagacaaacagatcaatagagcagagcagagagcccagaaatatgcctacacaaataaagttaactaatatttgacaaagaagcaatgggaatttaatggagacaagatattcttttcaataaacagtgctggaactgaatactcacatgtaaaaataagaatctacaaacagaccttacatatttcacaaaattaactcaaattggatcataggcctaaatgtaaagcataaaacaataaaattcctagaagataatgtagagtcctaattagagaaagggagtcaggctggtgggagcaggggaaagcaaaaaaaaaaaaaaaaaaaatcagataagctacaagtctgcctttcttcaccatccagaacacacggccctcctgcacaaataactcacaatcttcctgtgcctagctatcagcagaccctcggctgatacaaaaaattgcaagttagctcactgccactgatagtggcaggaggcggacaaatgcctaggcagataggggcaagtccccagggaaaccccacttccaacccaaggatagtttaaagcctgaaagccaagttacaagtcaaatccatggactggattgagaacctgtcttcctgcttggtgcactttcctctggctgatctccacccttcacctgttttacatatacctacacttcctaattgtttttttcacattgttgtgcccacctttgggtggtgcctttgttttaacctttttgcatactcacaaaccaatcagcatgcactcgcctattctgagcccataaaagccctgggcttagccacacaaggagagaaacagcccccaggtcccctctccactgagagctgttccatcactcaataaaattcttctgtcttcctcatccttcaattgtcagggtatcctcattcttcttggttgtgggacaagagctcatgaactgctgatctcagatagaagctttaacacaggcaggctggggcatgctggcccagccacaggctgagccactgtgcaagccagaatgggccaaatggatggggctacctgtgtggcaggtagcgcgcccaagcaaggcccaggtgggggtgtcactggctggaggtccctggctggcaaaatgattgagaggaatcctgcatcacaaccttggcattatcagcactacacaaagccctcttcagcatacagcctaagaactagcctataaaatctgcagcaatcctttgtttgtttgcagtcagcttctttcttgcaagctgcctgttgcctccctagcaatgtattttcctactttctgtaataaatctaccttccttacctacagcaaggtaaattcttttttttttttttttgagagagagagtgtctcactctgtcacccaggctggagtgcagtggtgcaatcctggctcactgcaacctctgcctcaacaaggtaaattcttttatgcctgcaccaccaggccagatagtcatcactcccttgcaacagataacataaaaggaaatgcaggtgactttgaatttagcaatgacttcatcgatataacactgaaaacatcattgatgaatggaaagaatcaatgagttgaacttcattaaaactaaaacttctgctagcaaaagacactgttaaagataacaagataagccaccgactgagagaaaatctttgcaaaacacacacttgataaaggactgatgtccaaaatatacaaagaactcttaaaacccaacaaaaaaatgaacaactcaattaaaaatgggcacaagatccaaatagccacctcaacaaaaaagatattcagataacaaattagcatgtaaaaaagatgatcaacatcatacatcctcagggaattgcaaattaaaagaaaaatacatggtactacacatttattaaatttccacccactgaatctaaaataaaactcagtaattttttttaggccaagcacagtggctcacatctgtaatcccagcactttggaaggctgaggtaggcggatcacctgaggtcaggagttcaagactagcctggccaacatggtgaaaccccatctctactaaaaatacaaaaaaaaaaaatagccaggcgtggtggtgcatgcctgtaatcccagatacttgggaggctgaggcaggagaatcgcttgaacccaggaggtggaggttgcagtgagccaagatcacgccactgcactccagcctgggtgacaagaatgagactccatctcaaaaaaacaaacaaacaatttttttttttaatttccaaaatcccaaacactgacaacaccaaatcctggcaaagatacagagcagcaggaactatcactcattgccagtgggaatgcaaaatggcagtaaccacatcgtaagactggtagtttctttcgaaactaaacgtacttttaccatatgatcaagaagtgcactcatcagtatttatccaaataagttgaaaacttgcgtccatacaaaagcctgcacacaaatgtttatagcaactttactcataattgctaaaacttgaaagcatccaagatgtcctttaatcagtgagtggataaacaaactgtggcatacctaaacatgaaatattatttaataatgagaaatcagctatcaagccacaaaaaaagacacagagaaaccttaaatacatatttctaagtggatgaagccaatccaaaagttctacatgaactataattccaactatgtgatattcccaaaataaaaaattacggagagtaaaaagatcaatagttgccaagggtaaagggaaaagagggagacaaatgaataggtcaagtacaggtgatatttagggcagtgaaactatggtgaatgttactgcagtatgggatagaggtcattagacatttgttgaaacccatacaatgttcaacacaaacaatgaagactgttgtcagatacgaactttagtttataacttaccaatattgcctcatcaagtgtaacaaatgcaccacacttaatgcaggatgttaataatagaagaaaatcaagggagggcattaagatctctgttctttccactcaatttttctacaaccataaaactactaaaaaaacataaaagtattttacatttaaaaagaaggatggggccgggcgtggtgactcacacctgtaatcccagcactttgggaggccgaggcggttggatcatttgaggtcaggagtttgagaccagcttggccaccgtagtgagacccccacctctactaaaaatacaaaaattggccgggcatggtggctcactcctgtaatcccagcactttgggaggccgaggcgggtggatcacgaggtcaggagatcgagaccatcctggctaacacagtgaaaccccatctctaatcaaaatacaaaaaattagctgggcgtggtggcaggcgcctgtagtcccagctactcaggaggctgaggcaggagaatggcgtgaacccgggaggcggagcttgcagtgagccgagatcgagccactgcactccagcctggcgacagagtgagactccgtctcaaaaaaaaaaaaaagtcacaattatttatcatatttattacctcaaataattattattttctttgctttttggggggtgagaacatgtagatctactcttttaccaaatttcaagtatacaatgttgtatattgttaactatattcacactgccatacattagattttcagaacttactgattttgcaaactgaatctttgcataccctgacctatatcacaaagagaattttgaaagcagcaagagaaaaacatcttgtcccatataagggaggctgcgtaagactatcaatggatttctcaaaagaatcttgcagatcaagaaacagtgggatgattcaatgtactggaagaaagagaaagaccaaaaggaatactttaccccagaaaagctgtcctttaagaataaaggatgggctgggccaggtggctcacgcctgtaatcccagcactttgggaggctgaggcaggcagatcacctgaggtcaggagttcaagaccagcctggccaacatggcaaaaccctgtctctactaaaaatacaaaaattagccaatgtgatatagggtgcctgtaatcccagctactcaggaggctgaggcaggagaattgcttgaacccaggaggtagaggttgcagtgagccgaggccatgccattgtactccagcctgggcaacaagagtaaaacactgtcccagaaaaaaaaaaaaaaaagaataaagaacaatgctgccatctgatcttttcagctgtggcctggcacccttctgagagcccggctcccagatacttgcagtctgccctggcactgctgtcactttagcattctgcagttgcctgagcattcttcctgcccctgcctaagttttctgccagctgtgtgggggccagcctgcccctctctatcacagccagcacctgaaccctgggtacctgaggacacatatgccagcctgcttctgatccagtccctccagtacttatgcatgccatccagagcaccatatagggatctgagaatcaagaaaatggctagcccagtacaccattggcacatgatcgctctctctggagactaaggctgtgctgacccagctagccaacactgcaacagctgaaatccaccctcatgtgctgaaaggtgaagctgcttcccctttgtacacaaaggagcagcgttcctgcatgagagaacaggcaagccacagggctgtctgtattggcctgagggaagaggtcctaccctgaggttgctcctgtgaagagccacaagacaggcattttcaatggctcttggctacgttatgacctagagatagatgactgggtctgtatgaactgagagtcatgaactctgggacaggggtaggatagggaaacacatcatgttcctacctacacaggaggtagagctggtacagctcctccctccctacagagacctgtgagcatttcaccaggagctgcaccagccaccctctaaaggctactgttcacgttcatcattgagatgttggtgggtaagctttgtggtccagctctgcccagctgtgtcttcccctctgggctgaacaggcaactcagagtctaggcattacatagaccagcctatcacctgaaacaacagacaggaaatcacagtaaacaaagatcaaacacacaccatctgcttctgccatagctggctcttactcataagtgccacttactggcatggaggttaaactacacaaatcaataaaaagtctactgacagaagggcacagggctaaagaaacaaagccaaagccccctacccaatatatgctgtagttacacccacaaggaggaaaaaccccatctaaattaaagtaaattcaaaaataagaagtgacaactttcccagatgagaagaaaccatcataagaagtttggcatcatgaagaaaaaaaaaaaagcagaatgttttgacactaccaaaggacacactagctctctcgcaatggatcctaaccaaaatgaaaattctgaaatgaaagataatgaattcaaaatatggattataaggaagttcaatgagatccaagacaaagctgaaaatcaacacaaagataccagaacaatgcagaatgtgaatgaagtacagatatcttaaaaaaaaaacaattgaatttctagaaatgaaaaacacactgaagggttgggttacagatgaaagctttttttttttttttttctttttgagacagagtcttgctctgtcgcccaggctgcagtgcagtggcgccatctcagctcactgcaagctccacctcccgggttcacaccattctcctgcctcagcctcctgagtagctgggactacaggcacccactaccacgcccggctaattttttgtatttttagtagaggtggggtttcaccgtgttagccaggatggtctcgatctcctgacctcgtgatccgcccatctcggcctcccaaagtgctgggattacaggcgtgagccactgcacccggccagatgaaagctttaacaataggctagactaagcagaagacagacagaaaataggatcccagtgccttttggcttgtaaactttcttctgagaagtcggctgttagtctaatgtgatttcctttataggtgatttgaaaattgtctcttgcttctttcagagtattttccttcaagttgcctttggatagtctggtgaagttcatcttgcaaaatattttcaggtattttccgagcttctcgtatctggatgtgtacctctctagcaaggccaagacaatttttctgattattccctcaaatatgtttccaatctttttaccttttcctcttctctctcagaaatgcctacaactcataagtttggttgctttacataatttccgatttattgaactcttgattatttatttaaatttacttttttttttgtctgtgttagttcaaaaaacctgttttgttttttgaaaagataagaaaattgatatggtgctaggccgggcacggtggctcacgcctataatcctagcactttgggaggccaagacaggtggattgcctgagctcaggagttccagatcagcctgggcaagatggtgaaaccccgtatctactaaaatacaaaaaatcagctgtgcatggtggcaggtgcttgtaatctcagctactcaggaggctgaggcatgagaattgcttgaacctgggaggcagaggttgcagtgagccaagatcgtgccactgaaccccagcctggacaacaaagcaaaactctgtctcaaaaaaaaaaaagaaagaaagaaaagaaagaaaattgatatggtgctagctagattaaccaagaaaaaagacagaagattcaagtaagcacaagcacaatcagaagtgataaaagtgacattacaactgataccacagaaaacaaaagatcatcagagactaatatgaatatctctatgcatacaaactagaaaacctagataaaatggttaaattcatccctccctgctcggatgtggctggagctggaggtgcagagggccagagatgctgcagaccttccacccagagcagcttggaggcagtgaataacagctcttcaagtctgcaacaaaaaatggcctcttccagagaattgtttgaacctgggaggcagaggttgcagtgagccgagatagcgccactgtgctccagcctgggtgacagaacgagactccatctcaaaaaaaaaaaaaaaaaaaaaaaagcctcttcatagcttaaattacaaaagtaaactaaaagacttacatgcttttggccaggcgcggtggctcacgcctgtaatcccagcactttgggaggccgaggcgggcggatcacgaggtcaggagatcgagactatcctggctaacacggtgaaaccccgtctctactgaaaatacaaaaaattagccgggcgtggtggcgggcgcctatagtcccagctactcaggaggctgaggcaggagaatggcgtgaacccgggaggcggagcttgcagtgagcagagatcgcaccgctgcactccagcctgggcgacagagcgagactctgtctcaaaaaaaaaaaaaggacttgcatgtttttttctttactccaactcattccttacatgtaggctcaatcttttcagtatttgctttactggttcagcaaaagccaggaaatacaactttgtggtaatcagaatgttatccaactgtatatatatatatatatatatatatatatttttttttttttttgagacggagtctcgctctgtctaccaggctggagtgcagtggcgcgatctccgctcactgcaagctccgcctctcgggttcacgccattctgcctcagcctcccgagttgctgggactggaggcgcctgccaccacacctggctaattttttgtatttttagtacagaaggggtttcatggtgttggccaggatagtctcgatttcctgacctcatgatccgcccgccttggcctcccaaagtgctgagattacaggggtgagccaccacgccaggccccaactgtatattgtttaccttattgtaaatattggtgaacagtggtcaataatagttttatattcctttaaaaaaaaagaaaatgggtaaatacctggaaacatacaacctcctaagactaaaccaggaaaaaatagatatcctaaatagaccaataacaagtaatgaaattgactcactaataaaataatttcaaacaaataaaaacaagaacagataggtttacagccaaattttgccacaagtataatgaagagctggtaccagtcttactgaaactattccaaaaatttatggaatttttggattggaagaatcaacatcattacaaagaccacactaactaaagcaatgtacaaattaaatgcaattcctatcaaattaccaatatcattttttcacagaattagaaaaaacgatcctaaatatcatatggaaccaaaaaagcattcaaatagccaaagtactcctaagcaaaaagaactaagtcagaggcatcatgtgtctgacttcaaattatactataatgctatactaaaaaaaacagtatggcattggtacaaaaacagacagattaatggaatggaataaagagtccattgctaggaaggatacagcttaaaaagggagaaaaaaattgtgaaagaaaagagaataaagaaccagtaataaaatcacatgcctacaaccaagtgatgtttgacaaagttggcaaaaataaacagtggggaaagagcattctattcaataaatggtgctgggaaaattggctacccataggcaaaagaatgaaactgaattcccatttctcatcatatacaaactttaactcaagacgtattaatgacttaaatgaaagaccagaagctataaaaatcctagaagaaaatttaggaaaaactcttctagatattggcctaggaaaataattcataacttagacctgaaaaggaaatgcaacaaaaccaaatatacacaaatgagacttaaactaaagagcacagcaaaagaaataatcaacagagtaaacagacaacctacacaataagaacaaaatatttgcaaactttgcatctgacaaagaactaatatccagaatctaaaaagaacacaaacaactcaacaacaacaaagaataaacaacctcattaaaaaagactgcaaaggatatgaacagacatttctcaaaagaagacatacaagtggccaccaaacacatgaaaaattgctcaacatcaccaatcatcagagaaatgcaaattaaaaccacaataaaggcagggcgcagtggctcacacctgtaatcccagcactttgggaggccaaggcgggtggatcacctgaggtcaggagttcaagaccagcctgaccaatatggttaaaccccatctctaccaaaaatacaaaaattagctgggcatggtggcaggcacctgtaatcccagctactcggaggctgaggcaggggaatctcttgaacccaggaggcagaggttgcagtgagatgagatcataccactgaactccagcctgagtgacagggcgagactctgtctcaaacacacacacacacacacacacacacacacacacacacacacaaaataagatataaacacaacagatgttggtgtgaatgcagagaataatgaatgcttattcactgttggtgggaccataacaacctctatgaaaaacagcatagagatttctcgaagcactaaaaatagagctaccatttggcccagtgattatactactaggcatctgaaagaaaagaaataattatataaaaaagtcactttcactcatgtgtattacattcctactcataatagtaaagtcatggaattaacctaaatgtccattaacagtggactggatttattttaatatggtatatatacaccatggaatactatgcagccataaaaatgaaatcatgctctgtgcagtaacatggatggagctgggggccattatcctaagtgaaataactcagaaacagaaaatcaaataccacatgttctcataagcaggagctaaacaatgagtacacaaggacataaaaatggaaacaatagatagtgagactccaaaagggagagactgggaggaggccgatggtcaaaatattatctattggtagtgagatgtgatcacgccactgcacaccagccagggcaacagagtgagatcatgtctcaaaaaaaaaatgatctgttgggtacaatatttactatttcaggatagttacactagaagccaaacctcaccattatgcaatatatctatttgacaaatatgcacttataccctctgaatctaaaataaaaaacaaaggaattctatagtagtaaacacctacatctttttttaaaaaaagatctcgcctgtgtggtggctcacgcctgtaatcccagcactttgtgaggccgaggcaggcagattgcccaaggtcaggagttcgagaaagcctggctaacatggtgaaaccccatcctactaaaaatacaaacaaattagccggatgtggtggcgcacgcctgtagtcccagctactcgggaggctgagggaggagaatcacttgaacctgggaggcagaggttgcagtgagctgagattgcgccactgcactccagcctgggcaacagagagagactccgtctcaaaaaaaaaagatctcaaataaacaacctaactttacacacacacaaacacacacacacaaatagcagaaggaaagaaataacaaagattagagcataaataaatgaaatagagaataaaaaaaattttaatcggccaggcacggtggctcacacctgtaatcccagcagatctcttgaggccaggagtttgagaccagcctggccaacatggtgaaaccctgtctgtactaaaaacacaaaaattagccaagtgtggtggcatgctcctgtaatcccagctacttgggaggctgaggcaggagaatcacttgaagccgggagatagatcttacagtgagccgagattgtgccactgcactccagcttgggcaacagagtgagactctgtctcaaaaaagaaaacaaaacaaaaaattaatcaatgaagctaagagttgatttggggaaaaaaactcaaaatcaaagcccttacttagactaagaacaaaaagagagaatatgttaataaaataagaaatgaaagagaagacattacaacttattacagaagtttatttcttacagaaataaacagaattataagggactactatgaacaattatacaccaaccaacttgacaacttagaagaaatggtgaaattactagaaacatataaactaccaagatggaatgaagaataaatagagagcttaaagagaccaataacaaatagagaaactaaagaagtaatttttcaaaactccaaaatatagcctaggaccagattacttcatgggtaaattctaccaaactttcaaagaaaatttaatataaaacatcctcaaattctttgaaaaaatagaaaaaagaggtaacaccttcagagtcattttatgaggcagcatccccttgatatcaaagcaagaaaacacactttcaagaagaaaattataggccaatatccttgaggaacatgctgtatgaattaaatctaaataaatctgtttacaaagaatcgattctcagcagaagctttacaaaattaaaaaaattaaaaattctcacactggattctggataaacactcatttctagcctctttgtcagatatgttactgaaacttacactaactgaggagttcgcttgagcagcagtttcttcatctgttgggagctgatatatctggatgccattgctaatcaattcactcattatcttattcttaaacgtctgtaaatcatttttagaaatagtgtctgctttggcaatcagtggtataatattcacctatgaagaaagaagacaaacaaaatctcatcattgttcatctcacagtttttttgttttttgttttttgttttgagacggagtctcgctttgtcgcccaggctggagtgcaggggcacgatctcggctcactgcaagctccgcctcctgggttcacgccactctcctgcctcagcctcccgagtagctgggaccacaggcacccgccaccacgcccggctaatttctttttgtgtttttagtaaagacggggtttcaccgtgttagccaggatggtctcaatctcctgacctcgtgatccgcctgccccggcctcccaaagtgctgggattacaggcgtgagccactgcgcccagccatcctatagtttttatagtaaagccttcacaatctctgacaacaaattgcataactaggtaatcactggctgtcatgcttttcttaaaaattattttccaaaattatcaatacttttgaagattgatcttttatccaaattcaggtttagaagtctcaaccttgtttctcttctaaaaatcccttatacctctacacatatggagttagtaaaatgtaaatagtaggacaatgtaaattattttatttatttatttatttatttatttatttttcagacagagtctggctctgttgcccaggctctggagtgcagtagcgcgatcttggctcactgcaagctccgcctcccaggttcatgccattctcctgcctcagcctcccgagtagctgggactacaggcgcccaccaccatgcccggctactttttggtatttttagtagagacggggtttcaccgtgttagccaggatattctcgatctcctgacctcgtgatccgctcgcctcagcctcccaaagtgctgggattacaggcctgagccaccgtgcctggtctatttaatttattttcaattttatttcttattaagctgagtgataaaagacaaattcaaagaactttcctcaaaattgtggaagggattttgtccttctactttttacatcactttttccatcaatcaatcttaattaatgtcccattttcactctcttgccccgcctagatgtgtttgcagatagatttgctattgtttttcaaagaccacctaaaaagaatatagatgtttttgattaccatattctttctttttttgaggcggaatcttgctctgtcgcccaggctggagtgcaatggcgcaatctaggctcagggcaacgtctgcctcccgggttcaagcaagtctcctgcttcagcctcctgagtagctgggattacaggtgcccgccaccatacccggttgatttttgcatttttagtagagacagggtttcaccatgttggccaggctagtctcgaactcctgacctcaggatacaaccacttcagcctcccaaagtgttgggattataggcatgagccaccacacctggcctggttaccatattctaaaggccgtgtgtgtatgtatgtgtgtgtgtgcgcgtgtgtgtgtataagaacaccttgcaaacaaatatgttcatttttcttttgtaaaaagacataatttccacattgaaagttaaatatttgcatatttgaggttgaatttttacccacaaagttttttcctagtgcttcaatatgagcactcctgccttttgcatttgcacttaaataactaaactttttaggaaataacaatatacaaaattatataatgttttattactgttaaaatatcttattaaattatagctccacaaaatcaatatctgtaatatagtagaaatacataaatataaattttaggcagactgcttttgttttagattgctcaaaacacgttttttaaaaaatccatggacagaccgggcgcagtggctcacgcctgtaatcccagcactttgggaggccaagactggcagatcacctggggccaggagttcaagaccagcctgaccaacatgaacaaaccccgtctctactaaaaatgcaaaattagccaggcgtgttggctcatgcctgtaatcccagctactcaggaggctgaggcaggagaatcgcttgaacccaggaggcagaggttgcagtgagccgagattgcgccattgcactccagcctgggcaacaagagcgaaactccgtctcaacaacaacaacaacaacaaaaagagtgtatattcctgactattgaaggtactactaattaagaacttgaagcagctcttaatttaactagaaatctaatttatttcaactacttaatgacatctgagattaagtacaaagtctcttttcagtttgaacaatatatagtaaaagttgagattcctcggataaaaggaacccaacttagaactttttctctcttcaactaaataaagatgtcttcaactaatttaagttgaagacagcatgttttgttagggctgagtgcagaaaagaatctgataatatgacaatttcctttatatgtatattgcttttctatatttaaaaaagaaaatatacttttaaccttttttttttttttgagagagagagagagagggtcttgatctgtggccctgtctgcagtgcggtggcatgatcacagctcactgcagcctcaacctcccgggctgaagcgatcctcccacctcagcctcctgagtagctggaactacaggcacgtgctgccatgcctggctatttttttgtattttttgtagagacagggtctcactatgttgttctagctggtctcaaacttccaggctcaggcaatcctccctcctcagcctcccaaagtgctgggattacaggcgtgagccaccatgtctggcccttctaaattttttatgaaaaatgattttagacttatggaagagttgcatgaatattacagagaaagaaattgaggcatcataattttcccaaagccacacagtgagcaagtaacagggtcaggtttgtgaaagcaggcagcttgaacccactacccatgcttttttatttatttttttttttggagacagagtttcactcttgttgcccaggctgaagtgcaatggcgtgatctcggctcaccgcaacctctgcctgcgggttcaagcaattatcctgcctcagcctcccgagtagctgggattacaggcatgtgccaccacgcccagctaattttgtattttttagtagagacagggtttcaccatgttggtcaggctgttctcaaactcctgacctcaggtgatctacctgtctcggcctcccagagtgccgggattacagggtgagccctggctcccagccctccccatgtttttaatcacagaaagcgctagacatttttcccaaggtcacagacacctagcaagtgataaagcaaatattcaaaagctgcttccactgacaagtcctgtgacctttacatattcaaaaattaaaattccttctgtatggataaatctgagcttcataaacattcaacggactgattttctgtacaataaaaccaaactacaaaaaactgctgaataattagaaa

SEQ ID NO: 1853 - DNA, 12212 bp, Homo sapiens
tgaccacttaatgagcagttaacatgtatgtaagcagtttgctatagtgatgaagaaaaagttcataacatgtccatacaaagatattaattctaaaccaataataaggctcatgctttactctatggttatgtaaaatgtaaacatagaggaaagctgggtgcatccgacaggggactagtatccagaatatacaaagaatgcaagcaactaaacaacaacaacaagaagaacaaataatcccattaaaaagtgggcaaaggacatgaatagacatttttcagaacaccaaaatacaaggcaaaaccacaatgagatatcatcttatctcagtcagaatggctattgttaaaaagataaaaaatggccgggcgcggtggctcacgcctgtaatcacagcactttgggaggccaaggtgggtggatcacgaggtcaggagttcaagaccatcctggctaacacggtgaaaccctgtctctgctaaaaatacaaaaattatctgggtgtggtggcaggcgcctgtagtcccaggtactcaggaggctgaggtaggagaatagcatgaacccaggagacaaagcttacagtgagccgagatcgcgccactgcgctctagcctgggcaacagagcaagactccatctcaaaaaaagacaaaaaataacaggccaagtagagtggctcatgtctataatcccagcactttggaaggccaaggtaggaggatcacttgaggccaggagtttgacaccagcctgggcaacatagcaagaccccatctatacaaacaatttttaaaattagccaggcatggtggcatgtgcctgtagtctcagttactcaagaggctgaggtggaaggattcacttgagcctgggaggtcgaagctgcagtgagccaagcttgtgccactgcactccagcctgggtgatggaatgaaaaactgtctcaaaaaataataataaaaataattaaataacataatttggcaagggtacacagaaatgggaacccttagacactgttggtgggaatgtaaattagtacaacgtctacggaaaatttgtacaaataaagttaaataaagaaataaggaaataagctaaaactaatagaagctatatttaaaattttttgctataactggctaaataaaaatcttgtaagaaagtcaattatatacaaaagtattaatcttataagaaaagaacattacttaggaaaatattaaaatctggaagaaaaggtattacttacacaaattagtctatggcaaaggaagtcaaattccttgaaataagaaaaccttttttaatttaaataagaaaacactcacctggcttctttgtctatttgatcaccataccctactgtctccacaacagtcaatttcaactgaacattgctttcctgaagttcatatgtctgaatttgaagtccaacatttgagtaaaaatgtgaggatttgttatctttcaagttagtattaaacaatgtgtctatcagtgtcgattttccaattccagtctcccctgtaatagacatagagtcattgtcatagggacataaaggggctaagaaaaagcaacactttgaattcctacggtggtttttaaaatcttagaaagttgaactcatagaagtagagagtagtattctggctaccagaggctgggggagcaggagaaaggaaaggtggagtagttggtcaaaggtacaaagtttctttttttttttttacttttattttaggttgggagtacacgtgcaggtttgttgtatcagtaaactcatgacatgagggtttgttgtacagattatttcatcacccaggtactaagcatggtaaccaatagttattttatctgatcctctccctcctccaaacctccaccctcaagtagacaccagtgtctgttattcccctttttgtgtccatgtgttctcatcatttagctcccacttacaagtgagaacatggcacatgttctcagccataaaaaagaaggagatcatgtcctttgcaggaacatggatggagctggaggccatcatccttagcaaaccatcagagctcattgtagcgctattcacagtagcaaagacatggaatcaacctaaatgttcatcaatggtagactggataaagaaaatatggtacatatacaccatggaatactacacagccatgaaaaagaatgagatcatgtcctttgcaggaacatggatggagctagaggccatcatccttagcaaacagtttcaaacaggagtagaaataagttttgagatctattgcacagcagagtgactatagtcaatgtattgtatatttcaaaataatcaagagagttaatttcaaatgtctcatcataaaaaaatgataagtaaaccgggtaatagatacattaattcacttgattgaatcattccaaattgtaaacatatagcaaaacctcacattgtatccatacatgtaaataactatgatttttcaattaaaaataatattaattttaaaaataaataaagggtctcaaatacttcaaagactgggatggccttgaaaatatacatgctaggccgggtgcggtggctcacgcctgtaatcccagcactttgggaggctgaggcgggcggatcacgaggtcaggagatcgagaccatcctggctaacatggtgaaaccccgtctgtactaaaaatacaaaaaattagccgggtgtattggcgggcgcctgtagtcccagttacttgggaggctgaggcaggagaatggcatgaacctgggaggcggagcttgcagtgaaccgagattgcaccactgcactccagcatgggcaacagagcaagactccgtctcagaaaaaaaaaaaaaagtatatatatatatatatatatatatatgtatacatgctagccctgattctctcagtcattaacataatggaaaaagaaagtatatactaagctacatcagacttttaagagcacaggaatgtgtcaatttttaacaatcactacaggtcgagtgtggtgtctcatgcctgtaatcccagcactttgggaagctgaggtgggcagattgcttgagcccaggcggctgaggctacagtgagccataatcacaccattgcactccagcctgggcaacaaagtgagaacctgtctcaaaaaataaaaggattacataatatggctaagatgagaatcactgtaaacatgaagatatatttgaattaatagcatcaatgttacactgcttaagataagttgaaatgaacattgggaaaaatgaaggaataattcaaatgaggtgtttgacacttacccacacagagaatattaaaagtgaatccttgtcggatagatctgctcaccaactgattgggcaaacattcaaaaccaaaatgtccaatcgtagttaaacaacgaatattattttctttttgcttaaataaaacaaaaatttagagttttgtgttagaataaaaaatgaagtcatttgaaaggaaaatgattatagtacatcaaataaattagaattgattatcatttgcttatcatacctcagacaagatgcaaatatattaagtaaatttgtgaaaatagaagtctgtgttcaaacacatagatttggctattatttttataaataaagtgaatctatctctcagcacactcaaagaggctctgtttctaaattttaaaagagacaggggacaggcacggtggctcatgcctgtaatcccagcactttgggaggctgaggcaggcggatcatgaggtcaggagttcgagaccagcctggccaacattgtgaaaccccatctctactaaaaatacaaaattagccgggcatgcttgtactaaaaatacaaaattggtggtgcatgcttgtaatcccagttactcaggaggctgaggcaggagaatcacttcaacccgggagggggaggttgcagtgaggcaagagcacaccactgcactccagcctgggtgacagagtgaaactctgtctcaaaaaattaattaattaattaaatagggaattaaggaaatactacaagaaactctaatgtattactgtaacataataaattatttcttccataagaaaaaagaaaaaaactttaacatcctttcattctgctgcagcgtattaatatattgagaaaatcccacacatgttaatccagatgcttctcaacttatgatgaggctatgtcccaagaaacccctcctaaattgaacatattgtaagtcaaaactgcatttaacacacataacaaaactgaacattatagctcagctttgcctgccttagacatgctcagaacacttacattagcctacagttgggcaaaatcaactaacacaaagcttatgttataataaagtattaaatatctcatgtaatttatcaaacaaagtgaaaaacagcactattatagagtcaacaatttaagttgaatgattgtaagctggagatcctctacatatgtgaggaaaccaaaatcaatttgaaatttttaaaaaatcaaatgatgtatacttcagatttgttatataccctctgaggacttgtgttatatcgaagaaatctactactaataacaccattctagaaaattagaaatccatcagtattacacacaaagttaccaactgatcatttttaaaaggttaaaagatcattcattttttatttttaagtacttctattttaaaaatgggaattatacaaccccctgcacaactataaacacattaaataccactttgcaatgacagctcagcatacttcacagttcttaacactattttatgaggaatacaaaatacctttttatttaaattaacccgctttaaaaatgttttagtatatgtgagaataaaggaattataaatcagtaggaaagattttaaggtagaagcatcaacaatcagctcagtagatgttgtctacatttattttgtacctttataaaacaagaacatgctaatcggcctgggaggcagaggttgcagtaagctgagatctcgactcactgcaacctccatcacccgggctccagcaattttccagcctcggcctctagaaaagctgggactacatgcatgcgccaccatgcccagccaatttttgtattttttgtagagaaggggtttcaccatgttggccaggctggtctcgaactcctgacctcaggtgatgcgcctgcctcggccttccaaagtgctgggattacaggtgtgatccactgcacctggctaatttttgtatttttgatagagacggggtcgcaccatgttgcttgggctggtcttgaattcctgagctcaaacaatcctcctgccttagcctccaaagggctgggattacaagcttgagtcactgagcccgatctactaacagagatttttttttttttttttttttgagacggagtctcgctctgtcgcccaggctgcagtgcagtggcacgatggctcactgcaagctccgcttcccgggttcacgccattctcctgcctcagcctcccgagtagctgggactacaggcacctgccactacgcccggctaattttttgtatttttagtagagatggggtttcaccgtgttagccaggatggtctcgatctcctgacctcgtgatccgcccgcctcggcctcccaaagtgctgggattacaggcatgagccaccgcgcctggcctactaatagagattttaaaacagctattataaatgtgcagagacataaaggaaagtgtgcatacacaatgagtaaaaagacaaaaatcccaggagaaaaacaaaaattataaaattaagataaaagcagaaagcatggccaggcacgttggctcacgcctgaaatcccagcagtttgagaggctgaggcagaaggatcacttgaggttaggagttcgagaccagcctggccaacatagtgaaaccctgtctctactaaatatacaaaaatgaacccggcatggtggcaggagcctgtaatcccagctactcgggaggctgaggcaggcgaatcccttgagccagggaggcagaggttgcagtgaactgaaatcggaccactgcattccagcctgggcaacagagggagactacatctcaaaaataaataaataaaagcagaaagcaaagaaataggaaataggtcttagaaaaaattaaataagcaaaaatttgctgctttgaaaagattgataagattgataaacacctagctggactaataaaaacacccaaaacagccaggcatggtggctcatgcctgtaatcccagcactttgggaggctgaggcagggagatcacctgaggtcaggagtttgagaccagcctgaccaacatggaaaaaccccgtctctactaaaaatacaaaaattagccgggcatggtggcacacgcctgtaataccagctactcaggaggctgaggtaggagaatcacttgaacctgggaggcagaggttgcggtgagccgagatcgcaccactgcactccagcctgggcaacagagcaagactccatctcaaaaaaacaaaaaacaaacaaacaaaaaacacccaaaacacaaattgctcatagcagaagtgggagaatattactacagaccacacagataacaaaattagactactgtgaacacattgatgaacacattttgccaatgattttgaaataactcttttgccaacaaacttgaaaataaataaatttcattgggaaaaaaaacaaattataaaaatgacacaatgggaaataggaaatctaaatagtcatatatctattgaagaaattatagccaaaaacctttccacaaagaaatcttcaggccctgctgatttcactattgaattctatcaacaagcagttaaaagaaaaattcacacaaactctctacaaaacagaagagggggtagttttttccaatgtattttatgaaaccagatataatggcaatataaacacctgacaggccaggggcggtggctcatgcctgtatcctagcattctgtgaggttgaggtgggttggatcacctgaggtcaggagttcaagacaacctgaccaacatggtgaaactccatctctactaaacacaaaaaattagccgggcatggtggcacgtgcctgtaatcccagctacctgggaggctaatgcaggagaatcccttgaacccaggaggcagaggttgcagtgagctgagattacaccatgcactccagcctgggcaacagagtgagactccatctcaaaaaaacaaacaaacgaacaaaaaacacctggcaaagacatcacaaaaagagaaaattatacattaatttctgtcatgtgcatagctgcaaaaattcttttttactactataattttaattgtacaactagtaagtgtgcaaataaatttttcttaacaactgaaatattgaaatggaagataatattccatttaactattccccacatcctatctccttcctcttttccctatttttatgatttttaggattctagacattaaaaaatacttttatatacacaaatatagaggtattaaattttaaaaacacatacatggccaggtacagtggctcacgcctgtaatcgcagcactttgggaggttgaggtgggcagatcaccagaggtcaggagttcaagaccagtctggccagcgtggtgaaacccggtctctactaaaaatacaaaaaaaaaaattagccagtcatggtggcggaggcctgtaaccccagctactcaggaggctaagagaggagaattgattgaacccgggaggcagaagttgcagtaagccaagatcgcgccattgcacgccagcctgggccacaagagtgaaactcttgtctcacaaaaaaaaagcaaacattctgcaacttgcttttttctactaaaattctatacatgttaatcagctagctttattgaggaataatttatatgtaataaaattcaccaactttatgtgcacaatttgataaattttaacaaatgtgtatagtaatgtaatcaccatcatgatcaccatatagaacatttctgacatccctaaaactttccctattagcccctattcagtcaatttgtaaccctcatccctcagccctggcaacctctcatctgttttcagttgctatagttttactttttctagaatttcatttagaagaaatcatactgcatggagtttttttttttatcttaacaaaacattaccaatcaattcacttgtatataaaaaagattatagattaaaacaattggcatttattctagaaatgcaaggttaattcagcactcaaaaatcaataaatgataaactataaaatactgatgcaagaaattgaaaaggacacaaaaaaatgaaaagatattccacgtgtatggactgaaagaatcaatatcattaaaatgttcataccaccgaaagcaatctacatatttaactcaatccctatcaaaataccaatgacattctccacagaaatagaaaaaataggccgggcgcggtggctcacacctgtaatcccagcactttgggaggccgaggtgggtggatcatgaggtcaggagatcaagaccaacctggctaacacggtgaaaccctgtctctactaaaaatacaaaaaagaggctgggcgcagtggctcacgcctgtaatcccagcactttgggaggctgaggcgggtggatcatgaggtcaggagatcgagaccatcctggctaacacagtgaaaccccgtctctactaaaaatacaaaaaattagccaggtgtggtggtgggtgcctgtagtcccagctactcgggaggctgaggcaggagaatgacgtgaacctgagaggcagaggttgcagtgagccgagattgcgccactgcactccagcctgggcaacagagtgagactctgtcaaaaaaaaaaaaaagaagaagaaaagaaaaaagaaatagaaaaaataatcctaaaatttatacgtacccacaaaagacacagaatattcaaagcaatgctgagtactctgggtacactgaaggaatcacattacttgacttcaaattataatacagaactacaataaccaaaacagcatggtactggcatgaaaacagacatatagaccaatggaacagaatacagaactcagaaataaattcagacatgtacagtgaactcatttttgacgaaggtgctaatagcatacagtggggaaagaagagtctcttcaataaattgtgctgggaaaattggatatccatatgtaaaagaatgaaaacagactcctatctcttatcatatataaaaatcaaataaaaatgaattaaagacataaatctaagctgtgaaactatgaacctactaaaagaaaagattggggaaactttccaggacattgacctgggcaaatatttcttggataatgccccacaagcacaggaaaccaaagcaaaaatggacaaatgggatcatatgaaattaaaaagcttctacacagcaaagaaagtgatcaacaaagtgaggagacaacccactgaatgggagaaaatatttgcaaactatcccccgataagggattaataaccagaatatgtaagaagctcaaataactcaataggaaaaaatctaataatccaatttaaaaagtggcaagtgattggaatacacttgtctcaaaagaagacatacaaatggcaaacaggtatataaaaaggtgctcaacatcattgaccatcagagaaattccaatcaaacctacaatgatatatcatctcacctgagttaaagtggtttttacccaaaagactggcaataacaaatgctggcgaaaatgtggaaaaaaagagaaccctcttacactgttggtgcaaatgtgaattagtatggagaacgtatggaggtacctcaaaaaactaaaaatagaactacctatgatccagcaatcccactgctaggtatatacccaaaagaaagaaattagtacattgaagagatatctacactcccatgcttattgcagcactattcacactaggcaagatttggaagcaacctaagtgtccatcaacagatgaatggaccaagaaaatgtggtacatatacacaatggaaaactattcaatcatcaaaaagaatgagatcttgttatttccaacaacatggatggaacctaacattatgttaagtgaaataagcaagtcatggaaagacaaacttcacatgttctcacttacttgtgggagctaaaaattaaaacaattgaactcatagagatagagagtggaaggatggttaccagaggctaagaagggtagtgggggtggtgaggggatggttaatgggtacaaggatatagttagatagaatgaatagggcccagtatttggtagcacaacagggcgactatagtcaacaataaattgtacattttagaagaatgaagagtacaattgaaatgtttctaacacaaagaaatgaaaaatacttaaggtagtggatactccatttatcctgatatgattattacacattgtgcgcctataacaaaatatctcatatgccccataaatatatagacctgctatgtacccataaaaattaaaaagtaagggctgagcgtggtggctcatgcctgtaatcccagaattttgggaggctgaggctggaagatcgcgtgagctcaggagttcgagaccaatctgggcaacatagtgaaaccctgtctctactgaaaataaaaactaaaaaaatagcagagtatggtggtacatgctcgtcgtcccagctactctggaggctgaggcgggagaatcacttaagcccaggagttagagtttgcagtgagctatgattgtgccactgcgctgcagcctgggtaaccgagtaaaaccctgtctcaaaaaaaaaaaatttaaaaatcaataaacatatttcaccatattaatagtataaagtaaaatcaccatatgactgactcaataagtgaaaaatattatatttgatgaattgaattgaatacccatttgtgatttttaaagtctattagtaaaataagaattaaagagaacttcatcaatctgataaaaactgtattagaaaaaaatttaaatctaacatcatacttaatagtaaacatctgagtgctttcttcacaagattgaaaataaagcagagatgtcagctgttgccattttatacattgtactggaggttctttttttttttgagacggagtctcgctctgtcgcccaggttggagtgcagtagtgcgatctcggctcactgcaagctccgcctcccgggttcacgctattctcctgcctcagcctcctgagcagctgggaccataggcacccgccaccacgcccggctaattttttgtatttttagtagagatgggtttcaccatgttagccaggatggtctcaatctcctgaccttgtgatccgcccacctcggcctcccaaagtgctgggattacaggcgtgagctaccacacccggcctgtactggaggttcttaccagtcaataaggcaaacaaaaagcataaatattcaaaagagtttgtcattttatattgaaaaaaggtagaaaatatacaagaatctacagagcatctaccagaactactaagagaacatatcaaaattacaagatacaaagtcaatatacaaaaatcagttatattcatttctagcttctgctcagagatgtggagagcagaaaaaagacatcactactaatactataggaataaaataatgaactaaggcaagatcacaactttttttttttttttttttgagacagagtctcgctctttcgcccaggccggagtgcagtggcactatctcggctcactgcaagctctgcctcccaggttcacgctattctcctctctcagcctcccaagtagctgggactacaggcgcccgccaccgtgcccagctaattttttgtatttttagtagaggtggggtttcaccgtgttagccaggatggtctcgagctcctgacctcatgatccacccgcttcggcctcccaaagtgctgggattacaggcgtgagccacggcgcccggtcagatcacaactttttaaaaactcatcctagtactgacgtttcaggtcgaccaattgttccagaatcgaaggagagacagaaacccacagga

SEQ ID NO: 1854 - DNA, 6971 bp, Homo sapiens
actagcatgattttcatcaatgcttcagtaatctattctttatatcagaagggtgaaagtaaacatatcaagtttttttttttgtttctgggaggactcataagatatcccataagtgtggtaatagcagtttttattccacctatttcctttaaatgatagtaaaaagctccatgagtaaatatattgtctgattttctactcttatgtattgttgattaagtcctttaaaaactttatttttagattaacttgtacaatggacttttttttgtatacattctatgaattttaacacacctatagattagtgtaataaccactgccacagccaggatgcagaacagttccataaccctgaaaattcctgtgtgccatccctttgtagtcacagcctcctcccaacccttaaacgctggcaaccactgaccttttatcactgtgttttgtgcttttaagaatgtctcacacatagcaatatgaaccttaaatgtaaatgggctaaatgccccaattaaaagacacagactggcaaattggataaagaatcaagacccatcagtgtgctgtattcaggagactcatctcacatacaaagacacacataggctcaaaataaagggatggaggaatatttaccaagataatggaaagcaaaaaaaaaagcagggattgcaatcctagtctctgataaaacagaattttaaccaacaaagatcaagaaagtgtaagaagggcattacataatggaaaagggatcaacgcaacaagaagagctaactatcctaaatattatatgcacccaatacaagagcaccaagattcataaagcaagatcttagagacctacaaagagacttagactcccacacaataatagtgggagactttaacaccccaccgtcaatattagacagatcaacgagacagaaaattaacaaggatattcaggacttgaacttagctctggaccaagtggacctaatagacacctacagaactctccaccccaaatcaacagcgtatacattcttttcagcaccacataacacttattcagaaattgaccacattattggaagtaaaacactcctcagcaaatgcaaaagaatggaaatcttaatggtctctcagaccacagtgcaatcaaattagaactcaggattaagaaactaactcaaaactgcacaactacatggaaactgaacaacctgctcctgaatgactactgggtaattaacaaaattaaggcagaaataaataagttctttgaaaccaatgagaacaaagacacaatgtaccagaatctctgggacacagctaaagcagtgtttagagggaaatttatagcactaaatgcccacaggagaaagcgggaaagatctaaaatcgacaccctaacatcacaattaaaagatctacagaagcaagaacaaacaaattcaaaagctagtagaagacaagaaataattaagatcagggcagaactgcaggagctggagacatgaaaaacccttcaaaaaatcaatgaatccaggagctggtttcttgaaaagattaacaaaatagatagaccactagccagactaataaagaagaatcaaatagacacaataaaaaatgataaagcagaaatcaccactgatcccacagaaatccaagctaccgtcacagaatgcaataaacacctctatgcaaatcaactagaaaatctagaagaaatggaaaaattcctggacacatacaccctcccaagactaaatcagcaagaagtcgaatccctgaatagaccaacaataagttctgaaattgaggcagttattaatagcctaccaaccaaaaaaagtccaggaccagacagatacacagtcgaattccaccagaggtacaaagaggagctagtaccattctttctgaaactgttccaaacagtagaaaaagagggaatcctccctaactcattttatgaggccggcatcatcctggtaccaaaacgtgccagagacacaacaaaaaaagaaaatttcaggccaatatccctgatgaacattgatgcaaaaatcctcaataaaatactggcaaactgaattcagcagcacatcaaaaagcttatccacaacaatcaagtcagcttcatccctgggatgcaaggctggttcaacatatgcaaatcagtaaacataatgcatcacataaacagaaccaaaaacaaaaaccacatgattacctcaatagatgcaagaaaaagcctttgataaaattcaacacccttcatgctaaaaactctcaataaactaggtattgatggaatgtatttcaaaataataaaaggtattcatgacacacccacagctaatatcttactgaatgggcaaaaactggaagcattcccttgaaaactggcacaagacagggatgccctctctcaccactcctatttaacatactattgcaagttctgatcagggcaatcaggcaagagaaagaaagggtattcaaataggaagagagacagtcaaagtctgtctgtgtgcagatgacatgattgtatatttagaaaatcccatcatctcagcccaaaatctccttaagctgataagcaacttcagcaaagtctcaggatacaaaatcagtgtgcaaaactcacaaacattcttatacacccgtaacagacaaagagccaaatcatgagtgaactcccattcacaattgctacaaagagagtaagatacttaggaatacagctagcaagggatgtgaaggacctcttcaagaagaattacaaaccactgctcaaggaaataagagaggacacaaaaaaatggaaaacaaattccatgctcatggatagggagaatcagtatcatgaaaagggccatactactcaaagtaatatgtagattcagtgctatccccatcaagccaccattaactttcttcacagaattagaaaaaactactttaaatttcatgtggaaccaaaaagcccgtatagccaagacaatcctaagcagaaagaacaaagctggaggcatcatgctacctgacttcaaactatagtacaaggctacagtaaccaaaatagcatggtaccggtaccaaaatagatatatagaccaatggaacaaaacagaggccacagaagtaatgcctcagaagtatctacaaccatctgatctttgacaaacctgacagaagcaagcaatggggaaaggattccctatttaataaatggtgttgggaaaactggctagccatatgcagaaaactgaaactggaccccttccttacaccgtatacaaaagttaactcaagatgcattaaagacttaagacctaaaaccataaaagccctagaagaaaacctaggtaataccatttaggacataggcatgggcaaagacttcatgactaaaacaccaaaagcactggcaacaaatgccaaaattgacaaatgggatctaattaaactaaagagcttctgcacagcagaagtgaacacatcagagtgaacaggtaacctacagaatgggagaaaatttttgcaatctacccatctgacaaaggtctagtatccataatctacaaagaactgaaacacatttacaaaaagaaaacaaccccatcaaaaagtgggcaaaggatataaaccgacacttctcaaaagaagacatttatgtggccaacaagcatatgaaaaaagctcatcatcactggtcattagagaaatgtaaatcaaaaccacgatgagataccatctcatgccacttagaatggcactctttgaaaagtcaggaaacaacagatgctggagaggatgtggagaaataggaacgctttacattgttggtgggagtgtaaattagttcggccattatggaaaatagtgtagcgattcctcaggcatctagaaccagaaataccatttgacccagcaatcgcattactgggtatatacccaaaggattataaatcattgtactataaagacatgcacacttaagtttattgcagcattgttcacaatagcaaagacttggaaccaacccaaatacccatcagtgatagactggataaagaaaatgtggcacatatacaccatgcaatactgtgcacccttaaaaaaatgatgagttcatatcctttgcagggacatgggtgaaggtggaagccatcattctcagcaaactaacacaggaacagaaaaccaaatacctcatgttctcactcataagtgaacatgttctcactcataagttgaacaatgagaacatatggacacagggaggggaacatcacacagtggggcctgttggggagtgggggtctaggggagggatagcattaggagaaatacctaatgtagattatggtttgatgggtgcagcaaaccaccatggcacatgtatacctatgtagcaagcctgcacgttcttcacgtgtatcccagaacttaaagtatataaaaaaaagaaaaaatagaaaaaaatataaataaaaataatatcatattagtggtatcatacagtatataattttgtgagtctagcttctttcattcagcatgtgaatcatcttttgtgattcattcaagttgtctaatgtagtttttcccttttttgtttctgaatagtgctctgttgtatgtacataccaaatttgtttgttcacctgttgcagaacatttgcattgtttccagtgtctgactattgcagataaagctactgtgaacatgtgtgtataggtttttatgtgaacgtaagtttttgtttctctatggtaattacccaggagtgaaatttctgggtcagattgtaatcgtatgtattattctttaaggacctgccaaactgttttccagagtggctgtactgtttttgattttcacctgcaatttatgaaagtttcagttcagcatcattgtcggcacctcgtattgttattatcttctattttagccattctcataggtgtgtggtagtgtttcattgtggttttaatttctctaatagataatgatgttgagcatcttttagtttgtttattattggctttctgtattttctttggtgaagtgtctgtcttttgcctgttttttaattggatttttgttttattgctgtagagttttgggcattcataaatacattctagatagaagtcctttatcagatgtcatttgcaatgatttttttctggcctgtagcttttctttttattttcttttcagtgtcttttgcagagaaaagggttttaattttgaagtttaatttattattgttttctttttatgtatcatgcttttagtgttgtgtataagaactcttcgcataacccaaagacttgaatattttttcttatattttcttctaaaagctctatagttgtatggtttacatttagagctgagatctctttggatgtaatttttgtgtaaggtgggaggtttatgtcagggttcatgtttttgcatatggatgtccaattttacaacaccatttttttaagagagtgttattctctgttgaattgtctttgtatctttgtcagaaataaatcggccatttttgtgtgagtctgtttgtggactctttctgctgttgatctgtgtgtctatccgtttaccaacatcatactgtcttggttactgtatctttatagtatgtcttaaaattgggtagtatgattctttttcagattttagctattcagctatctttccttttttgtatatattttattttatattttacatcttaccttattttattttattgagacgtgtaaggtcagccgagagaaaggaaaaatagacctaaagtcaggcgcgtaagtttattgaacctgaggggctgcttcacctcactcagaggaggcagccctgagtttacaaaatgaggggtttatattggagaagggagtttgagggagttctttggtgtggccgcattccagggttgtttgctggttaattttgtcacatatcaccttgtgacatttgtggtagcagaactttcaggaaggtgtaggtaaagtttgtttattcttccaacgacctcccgctgtgcggtccagatggttcgtaattggggtttgtttatccagcaaggtctgataagtgaagtctgctggcttcactgtggtgcctagataagggcttagaaatgtaaagaggcttgggggaagggtggacagcacggagacgtttgaggggagcgccaagaagctttatggggcagtttgtctttaagacgcagtctcactctgtcacccaggctggagtgtactggcacaatcttggctcactgcaacctctgcctcccgggttcaaatgattcttgtgcctcagcctcccgaggagctgggattataggcacccgccaccacactcggctaatttttgtatttttagtagagatgaggtttcactatgttgaccaggctggtctcgaactcctgacctcaagtgatccacctgccttggcctctcaaagtgctgggattacaggagtgagccactgcgcctggctgcttttccatgtatattttacaaacagcttgtctgtgtgcacaaaagccctgctgtgattttgattggaattgcattaaatctgtagatcaatatggggagaattgacatctttactacattgagcctttaatttgtgaactccatttatttaaattttctctggtttcttttatcaacgttttgttattttgggcttacagattctatacatgtgttgttagatttatacctaagaatttcatgtttggaagctattgtgttttttaaaaatttttgttttctagttggtcaagttcttttttacaacagtatttttttgatagtaaagttagtttggtacgaaaggctgtgtatactttgaccttcctcctcaaagaattgggcaatttattatgaaagcacatagtgtaaaatatataaaagggcaaaaagtcaagat

SEQ ID NO: 1855 - DNA, 6791 bp, Homo sapiens
actagcatgattttcatcaatgcttcagtaatctattctttatatcagaagggtgaaagtaaacatatcaagtttttttttttgtttctgggaggactcataagatatcccataagtgtggtaatagcagtttttattccacctatttcctttaaatgatagtaaaaagctccatgagtaaatatattgtctgattttctactcttatgtattgttgattaagtcctttaaaaactttatttttagattaacttgtacaatggacttttttttgtatacattctatgaattttaacacacctatagattagtgtaataaccactgccacagccaggatgcagaacagttccataaccctgaaaattcctgtgtgccatccctttgtagtcacagcctcctcccaacccttaaacgctggcaaccactgaccttttatcactgtgttttgtgcttttaagaatgtctcacacatagcaatatgaaccttaaatgtaaatgggctaaatgccccaattaaaagacacagactggcaaattggataaagaatcaagacccatcagtgtgctgtattcaggagactcatctcacatacaaagacacacataggctcaaaataaagggatggaggaatatttaccaagataatggaaagcaaaaaaaaaagcagggattgcaatcctagtctctgataaaacagaattttaaccaacaaagatcaagaaagtgtaagaagggcattacataatggaaaagggatcaacgcaacaagaagagctaactatcctaaatattatatgcacccaatacaagagcaccaagattcataaagcaagatcttagagacctacaaagagacttagactcccacacaataatagtgggagactttaacaccccaccgtcaatattagacagatcaacgagacagaaaattaacaaggatattcaggacttgaacttagctctggaccaagtggacctaatagacacctacagaactctccaccccaaatcaacagcgtatacattcttttcagcaccacataacacttattcagaaattgaccacattattggaagtaaaacactcctcagcaaatgcaaaagaatggaaatcttaatggtctctcagaccacagtgcaatcaaattagaactcaggattaagaaactaactcaaaactgcacaactacatggaaactgaacaacctgctcctgaatgactactgggtaattaacaaaattaaggcagaaataaataagttctttgaaaccaatgagaacaaagacacaatgtaccagaatctctgggacacagctaaagcagtgtttagagggaaatttatagcactaaatgcccacaggagaaagcgggaaagatctaaaatcgacaccctaacatcacaattaaaagatctacagaagcaagaacaaacaaattcaaaagctagtagaagacaagaaataattaagatcagggcagaactgcaggagctggagacatgaaaaacccttcaaaaaatcaatgaatccaggagctggtttcttgaaaagattaacaaaatagatagaccactagccagactaataaagaagaatcaaatagacacaataaaaaatgataaagcagaaatcaccactgatcccacagaaatccaagctaccgtcacagaatgcaataaacacctctatgcaaatcaactagaaaatctagaagaaatggaaaaattcctggacacatacaccctcccaagactaaatcagcaagaagtcgaatccctgaatagaccaacaataagttctgaaattgaggcagttattaatagcctaccaaccaaaaaaagtccaggaccagacagatacacagtcgaattccaccagaggtacaaagaggagctagtaccattctttctgaaactgttccaaacagtagaaaaagagggaatcctccctaactcattttatgaggccggcatcatcctggtaccaaaacgtgccagagacacaacaaaaaaagaaaatttcaggccaatatccctgatgaacattgatgcaaaaatcctcaataaaatactggcaaactgaattcagcagcacatcaaaaagcttatccacaacaatcaagtcagcttcatccctgggatgcaaggctggttcaacatatgcaaatcagtaaacataatgcatcacataaacagaaccaaaaacaaaaaccacatgattacctcaatagatgcaagaaaaagcctttgataaaattcaacacccttcatgctaaaaactctcaataaactaggtattgatggaatgtatttcaaaataataaaaggtattcatgacacacccacagctaatatcttactgaatgggcaaaaactggaagcattcccttgaaaactggcacaagacagggatgccctctctcaccactcctatttaacatactattgcaagttctgatcagggcaatcaggcaagagaaagaaagggtattcaaataggaagagagacagtcaaagtctgtctgtgtgcagatgacatgattgtatatttagaaaatcccatcatctcagcccaaaatctccttaagctgataagcaacttcagcaaagtctcaggatacaaaatcagtgtgcaaaactcacaaacattcttatacacccgtaacagacaaagagccaaatcatgagtgaactcccattcacaattgctacaaagagagtaagatacttaggaatacagctagcaagggatgtgaaggacctcttcaagaagaattacaaaccactgctcaaggaaataagagaggacacaaaaaaatggaaaacaaattccatgctcatggatagggagaatcagtatcatgaaaagggccatactactcaaagtaatatgtagattcagtgctatccccatcaagccaccattaactttcttcacagaattagaaaaaactactttaaatttcatgtggaaccaaaaagcccgtatagccaagacaatcctaagcagaaagaacaaagctggaggcatcatgctacctgacttcaaactatagtacaaggctacagtaaccaaaatagcatggtaccggtaccaaaatagatatatagaccaatggaacaaaacagaggccacagaagtaatgcctcagaagtatctacaaccatctgatctttgacaaacctgacagaagcaagcaatggggaaaggattccctatttaataaatggtgttgggaaaactggctagccatatgcagaaaactgaaactggaccccttccttacaccgtatacaaaagttaactcaagatgcattaaagacttaagacctaaaaccataaaagccctagaagaaaacctaggtaataccatttaggacataggcatgggcaaagacttcatgactaaaacaccaaaagcactggcaacaaatgccaaaattgacaaatgggatctaattaaactaaagagcttctgcacagcagaagtgaacacatcagagtgaacaggtaacctacagaatgggagaaaatttttgcaatctacccatctgacaaaggtctagtatccataatctacaaagaactgaaacacatttacaaaaagaaaacaaccccatcaaaaagtgggcaaaggatataaaccgacacttctcaaaagaagacatttatgtggccaacaagcatatgaaaaaagctcatcatcactggtcattagagaaatgtaaatcaaaaccacgatgagataccatctcatgccacttagaatggcactctttgaaaagtcaggaaacaacagatgctggagaggatgtggagaaataggaacgctttacattgttggtgggagtgtaaattagttcggccattatggaaaatagtgtagcgattcctcaggcatctagaaccagaaataccatttgacccagcaatcgcattactgggtatatacccaaaggattataaatcattgtactataaagacatgcacacttaagtttattgcagcattgttcacaatagcaaagacttggaaccaacccaaatacccatcagtgatagactggataaagaaaatgtggcacatatacaccatgcaatactgtgcacccttaaaaaaatgatgagttcatatcctttgcagggacatgggtgaaggtggaagccatcattctcagcaaactaacacaggaacagaaaaccaaatacctcatgttctcactcataagtgaacatgttctcactcataagttgaacaatgagaacatatggacacagggaggggaacatcacacagtggggcctgttggggagtgggggtctaggggagggatagcattaggagaaatacctaatgtagattatggtttgatgggtgcagcaaaccaccatggcacatgtatacctatgtagcaagcctgcacgttcttcacgtgtatcccagaacttaaagtatataaaaaaaagaaaaaatagaaaaaaatataaataaaaataatatcatattagtggtatcatacagtatataattttgtgagtctagcttctttcattcagcatgtgaatcatcttttgtgattcattcaagttgtctaatgtagtttttcccttttttgtttctgaatagtgctctgttgtatgtacataccaaatttgtttgttcacctgttgcagaacatttgcattgtttccagtgtctgactattgcagataaagctactgtgaacatgtgtgtataggtttttatgtgaacgtaagtttttgtttctctatggtaattacccaggagtgaaatttctgggtcagattgtaatcgtatgtattattctttaaggacctgccaaactgttttccagagtggctgtactgtttttgattttcacctgcaatttatgaaagtttcagttcagcatcattgtcggcacctcgtattgttattatcttctattttagccattctcataggtgtgtggtagtgtttcattgtggttttaatttctctaatagataatgatgttgagcatcttttagtttgtttattattggctttctgtattttctttggtgaagtgtctgtcttttgcctgttttttaattggatttttgttttattgctgtagagttttgggcattcataaatacattctagatagaagtcctttatcagatgtcatttgcaatgatttttttctggcctgtagcttttctttttattttcttttcagtgtcttttgcagagaaaagggttttaattttgaagtttaatttattattgttttctttttatgtatcatgcttttagtgttgtgtataagaactcttcgcataacccaaagacttgaatattttttcttatattttcttctaaaagctctatagttgtatggtttacatttagagctgagatctctttggatgtaatttttgtgtaaggtgggaggtttatgtcagggttcatgtttttgcatatggatgtccaattttacaacaccatttttttaagagagtgttattctctgttgaattgtctttgtatctttgtcagaaataaatcggccatttttgtgtgagtctgtttgtggactctttctgctgttgatctgtgtgtctatccgtttaccaacatcatactgtcttggttactgtatctttatagtatgtcttaaaattgggtagtatgattctttttcagattttagctattcagctatctttccttttttgtatatattttattttatattttacatcttaccttattttattttattgagacgtgtaaggtcagccgagagaaaggaaaaatagacctaaagtcaggcgcgtaagtttattgaacctgaggggctgcttcacctcactcagaggaggcagccctgagtttacaaaatgaggggtttatattggagaagggagtttgagggagttctttggtgtggccgcattccagggttgtttgctggttaattttgtcacatatcaccttgtgacatttgtggtagcagaactttcaggaaggtgtaggtaaagtttgtttattcttccaacgacctcccgctgtgcggtccagatggttcgtaattggggtttgtttatccagcaaggtctgataagtgaagtctgctggcttcactgtggtgcctagataagggcttagaaatgtaaagaggcttgggggaagggtggacagcacggagacgtttgaggggagcgccaagaagctttatggggcagtttgtctttaagacgcagtctcactctgtcacccaggctggagtgtactggcacaatcttggctcactgcaacctctgcctcccgggttcaaatgattcttgtgcctcagcctcccgaggagctgggattataggcacccgccaccacactcggctaatttttgtatttttagtagagatgaggtttcactatgttgaccaggctggtctcgaactcctgacctcaagtgatccacctgccttggcctctcaaagtgctgggattacaggagtgagccactgcgcctggctgcttttccatgtatattttacaaacagcttgtctgtgtgcacaaaagccctgctgtgattttgattggaattgcattaaatctgtagatcaatatggggagaattgacatctttactacattgagcctttaatttgtgaactccatttatttaaattttctctggtttcttttatcaacgttttgttattttgggcttacagattctatacatgtgttgttagatttatacctaagaatttcatgtttggaagctattgtg

SEQ ID NO: 1856 - DNA, 8669 bp, Homo sapiens
actagcatgattttcatcaatgcttcagtaatctattctttatatcagaagggtgaaagtaaacatatcaagtttttttttttgtttctgggaggactcataagatatcccataagtgtggtaatagcagtttttattccacctatttcctttaaatgatagtaaaaagctccatgagtaaatatattgtctgattttctactcttatgtattgttgattaagtcctttaaaaactttatttttagattaacttgtacaatggacttttttttgtatacattctatgaattttaacacacctatagattagtgtaataaccactgccacagccaggatgcagaacagttccataaccctgaaaattcctgtgtgccatccctttgtagtcacagcctcctcccaacccttaaacgctggcaaccactgaccttttatcactgtgttttgtgcttttaagaatgtctcacacatagcaatatgaaccttaaatgtaaatgggctaaatgccccaattaaaagacacagactggcaaattggataaagaatcaagacccatcagtgtgctgtattcaggagactcatctcacatacaaagacacacataggctcaaaataaagggatggaggaatatttaccaagataatggaaagcaaaaaaaaaagcagggattgcaatcctagtctctgataaaacagaattttaaccaacaaagatcaagaaagtgtaagaagggcattacataatggaaaagggatcaacgcaacaagaagagctaactatcctaaatattatatgcacccaatacaagagcaccaagattcataaagcaagatcttagagacctacaaagagacttagactcccacacaataatagtgggagactttaacaccccaccgtcaatattagacagatcaacgagacagaaaattaacaaggatattcaggacttgaacttagctctggaccaagtggacctaatagacacctacagaactctccaccccaaatcaacagcgtatacattcttttcagcaccacataacacttattcagaaattgaccacattattggaagtaaaacactcctcagcaaatgcaaaagaatggaaatcttaatggtctctcagaccacagtgcaatcaaattagaactcaggattaagaaactaactcaaaactgcacaactacatggaaactgaacaacctgctcctgaatgactactgggtaattaacaaaattaaggcagaaataaataagttctttgaaaccaatgagaacaaagacacaatgtaccagaatctctgggacacagctaaagcagtgtttagagggaaatttatagcactaaatgcccacaggagaaagcgggaaagatctaaaatcgacaccctaacatcacaattaaaagatctacagaagcaagaacaaacaaattcaaaagctagtagaagacaagaaataattaagatcagggcagaactgcaggagctggagacatgaaaaacccttcaaaaaatcaatgaatccaggagctggtttcttgaaaagattaacaaaatagatagaccactagccagactaataaagaagaatcaaatagacacaataaaaaatgataaagcagaaatcaccactgatcccacagaaatccaagctaccgtcacagaatgcaataaacacctctatgcaaatcaactagaaaatctagaagaaatggaaaaattcctggacacatacaccctcccaagactaaatcagcaagaagtcgaatccctgaatagaccaacaataagttctgaaattgaggcagttattaatagcctaccaaccaaaaaaagtccaggaccagacagatacacagtcgaattccaccagaggtacaaagaggagctagtaccattctttctgaaactgttccaaacagtagaaaaagagggaatcctccctaactcattttatgaggccggcatcatcctggtaccaaaacgtgccagagacacaacaaaaaaagaaaatttcaggccaatatccctgatgaacattgatgcaaaaatcctcaataaaatactggcaaactgaattcagcagcacatcaaaaagcttatccacaacaatcaagtcagcttcatccctgggatgcaaggctggttcaacatatgcaaatcagtaaacataatgcatcacataaacagaaccaaaaacaaaaaccacatgattacctcaatagatgcaagaaaaagcctttgataaaattcaacacccttcatgctaaaaactctcaataaactaggtattgatggaatgtatttcaaaataataaaaggtattcatgacacacccacagctaatatcttactgaatgggcaaaaactggaagcattcccttgaaaactggcacaagacagggatgccctctctcaccactcctatttaacatactattgcaagttctgatcagggcaatcaggcaagagaaagaaagggtattcaaataggaagagagacagtcaaagtctgtctgtgtgcagatgacatgattgtatatttagaaaatcccatcatctcagcccaaaatctccttaagctgataagcaacttcagcaaagtctcaggatacaaaatcagtgtgcaaaactcacaaacattcttatacacccgtaacagacaaagagccaaatcatgagtgaactcccattcacaattgctacaaagagagtaagatacttaggaatacagctagcaagggatgtgaaggacctcttcaagaagaattacaaaccactgctcaaggaaataagagaggacacaaaaaaatggaaaacaaattccatgctcatggatagggagaatcagtatcatgaaaagggccatactactcaaagtaatatgtagattcagtgctatccccatcaagccaccattaactttcttcacagaattagaaaaaactactttaaatttcatgtggaaccaaaaagcccgtatagccaagacaatcctaagcagaaagaacaaagctggaggcatcatgctacctgacttcaaactatagtacaaggctacagtaaccaaaatagcatggtaccggtaccaaaatagatatatagaccaatggaacaaaacagaggccacagaagtaatgcctcagaagtatctacaaccatctgatctttgacaaacctgacagaagcaagcaatggggaaaggattccctatttaataaatggtgttgggaaaactggctagccatatgcagaaaactgaaactggaccccttccttacaccgtatacaaaagttaactcaagatgcattaaagacttaagacctaaaaccataaaagccctagaagaaaacctaggtaataccatttaggacataggcatgggcaaagacttcatgactaaaacaccaaaagcactggcaacaaatgccaaaattgacaaatgggatctaattaaactaaagagcttctgcacagcagaagtgaacacatcagagtgaacaggtaacctacagaatgggagaaaatttttgcaatctacccatctgacaaaggtctagtatccataatctacaaagaactgaaacacatttacaaaaagaaaacaaccccatcaaaaagtgggcaaaggatataaaccgacacttctcaaaagaagacatttatgtggccaacaagcatatgaaaaaagctcatcatcactggtcattagagaaatgtaaatcaaaaccacgatgagataccatctcatgccacttagaatggcactctttgaaaagtcaggaaacaacagatgctggagaggatgtggagaaataggaacgctttacattgttggtgggagtgtaaattagttcggccattatggaaaatagtgtagcgattcctcaggcatctagaaccagaaataccatttgacccagcaatcgcattactgggtatatacccaaaggattataaatcattgtactataaagacatgcacacttaagtttattgcagcattgttcacaatagcaaagacttggaaccaacccaaatacccatcagtgatagactggataaagaaaatgtggcacatatacaccatgcaatactgtgcacccttaaaaaaatgatgagttcatatcctttgcagggacatgggtgaaggtggaagccatcattctcagcaaactaacacaggaacagaaaaccaaatacctcatgttctcactcataagtgaacatgttctcactcataagttgaacaatgagaacatatggacacagggaggggaacatcacacagtggggcctgttggggagtgggggtctaggggagggatagcattaggagaaatacctaatgtagattatggtttgatgggtgcagcaaaccaccatggcacatgtatacctatgtagcaagcctgcacgttcttcacgtgtatcccagaacttaaagtatataaaaaaaagaaaaaatagaaaaaaatataaataaaaataatatcatattagtggtatcatacagtatataattttgtgagtctagcttctttcattcagcatgtgaatcatcttttgtgattcattcaagttgtctaatgtagtttttcccttttttgtttctgaatagtgctctgttgtatgtacataccaaatttgtttgttcacctgttgcagaacatttgcattgtttccagtgtctgactattgcagataaagctactgtgaacatgtgtgtataggtttttatgtgaacgtaagtttttgtttctctatggtaattacccaggagtgaaatttctgggtcagattgtaatcgtatgtattattctttaaggacctgccaaactgttttccagagtggctgtactgtttttgattttcacctgcaatttatgaaagtttcagttcagcatcattgtcggcacctcgtattgttattatcttctattttagccattctcataggtgtgtggtagtgtttcattgtggttttaatttctctaatagataatgatgttgagcatcttttagtttgtttattattggctttctgtattttctttggtgaagtgtctgtcttttgcctgttttttaattggatttttgttttattgctgtagagttttgggcattcataaatacattctagatagaagtcctttatcagatgtcatttgcaatgatttttttctggcctgtagcttttctttttattttcttttcagtgtcttttgcagagaaaagggttttaattttgaagtttaatttattattgttttctttttatgtatcatgcttttagtgttgtgtataagaactcttcgcataacccaaagacttgaatattttttcttatattttcttctaaaagctctatagttgtatggtttacatttagagctgagatctctttggatgtaatttttgtgtaaggtgggaggtttatgtcagggttcatgtttttgcatatggatgtccaattttacaacaccatttttttaagagagtgttattctctgttgaattgtctttgtatctttgtcagaaataaatcggccatttttgtgtgagtctgtttgtggactctttctgctgttgatctgtgtgtctatccgtttaccaacatcatactgtcttggttactgtatctttatagtatgtcttaaaattgggtagtatgattctttttcagattttagctattcagctatctttccttttttgtatatattttattttatattttacatcttaccttattttattttattgagacgtgtaaggtcagccgagagaaaggaaaaatagacctaaagtcaggcgcgtaagtttattgaacctgaggggctgcttcacctcactcagaggaggcagccctgagtttacaaaatgaggggtttatattggagaagggagtttgagggagttctttggtgtggccgcattccagggttgtttgctggttaattttgtcacatatcaccttgtgacatttgtggtagcagaactttcaggaaggtgtaggtaaagtttgtttattcttccaacgacctcccgctgtgcggtccagatggttcgtaattggggtttgtttatccagcaaggtctgataagtgaagtctgctggcttcactgtggtgcctagataagggcttagaaatgtaaagaggcttgggggaagggtggacagcacggagacgtttgaggggagcgccaagaagctttatggggcagtttgtctttaagacgcagtctcactctgtcacccaggctggagtgtactggcacaatcttggctcactgcaacctctgcctcccgggttcaaatgattcttgtgcctcagcctcccgaggagctgggattataggcacccgccaccacactcggctaatttttgtatttttagtagagatgaggtttcactatgttgaccaggctggtctcgaactcctgacctcaagtgatccacctgccttggcctctcaaagtgctgggattacaggagtgagccactgcgcctggctgcttttccatgtatattttacaaacagcttgtctgtgtgcacaaaagccctgctgtgattttgattggaattgcattaaatctgtagatcaatatggggagaattgacatctttactacattgagcctttaatttgtgaactccatttatttaaattttctctggtttcttttatcaacgttttgttattttgggcttacagattctatacatgtgttgttagatttatacctaagaatttcatgtttggaagctattgtgttttttaaaaatttttgttttctagttggtcaagttcttttttacaacagtatttttttgatagtaaagttagtttggtacgaaaggctgtgtatactttgaccttcctcctcaaagaattgggcaatttattatgaaagcacatagtgtaaaatatataaaagggcaaaaagtcaagatccaagggctgtgcttaaaaaggtaatattcagagttaaactggaagcattatcaaaagattttatttacaaggccatgaagggattactgtcactttgtctttaaaaaaattttagaaatagcaataataaaaaagtaatagtttgatagcaaagctctagaatactaactagatattttgggcatatcaaagatactgtggttttagatcatttttcttatgagatccagattaaatgaagtgttctgaagactgcctacagaaaattcaaaacaatggacaattcaagtgttgtgggttattaccttcagtaataaaccatatctttttttaaacgtttaaattaggtttgggggtacatatgcaggtttgttatatagataaactcgtgccacaggggcttgttgtacagattattttgtcacccagatactaagcctagtacccaatagttattttttctgcccctctccttcctcctaccctctgcccttaagtaggccccgtgtctgttgttcccttctttgtgttcatgagttctcaacatttagtgagaacacagagtatttggttttctatatcttttaactgaaatacatggactatagttttatcatgacaccatttgtattaaggttcttcactatatttttaggttattatggaaatcttaaaggtgttttctagaagccagtttttaaaaagtataacagttctgtctgatgttacattgaaaaagaattgtgtttctgtgtgtgttgaggagtactgctgtgaagaagttgaatataaagaagagaatggccccctttctttgtttatttttatttatttatttatttttaagagatggggtctcactatattgctcaggctggtctcaaactcctgagctcaagcgatcttcccacctcgatctcccaaagtgctgggattacaggcatgaactaccacgtctgtcccccttttatttattcagagacacattttcagtgttgctttccctaaaatgcattttttcctgctttatttttctgttaccatattatacacttatttatctttattattgtctgcttctaccactcgagtggaagctttttgggagtagcttatctatcttgtttgccactatatcctcaaatgcctagaactgtgcctggtgcaaagtgggcactcaaatattagttgaatgaatgtttaaattttagccacagttatatgctgaagtattaggctttaaaaaatagttccatgtttttttcctgagttcatttacttacctctcatttatggccccatgtacatcattttattctttaaaaccttgcatgaagattttattccgactcttaatatatttctaggagatgttagtggtcatactgatcacccagtgaacctaactttgcatttctggaccttcttaataacgtgagacccaaacctttatgtaatttcagtcacttccccaaaccaggattttgtgaatctctacaattgttatttttcaaaagtaatagagtccaatccattatatttttctcctaacaggatttcctgtcctctcatttactgtgtctgctaatcttaaatctccagtgggtttatttactgtctctcttttcttccagtttatcagcagccttctagcttttttctttatttactcattcttggaccctatcatacaattc

SEQ ID NO: 1857 - DNA, 12641 bp, Homo sapiens
gtgtttgtagacaacagtatgttgaagactactggaatagcacatagatgtctttggagaaagagatatattcttttgaggtctgcatttatgctttggggcacacagtttaataaaaaggtaatataaaatggaagtggggtaaaatatgtctcccagaatgagccaacaggattgaaagaaccactttccaagtctagatcactgtagcatctttttgcttaaggccgaaagttcttctcaactttcctttcaggtttttatttatttatttatttatttatttatttatttatttatttattaggcaaaatgggaattgagaagcctgaaatgatgaagatgctcatgattttaaaaagtttttgtatgtcaggaatgaaagatgtggtgaggttgaacaggaggaaaaaaatgactgtatcccagtcagcctgggtagtatcacttcctgctttcctggggtaaaaagcctggaggaatatgggcattcggttgttgagaaagagtttgtctgacttctcttgctgtatttgggattgttcagagactaactggttggattgcaatttgctttcttgtggaaaaactgatctagcaacatatattgtgcgtttgagctttagagaagccttttctcttgtagtttattctcttgcatagtggtgtttctaggctgctgacatatgcgaaggaaacattgtattgatgtgtgcatgtgacagtctacctgcaacatgcatgtgctcgtggctgaatcatttgtgcatccaaagctgaggtccctggctgctgttgatttagtccaatgcatatgtaatactctgtggaaaacattcctggttagtagctcctcactactgtgttatacaagctgctggcaaaggtaattatgcttaataggagccacctttgatttaaagctgcagaggtgagtaattaaattgagctcgctcaagcacgagggggtggcatgcaacctttgtttggggacattcattgggagcggctgggatctgttacaaaggcaatgtttcttgggctcatatttgtcacccagattgtcttagaaagacatcagtgcacctgggagagatgcagcaaaggcatagtgcaggcatctctttcttcgtcctgtcccctcaaatatcaccaaaggagaactcgcctcccagcttcatctgccctggttcctgtgctcatcttgccccgggggggggttcagcactgtcctgctctctggtttctcgatgctcatctctacagatgatcacaactgatcaccaatagtgatcagtcttgccacgtggactggcagtcctgagatttctaatctgggtctgctcggacatcaacagcaacaacaaaagcataccagtcccttaatcctttaatgattgaatatgagacgaattcgtgtttgtaagatttcatttcaatcccatgggtggctattattgcatctcaaagatgatctatttgtatacatttctatattttcttttcagcaaacctaacctgataaaagaaaaaaaaaatgcctgggctgtcctctccccagccctaccctctagagtttctgaatggtaacacccaagcaagccgggttctgttgggcaaagagcctgttccaggcgatgccacctagaactggggtgacatacttgctaggaaagaacagcaactccaactaaatctttgtggcttccaaaggattcccaagctccaggcagagggttttgctctgtgataactgcaaagtgggttcataaaatccagaggaatcctaggaaaatctctttgcctaaactcccctgcttttaggataaacagatggccttacatcttcctactcaaagtatggcctgcaggccaacagcctcagcatctcctaggagctcattagaaatgcagattctcatgccccaccccagacctgcttcatcagaatctgcattttcagaggatgctcagggggggattcgtgagcacgttgagatttttagaagagttagcctaccctgaatggttgactcctgcctcctttctgacttgaaatcctcatcatttccttgcctgaactgtggtttctttctgtccttattccatgcccagctgtgccttcttctttttttggggggacagagtcttgctctgtcacccaggctggcatgcaatggcgtgatcttggctcactgcagcctctgtctcccaggttcaagcgattctcctgcctcagcctcctgactagctgggattaaaggcacctgccaccacacctggctgatttttgtattttcagtagagaccgggtttcgccatgttggccaggctggtctcgaattcctgacctcaagtgatccacccgccttggttcccaaagtgctgggattacaggtatgagccactgcacctggccaaagctctgccctcttcttggtctagttaatgccttcacatggttcatatattagcccaagggttacttgctcagggaaaccttgcctcagcctttagattaggttaaatccaccctcgccagtacaggcctgaaagcaccatatacctcactgccttgctcttttcagggttacaattctatgattcttggtttagttaatttctgtctatcgcctctgcacacagttccatgagggcaggaaccatgtccagttttatgactcccacctgctgggaccccaccatagtgtccagtacatgtagaagctcaataaatatttgttcagtgaacagatgcgtgctctcaggacatataattaggaatattgtaggcgtattgctggctacttagtttatctcttcaggaatgttcaaaacatttctagaactgttttctgtttattcaattccaggtgatgagaaaatcaactcaaccgaactactatttttaagcactttccacacattcagcattataccacttaatcctcacaacattttataaattttataaatgaataaactgaaacttacagcagtgatttcagactagcaaaatgatggcagagctgaaaaccacgttctactcttcactgccacattccactcttcactgccacattccaagacccatgagtctgaggcctcatgctctcccttgggttggaatcagagtggttctccaagatgcacagagttcccgattcacctccttaacacagatctttattaagcacaccacctgggtgccaagcactgttctgtagcagcagtaatgagtaagatccatcaggaccctgctctcaggggacagaagcaacatatatacttaagatgccatgtggttaaaaaggggctaagaagaaaaacaaagggtggcaaagggagggaaggtgagggaagggggctataaaccatagagcctttgcctccttcatttttgtatctgagcacttggctcaagggccagtgtgcgataggtctcctcagttagcatcggttgatgactgactgacagatggaatccaacatttccaaagtgggctaagcaccagctggtgtcgtatgtgaccataaaactgagcagagcaaacggccagtctagagattgggatttcctaccctgttgcccagattttcctccctctatcagccactggtttgtgactggaatcatcagaatcgcctctagagctttcaaaaaaaagtcatgtgctcagcttttccttgggcaaactgggatttctgggggtggaaaaccagcatgtgtgtttttaaaaaatcctacagttaagtctgatgtgctcaaatggttgagatgctgtataccccaaccatgtgaaataataacaccatctagctttcactgagtgcctactgtgtgccaagccacatactcagtggttaaccaaccccactaagagagaagaagatggtgacgatgatgatggtaatgaaaacaacagctaatatttattgagtaatgttgtttgtgcctggtgttatgctaaacacttatgatgtccaaatagttcatcttcgcagacgtccaatgagtctttttctgtctcactcaccattatagacatttcagagaaggttcaagtaagtatcagatatatgtttcaagcaggggttgacaaactgtgacctgtgagctaaacgccacctgtttttgtatgacctatgggttagaatggtttttacattttttaatgattgggaggaaatgtgaaaattagttttcttaggttatataagtacctatataatatcttaaattttgtctcttggcctgcaaagctcaaatttactatttggtcctttattggaaaagtttgctggcttctgccctagtgtatttttttccaacttgttgtatgtgtaggacagtcatatgagtgattgttttaggtggtagaagcatgaatttttaaaataattatggtttcatttgctgtgtaatagaaggggaaagtaaaactaatatattaaaactgatttcatggatgttactgctcaatccaatgtaaagaaaaaaatgaatctttttgaaatcaatttttaaaaaataataatacaggcagtatggagataaaacagaaatcatgcaagttatagaaatgggataaacactgttataggatcagaaagtgggatgaatagggaaaagtcaaaataatggaaacaatttcacctggatgagaaagataggagatgagatgacggaagctttttgcatttttaatattctgtgattctcagtttcttagaacccttgtttttcaggactttttgatctcttgaggtctcttccagcgctctgattccatgaaaagtttcctcgggagatactgacacaagctgggggatgtccagggttcgttatagctcaaggcacagtcttcctgtgtttttccttctgctgacttagaaagacagatgagcaaacctcagatggattcagaggtttggtggggaaatctgagaggctctctagttcagccaggagtggaagagggggacagccatctgataatgactgttgctattttaagacacagatagcagagatgaggagtagcgtgatgaaaactcacattaaaacaaccaagagaggcacaacaggaactctatgaaccccagagagacccggtctgggtttacaatgacaatgttgtgtgtgcgttcatgtgcgtgtgtgtgtgtgtgtgtgtgtgtgtgtgtgtgtgtgtgtgtgtgtgtgtttgggagggggtgctgatatttttttaaatgcagatggttttgttctctgtagttgaagcttcagttcagcagctctgagacaaacaggaaagcctgtgttattctctacaggaacacatcaaaggtagtttctggcaacagtcaaaatgtatatcaaggaaggagaaaggattcatgacctgtttgaacaactagtgttaaaaacacattcgagaagaaataatgctaggtagaggatgaaaggaaaataggagaaaggaagaccccttgcttcactcagacctaaagatgattgtttctcaccattgctagctttttcaagaataaggaagcgaaaaaatcacctgtctcatttatcatctgacaggggagctaaactctgctggatgaaactttttcttttgccccagactaaataaagccccacctcgtcttctgtttcattttgaaagaaaagaggtaaaacatgcacaactaaaacacttgtttaaaagtgtgtgacatttcaggaaggtttaacgttacgtatgtcttccctattgagtttcataaacagagtatcattgtttgatagtggcatagctgtggttttgagaaggcttgtctagaacggagttcctgagctgcttggatgatatttcactgctttgatggagaacggactaaagaacatcattgtgacctttttatcaaggcttaaaggaagtataaaaagaaaacggaagttgtcaacactcaccaggctctattgtgaggcacacaaccaacccagggaggaaaatctaaggttgcttttgtcaccttaactcacatcacttcattgtagtacaagtgagagccggaacttattggacacttactctgtgccacacaggctttgggtgaatttttgcattttaattctcaccccagtaaagagacataatggtatccatgttagaaatgacaaagaggcacacagtgaagtcaggtgactcggccaagcttctgcagctgcttagaggccaggctgatctacctagccaggggtacctgacttccaagcccgtgctgtcgacccttctggtttaactctgagtaaatttcatactttgtggagcgtccatcagccaatcacaatctaaaaataatacaaaatgaaagaaactgtcatacattatctttttttcatcttcctaacaaataagctggcatgattattctttccattaccctgaaaaataaaccaaggctcaaggagaggtcatggtctgccccaaaccacagcctccattctctggcttgaaatcttatgcttttacccaccttttgatgttacctcttaagtgatgttgccagaattagcaataaaataaatttataaaaaagaaaataaatatttttatttataaaaaataaatttataaaaaagaacaggatgcacagttaaatttgaatttcagataatataaaagaatgtttagtataaggatgtccagtacagtatttgggacctacgggcaagctttaaagaacataagttttatcacattctccaggtacgacgtgtgtattaataaatcaatagaagtttatctgtgagcagttatctcagttttttaattcctaagtcttcatgttctgaagaaatggccatcaccttgcattcccagggcctattgattatgaggcttcataaaccttaggacttgagagaacagctgggattccttcccagttgctaaccaatgacttcataatgtaatggacagctctaaattgtgcttctacgttgtagacataataagagacacactaaaggacaaatacattatctaataaagctgcctcgagcttaagagataacaaaatgtcaaaactaaattctttttctaagcacttccagtatgaaatttagttcaccgtccaggtactgtccttcattgtggggagaaacatcctgcctgtctacctggggttctattttatttcatcagcctcctgtttttctccagggatggtgtgtgtgtgtgtgtgtgtgtgtgtgtgtgtgtgtgtgtgaaattttttcctaaatattaagtcagtgcaccttcctcgcaagcgctggacagctcaggatcttattttggaagctcgaggtatgagcaggcctgagaaaattgtggcccttctttttactccttccctctgtgaacttttgagaagattccttagtgatcggcttacacgctttcaaactggcacgcctgtaatctggtaaaatgtgtcagccctatggagaaataagccttccagaagagtttcttcattgttgaggtaattgtctcctctctgacaggcacattcatcagtggcttaatggtcaatcactagttggcaggcagagtgttttcattcttccctatccactacattaggcatacttaatcaaaatgtctccgggtaatggctgtgaagagttcatgactgactgatccgttgtctgtgctgatagaaaattaacagctcagtgctggaaagatgcgagcccacagataaacaaattgtacattaatatttcatcttggggacctgggatgtgctgtccatagcaaaatatttcctggctgcacaagcaattctttctttccttctctttccttcttttttttctttttctttttttttttaattatttctttccgtaagctgtgcacactcataccacatggacagtatgcatcctgttctagaagcttcagtgtctgtggaaagttcaggggagttcatattcgatgccctgttttcatcactgccaaatgaaagcaggcgaaaccctatagaggagttgttttgttctttctttttctagtataatatctgtgggctgactgttgcctgagcatggaacacgcacccactccccccctccaattaaatacctgccccaactttaaacatatttcatacagaatatttaagggtttctggatgaaatacaaatttcatccagaaatacaaatttcatccagaaatacaaataggaaaacacacattgctcagtcctacttattttagctgtaattcattgtgttggatgattttgcagagtattctgatagtgaagacaaactgattccctagtgaagctgaaatcggtcaagcttcctgatggccaagacgtaagatgatacagcagttgaccatgtgcgaaagaccagaagggtcagagtttgacttgccttgaccccatgcaggcgttgccccgccacctcttcctgtctttttaattttatacccagaagaacaaaaacagagaaaaggcatttacgcttagcagtccagacctgccgggaaaagcataaaacaaggtgtataaatgctggaagaggaagccacaccatcctgctgcttatgagctcagggaagttctttttaaatggtgtcctaggtgcacacaaaagaaatgtgtgggcgtccgtgtgacatcacatgccataaaagacatcaagatgctaccaaaagtcagaccctcaggtttaatctgagtggttcaatataataataaaaataataatagccaactttcagtgtttactataagataggcaatatgggctgtacatgaatcttctgatttagtggaggtagataccatcattattcccattttacagatgagcaaactaagagagacaggaggaaattcatctaagaccaaacagccagtaagtgatataatagaatcgtgggagtcatcctgaactttgaacctcttcccttaactgcactacatataagaagccaggtttaagccgggcctggtggctcacacttgtaatcccagcactttgggaggccgaggccagaggatcagtgaggtcaggagttcgagaccagcctgggcaacacggtgaaaccctgtctctactaaaaatacaaaaaaaattagccaggtgtggtggtgcacacctgtacctagctacttgggaggctgagccaggagaatcgcttgaacctgggaggcagagattgccgtgagccaagatcacaccgtgcactccagcctgggcaacagagagagactctgtctcaaaagtaaataaataaataaataaacaaataagccaggtttgagctgaactatttagaaatataaaatgttgaagctggagaaaacgtgtagatgtcctgccatctgaactcttcctgttccagaggagaaatggtggcctagaggaatgggaggtgaagggtctaaggtcttaccactgctgtccccaggcagtagacacattggttttattaacaggaaattctttggagattctctgtaaatcctgcatgcagcgtgtcctgtgtcatgtggtgatgagaagctgaataaattcacacttggatcattctcgatctgtcctaggcaaggccctggagaggtactcggtgttaaaatttctggagtgactgtgacatcttgaagtataaagtagaacaaacctttgtgtatatagcccctctctccaagtactggctctttctggttattctctggctagattttctttcctctagctgatgtgtttggtgacctcactttttcttctctgttttgagaaatctatgaaatttaagataagataagcccattgggttaatagcatttcacctgcctttcctgtatactcaagaaataatcccaagagaagaatcttagctttaaaggcatcaagtttaacacagagcagggtgagatggaatgtatttaatagttagatgatccttcattcttttcttttttgtgacacacacacgtacatgtgtgcactcaaaatgcttaacttataaccagttccattgccacttcattcacttacgagcctaaagtttggaagtttgctcctattgaaagaaaagttgtaagatgttcaacattataaaaagtgcatgagttgatctgttcccagacagactcacagaattttacttaacatatattgttgcaaaaatgtttgcatccctactgaaaaatcattagtgtcactattgcaagagtagttattaaacagttaagaaaaaaagtgatattttccctaacgttaagtattcatgcctgaaaagagactgagaaatagatacagatttttatagctattctggaagaagtctccatgtgcttttgaagaatttgcaataggagcacaggctcatgtatccttagatgccttgcatggaagcacatgaccaagataaactgaacactagccaatagggagtggtgaggaccatggagtgctgcaagccccagtcccttttaatgtgcaccacggctactcaactccagtctgtagtcaccatgcaggaatccatcatctatgttgccagatcttttggtttctcaatggattcacaaacctacatttcaatttcctaagcagcacaagttaagtaaatcacacgtggtacctgaattcaatgtaaactgccattttataaactcagatttagagatacatgtagtccttcattcttcattctttcacatcattttctttggtacagatctaaaatagcatcattctaatattaatctgtcatgttgggtggtggtggggtagggtgctatggtttattttgtttggggtcaaacatgaataaaaaataaaaataggacttttctgagttaattgagtaggagttgggagagttagaggggaaaactgaatatcagtataaatatttgagcacctacaatgtgcaagttctggaaatccatgagtgaacaaagctgatgatgccctcatgacacttgtaaatttctcaataattctttaattgccattgtgactggtgctgcaagagtaaaggctgctactgtgagggtgtctgacagccctagcctggggtggcaagaaaggcttccctgaggaggtggcattgaacttgatacttgaaggcttagcaggagttgaccaggctgaagtggcctggtggagtaaggagcttctggccaagaaggccttgggtgcagaagtcctgaggttggagacagcaggtgcatggacagaggaaggttggcacgatcggctccagtgagaaagagaaagatggtaaggaaggaggttcagaaatcagatggaccaaacacatgaaaatgtttggtcattttaaaaagatgacttgcaatatggcaactgggccataaagagttaacaagaggagtatggcatgagtataggcctttcaaagtgaaagacaggaagaagcacaaaatacgtgttggataaaataatttcttggtgatgacattagcatggaatagttaccatcctagagaaggtgctagaagatacaggggaatgataagagtcatccaagaaagaaatgtgtgtttgtgtgtgtgtgtgtgtgagtatgtgtgtatactcgtgtgtgtatgtatgtatactcatgcgtgtatgtatgtatatgcgtgtgtggtgtgtgtgtatgtatgtatactcgtgtgtgtgtatgtatattcgtgtgtgtgtgtgtgtgtgtttgtatttctgacatatccatatatccagttgagtatttgcagagtgatgtgagcatgacatggttaatgattaaaatccaaattaggtttcatcaggaaaattaaaataatttaaaaaataataatacaacacagcaaatggtctggctgtgtttcctacttttattcataatactaatttatatcattataaattatgtgtaagggtgtctaccttgtcaagcctatgtttgtaaagaagaaagcattttgtatctcacaccaagaaaccaattccactgaattgtatgtgagttaatattcaaggcaaaaaagaccaatttaaatcaatacataattaaccttgatattagaattgagaatgaaagcccagtttagagtgttgagcatgattttcttaatgatatgaacagtgtgtttagtctttatgaagaaaaaaataaagggaagaaacactggatggaaagaggagagaagtaggtaaaggcatttcagaaatatggttaattgggtaattggggattgggtgtcacttgaacttaagcctgtggttaattcatggcttattcttcaggaatgacattggcagagcagttattggaataatgaattgctcacttgtcctgggcaaatagaaaattcccctggttgaataaaacagtgggaggaggcatttgataggcttataatggcttaagagcctgggttagggttcttcccctgacagtcagaaaagagaactttgggggattggatattttcagcaaaggggcaaaattaagaaaggattataatcaccttttttttttttttacgggaattgacattgatacttaaagcattttcaaaatgaacgtcaaaaacagagttaagcagcagaatattaagtcaaggtagggggctgatataataaggagtttgaggaatttta

SEQ ID NO: 1858 - DNA, 1196 bp, Homo sapiens
tgtcaaaactaaattctttttctaagcacttccagtatgaaatttagttcaccgtccaggtactgtccttcattgtggggagaaacatcctgcctgtctacctggggttctattttatttcatcagcctcctgtttttctccagggatggtgtgtgtgtgtgtgtgtgtgtgtgtgtgtgtgtgtgtgtgaaattttttcctaaatattaagtcagtgcaccttcctcgcaagcgctggacagctcaggatcttattttggaagctcgaggtatgagcaggcctgagaaaattgtggcccttctttttactccttccctctgtgaacttttgagaagattccttagtgatcggcttacacgctttcaaactggcacgcctgtaatctggtaaaatgtgtcagccctatggagaaataagccttccagaagagtttcttcattgttgaggtaattgtctcctctctgacaggcacattcatcagtggcttaatggtcaatcactagttggcaggcagagtgttttcattcttccctatccactacattaggcatacttaatcaaaatgtctccgggtaatggctgtgaagagttcatgactgactgatccgttgtctgtgctgatagaaaattaacagctcagtgctggaaagatgcgagcccacagataaacaaattgtacattaatatttcatcttggggacctgggatgtgctgtccatagcaaaatatttcctggctgcacaagcaattctttctttccttctctttccttcttttttttctttttctttttttttttaattatttctttccgtaagctgtgcacactcataccacatggacagtatgcatcctgttctagaagcttcagtgtctgtggaaagttcaggggagttcatattcgatgccctgttttcatcactgccaaatgaaagcaggcgaaaccctatagaggagttgttttgttctttctttttctagtataatatctgtgggctgactgttgcctgagcatggaacacgcacccactccccccctccaattaaatacctgccccaactttaaacatatttcatacagaatatttaagggtttctggatgaaatacaaatttcatccagaaatacaaatttcatccagaaatacaaataggaaaacacacattgctcagtcctacttattttagctgtaat

SEQ ID NO: 1859 - DNA, 5583 bp, Homo sapiens
tgtcaaaactaaattctttttctaagcacttccagtatgaaatttagttcaccgtccaggtactgtccttcattgtggggagaaacatcctgcctgtctacctggggttctattttatttcatcagcctcctgtttttctccagggatggtgtgtgtgtgtgtgtgtgtgtgtgtgtgtgtgtgtgtgtgaaattttttcctaaatattaagtcagtgcaccttcctcgcaagcgctggacagctcaggatcttattttggaagctcgaggtatgagcaggcctgagaaaattgtggcccttctttttactccttccctctgtgaacttttgagaagattccttagtgatcggcttacacgctttcaaactggcacgcctgtaatctggtaaaatgtgtcagccctatggagaaataagccttccagaagagtttcttcattgttgaggtaattgtctcctctctgacaggcacattcatcagtggcttaatggtcaatcactagttggcaggcagagtgttttcattcttccctatccactacattaggcatacttaatcaaaatgtctccgggtaatggctgtgaagagttcatgactgactgatccgttgtctgtgctgatagaaaattaacagctcagtgctggaaagatgcgagcccacagataaacaaattgtacattaatatttcatcttggggacctgggatgtgctgtccatagcaaaatatttcctggctgcacaagcaattctttctttccttctctttccttcttttttttctttttctttttttttttaattatttctttccgtaagctgtgcacactcataccacatggacagtatgcatcctgttctagaagcttcagtgtctgtggaaagttcaggggagttcatattcgatgccctgttttcatcactgccaaatgaaagcaggcgaaaccctatagaggagttgttttgttctttctttttctagtataatatctgtgggctgactgttgcctgagcatggaacacgcacccactccccccctccaattaaatacctgccccaactttaaacatatttcatacagaatatttaagggtttctggatgaaatacaaatttcatccagaaatacaaatttcatccagaaatacaaataggaaaacacacattgctcagtcctacttattttagctgtaattcattgtgttggatgattttgcagagtattctgatagtgaagacaaactgattccctagtgaagctgaaatcggtcaagcttcctgatggccaagacgtaagatgatacagcagttgaccatgtgcgaaagaccagaagggtcagagtttgacttgccttgaccccatgcaggcgttgccccgccacctcttcctgtctttttaattttatacccagaagaacaaaaacagagaaaaggcatttacgcttagcagtccagacctgccgggaaaagcataaaacaaggtgtataaatgctggaagaggaagccacaccatcctgctgcttatgagctcagggaagttctttttaaatggtgtcctaggtgcacacaaaagaaatgtgtgggcgtccgtgtgacatcacatgccataaaagacatcaagatgctaccaaaagtcagaccctcaggtttaatctgagtggttcaatataataataaaaataataatagccaactttcagtgtttactataagataggcaatatgggctgtacatgaatcttctgatttagtggaggtagataccatcattattcccattttacagatgagcaaactaagagagacaggaggaaattcatctaagaccaaacagccagtaagtgatataatagaatcgtgggagtcatcctgaactttgaacctcttcccttaactgcactacatataagaagccaggtttaagccgggcctggtggctcacacttgtaatcccagcactttgggaggccgaggccagaggatcagtgaggtcaggagttcgagaccagcctgggcaacacggtgaaaccctgtctctactaaaaatacaaaaaaaattagccaggtgtggtggtgcacacctgtacctagctacttgggaggctgagccaggagaatcgcttgaacctgggaggcagagattgccgtgagccaagatcacaccgtgcactccagcctgggcaacagagagagactctgtctcaaaagtaaataaataaataaataaacaaataagccaggtttgagctgaactatttagaaatataaaatgttgaagctggagaaaacgtgtagatgtcctgccatctgaactcttcctgttccagaggagaaatggtggcctagaggaatgggaggtgaagggtctaaggtcttaccactgctgtccccaggcagtagacacattggttttattaacaggaaattctttggagattctctgtaaatcctgcatgcagcgtgtcctgtgtcatgtggtgatgagaagctgaataaattcacacttggatcattctcgatctgtcctaggcaaggccctggagaggtactcggtgttaaaatttctggagtgactgtgacatcttgaagtataaagtagaacaaacctttgtgtatatagcccctctctccaagtactggctctttctggttattctctggctagattttctttcctctagctgatgtgtttggtgacctcactttttcttctctgttttgagaaatctatgaaatttaagataagataagcccattgggttaatagcatttcacctgcctttcctgtatactcaagaaataatcccaagagaagaatcttagctttaaaggcatcaagtttaacacagagcagggtgagatggaatgtatttaatagttagatgatccttcattcttttcttttttgtgacacacacacgtacatgtgtgcactcaaaatgcttaacttataaccagttccattgccacttcattcacttacgagcctaaagtttggaagtttgctcctattgaaagaaaagttgtaagatgttcaacattataaaaagtgcatgagttgatctgttcccagacagactcacagaattttacttaacatatattgttgcaaaaatgtttgcatccctactgaaaaatcattagtgtcactattgcaagagtagttattaaacagttaagaaaaaaagtgatattttccctaacgttaagtattcatgcctgaaaagagactgagaaatagatacagatttttatagctattctggaagaagtctccatgtgcttttgaagaatttgcaataggagcacaggctcatgtatccttagatgccttgcatggaagcacatgaccaagataaactgaacactagccaatagggagtggtgaggaccatggagtgctgcaagccccagtcccttttaatgtgcaccacggctactcaactccagtctgtagtcaccatgcaggaatccatcatctatgttgccagatcttttggtttctcaatggattcacaaacctacatttcaatttcctaagcagcacaagttaagtaaatcacacgtggtacctgaattcaatgtaaactgccattttataaactcagatttagagatacatgtagtccttcattcttcattctttcacatcattttctttggtacagatctaaaatagcatcattctaatattaatctgtcatgttgggtggtggtggggtagggtgctatggtttattttgtttggggtcaaacatgaataaaaaataaaaataggacttttctgagttaattgagtaggagttgggagagttagaggggaaaactgaatatcagtataaatatttgagcacctacaatgtgcaagttctggaaatccatgagtgaacaaagctgatgatgccctcatgacacttgtaaatttctcaataattctttaattgccattgtgactggtgctgcaagagtaaaggctgctactgtgagggtgtctgacagccctagcctggggtggcaagaaaggcttccctgaggaggtggcattgaacttgatacttgaaggcttagcaggagttgaccaggctgaagtggcctggtggagtaaggagcttctggccaagaaggccttgggtgcagaagtcctgaggttggagacagcaggtgcatggacagaggaaggttggcacgatcggctccagtgagaaagagaaagatggtaaggaaggaggttcagaaatcagatggaccaaacacatgaaaatgtttggtcattttaaaaagatgacttgcaatatggcaactgggccataaagagttaacaagaggagtatggcatgagtataggcctttcaaagtgaaagacaggaagaagcacaaaatacgtgttggataaaataatttcttggtgatgacattagcatggaatagttaccatcctagagaaggtgctagaagatacaggggaatgataagagtcatccaagaaagaaatgtgtgtttgtgtgtgtgtgtgtgtgagtatgtgtgtatactcgtgtgtgtatgtatgtatactcatgcgtgtatgtatgtatatgcgtgtgtggtgtgtgtgtatgtatgtatactcgtgtgtgtgtatgtatattcgtgtgtgtgtgtgtgtgtgtttgtatttctgacatatccatatatccagttgagtatttgcagagtgatgtgagcatgacatggttaatgattaaaatccaaattaggtttcatcaggaaaattaaaataatttaaaaaataataatacaacacagcaaatggtctggctgtgtttcctacttttattcataatactaatttatatcattataaattatgtgtaagggtgtctaccttgtcaagcctatgtttgtaaagaagaaagcattttgtatctcacaccaagaaaccaattccactgaattgtatgtgagttaatattcaaggcaaaaaagaccaatttaaatcaatacataattaaccttgatattagaattgagaatgaaagcccagtttagagtgttgagcatgattttcttaatgatatgaacagtgtgtttagtctttatgaagaaaaaaataaagggaagaaacactggatggaaagaggagagaagtaggtaaaggcatttcagaaatatggttaattgggtaattggggattgggtgtcacttgaacttaagcctgtggttaattcatggcttattcttcaggaatgacattggcagagcagttattggaataatgaattgctcacttgtcctgggcaaatagaaaattcccctggttgaataaaacagtgggaggaggcatttgataggcttataatggcttaagagcctgggttagggttcttcccctgacagtcagaaaagagaactttgggggattggatattttcagcaaaggggcaaaattaagaaaggattataatcaccttttttttttttttacgggaattgacattgatacttaaagcattttcaaaatgaacgtcaaaaacagagttaagcagcagaatattaagtcaaggtagggggctgatataataaggagtttgaggaatttta

SEQ ID NO: 1860 - DNA, 1344 bp, Homo sapiens
acatgattcttttcataaggatgaacaacatgttttcatccctttaggtgattttcatcttaaatcccttttgatctgttcctaaattgcagccctagctttcttttggctcactctcttatttttaaatgaggacaaaagcagtcctaacctctgagagttagcctcgtactatcaattaagcctcagtgttgctagaagctaacctggcaagggccagctaattcatggtgttctccatggtgctacacaaaaacaatctcttagaacaccaacagcaaacaagaccaatctctgaccatcatggtgtaagatgataccaagaccactctgtcgttatatttgagcatagacaaaaatcagaacattcttcaaaccacaaaagtgaataaaagtctccttattctgcctaatgcaagagactgctgcttttttcttttgagacaaagtctatctctttcatccaggctggagtgcagtggcatgctcatagctaggtgtaatctcgaactcttaggctcaagtgatcctcctgcctcagcctcccgagcaggtgggtctataggcacacagcaccatgccagactaattgtttttcttttttttttttttgagacagaggctcactctgtcacccagactggagtgcagtggtgcaatctcagctccctgcaacctctgcctcctaggttcaagcgattctcctgcctcagcctcctgagtagctgggattacaggcgtacgccaccatgcctgacaaatattttttatttttagtagagacggggcgtcaccatgttggctaggctggtctcgaactcctgacctcaggcaatctgcctgcctcagcctcccaaagtgctgggattataagtgtgagctaccgcaccaggcccaaactaatttttaatttaattaaattttttttttggtagtgacagggaatcactacattgccagggctggtcttgaacttctggcctcaagccatcctcccaccctggctttccagtgttgggattacaggtgtgaacgaccgtgcccagccaactgctgctgctttaccaactgtaactttagcctcaagctatccttcctatcttctagaataaaattattaagatactcaatcctaaaactgcccaagagcaactaaagtagaggttcactgaggtgcagatgagactctcaccacgtgactagaaccctgaaatgaaattccactacttctaatatatccaatagaaagagaaggcatgacaatatccactgcgatattgttcataatagtttctgtattttaccaaacaaacattaaaacagcaatgtacaaaaaagttaatc

SEQ ID NO: 1861 - DNA, 1063 bp, Homo sapiens
gagatctatttgtgtggtgtcatttgcataaaaataggacaagtgtttctgtgcgttcatacgcgggaggcgaaatccttattgatgtgtctgtgtggagccttcgattgtcggagcggtttgatttagggtgtttgtgttgccttctacaagaaaggagagaaagtccttctcaactccttcggcggcctgggcccccagaagcatgtccctctgcgcggccggaatggtccaccacttgggccccaagcgcgccggatccacagcgagcaggttgagggccaggcgggaggcccattatgactcataaaatcgggcggcctaatcgccagctgccaacccatttacatgtggagcttcccaatgctcccttcgcccgggcccggcttcctgagggtttgccccgacacagctagagccgccaagtgggagctaatctagtggcctctccttcccgtcggcagcgtggcttcccttccccggcgacccccgctctcttggcctactgcgctgctcgccagcaactcctcagcttggacaaatagctgggagggcgccggccgcgcggagccagtaaatcaatcattaactcccaagcgaggcctggaccaggggagggagcggcggccagagccgagtccgcgaggcgagcgcaaagcctccaccggggttaggagccacccacgcgccaacgaaccgggtgcgtgaaggcgggtcccgccatggcctcccgggcccctccagaagcctccgcccgccgggcctttcaagcccgcaccttgcctggccaggcaggtcgcgttacagcgctgcccctgggagagcttgaacattaacgagtcgcctcgggcctcagcggcctgctctccacaggagagcgtcccgcgcttgggcaagctcctcggatccggccgggctcctcctggctcaggcttgctaaaccaaactgatcgcaccctgtatcgaccaatctccctgcggcaccctcttccctcagcccacggtggagccggcacgcagggggttaaaagccccggttcgctctggctcctcggctgcgagg

SEQ ID NO: 1862 - DNA, 3372 bp, Homo sapiens
ttgacattgaaattatatctgttcgttgatcgattctgcaaaacatggctttatggagcgggaaaaaactttttcgtctttgttcagaacacttttagctttactgtgagaatttcaatttgctagaggcaaataaactagtaaaatatgtctattccatagtaaaaggggtcattcaaaagcctgtccttattaaaatatacattgattataataaggtcagtgatttcaggcctgattagctttaaataaatgtaatgtcaaaggaatataattagttcctcattaaaatttttcatgattgacagtgagtaaaaatgaccttcacaacttgcatcatttagtcatgttctaaggatgacaaagggcagggcatcttctatgaggtaaatgtgtatgattgcagcctgaggcacatgcacttggtcccttaccctacctaaccctaacgcccaagacctgatccaagccagaccctgtgcttaggtgtgtaggctgtgtaaaggaggacccagaagctttgattctcatggggatgctttgagagaaaaagaaacctttgaaccggcaggacctgatttcatctgtgatgatgctgatgatcagaaattatatataaaagcaaatagcaacgtgcctatcagatataggggatttaaaatatgttgacagaaaactttctcagtgaggccactgaccttctaaagaggagctaatagtagaatagggatattaagatacaggtgatgtcaatgaattttggccaaaaccaatcttcttacctggagtaagaaagtcgtgtttcaaggagtttgcatgagtattaattgtggttgatgatgatgggaacctgccctgattattaggtatgattctcagagaatgtgtgctggtgctaagcttgcatttctcagaacccccaaaactctctttgcaatattatatagtttcattttcttgaacttattcatttgttaaatatgcatttactaagcaccaactatgtacatggcactctgctagtcaatagacaaataataagatatatgtactttggaccctgcattgaaagaaaaagcaaataatgttttttaaaaaactactttatgcttgattgttataaggaactttatgtgtattatctcttttattcctaataataataagaacaaggatgattgataatgctcactctgtgccaagccctgttaggcattttatgttcattaatttaaccctttataacaactctatgagataggtgccatttttacaaaaatggaaactgaggcagagcgatgttatcttgataaaactcatagacttagtaagtggcagagccaggatttaaacccaggcaccaaacttcatgcgcttatccactatatatatggctccacatcattttctttagtaatcaggacactgaggctcagtgaaaatgttttttcttaaagtcacagagatggtaaatactagaaccaaaatttaaatctctgtctaccataaaaatgtcctcttctcactatattaaattggcctcaatttagtatttaagacaacgtgtacagtaggaatacaaaggaaaaatggtcttaaaggagcccatctacttcttattttaactgctccatgtggattctatcacgcagtacatcaaagtaagtgatttaaccaatcatttgttctgcttgattttatcaaaagaggtcaaagtaagaatttcacagcaaggcttaaatgggaattcaggtttccttgctcactcattcattattcaacaaatttctattgactgccttaccatgtgcaagccattttggctatgtcctgattaaagatgtgcccctcctgcaccgcctccctccccaccccaatcctggaactaaatttcattctctgcagaaagccaggctaaagagaattcagcaaaccactttattctcataaattggcattcttagacctggaaattttgagttctatctccagtagcattgtttataccttctatttcattctgattacatttcattagcaaaacatagcaaatgtttataaaatcgtcagtcttctaggtgaaacgatgtaagacaccattcatttgattttttggaaatatcaaattttatgttcacaattcctctattctactctgattatttaggtaaaattaggttaaatatagataactatagaattaaaatttaaaaaactgtgcctttacacgtttggaaaattactcaattttttttcaaataacgccaaccatatatattgaaaataacattattccataccacaggtgacatattcttttcctatccctagcagcgacttccccaagtccctgcttgtctcaacagtttgaggaaaaaaaacaccagaaatatacatgttccagaacaatgaataaattcccaaataactttatatacattagtgaggatacaatgaggagtgtttatctagctaaatatgaggcatattaaaaattgctactttaacccagatatgagcaataataggagttttatctacgcctccttcctttccttctgctgacaaaggatacatttaattcttgacgttaatatcagttaaaatgagatctagagacagatataattagagagctagggagagaattaagttagtaaatcttaagaaaagactgagtatactgatgataagaggatatttaaatagaattttgaaaaagatcaaggatcaataattatacatttaaatatacatatatgtatgcatatacatatgcatagttttacataaagaaactattaaggtaagagctatggctttgacagttaatactcaagaaatatttactgagcacttggtataaataaatagatatggagcacaatacaaagatacagcagatgctctgaacaattaagtccttatcacaactcaaattccatagctagcattttgctgagccaagaatttaaatggtacttaaaatttatagaggccggggactgtggctcaagcctgtaatcctagcactttgggaggcctggatggctgaggcgggcagattgcctgagctcaggagttcgagaccaccctggcggcaacatggtgaaacccccatctctactaaaatacaaaaaattaaccaggcatggtggtgggcttctgtcatcccagctctttgggaggctgaggcaggagaatcacttgagcctgggagatggaggttgcagtgagctgagatcatgctactgtactccagcctgggcgacagagcaagactctgtctcaaaataataataataataataaataatttaaaaatgtataatcagatgttaaatattttcttgcaaaaaacaagggagctgg

SEQ ID NO: 1863 - DNA, 1161 bp, Homo sapiens
aaaactgtgcctttacacgtttggaaaattactcaattttttttcaaataacgccaaccatatatattgaaaataacattattccataccacaggtgacatattcttttcctatccctagcagcgacttccccaagtccctgcttgtctcaacagtttgaggaaaaaaaacaccagaaatatacatgttccagaacaatgaataaattcccaaataactttatatacattagtgaggatacaatgaggagtgtttatctagctaaatatgaggcatattaaaaattgctactttaacccagatatgagcaataataggagttttatctacgcctccttcctttccttctgctgacaaaggatacatttaattcttgacgttaatatcagttaaaatgagatctagagacagatataattagagagctagggagagaattaagttagtaaatcttaagaaaagactgagtatactgatgataagaggatatttaaatagaattttgaaaaagatcaaggatcaataattatacatttaaatatacatatatgtatgcatatacatatgcatagttttacataaagaaactattaaggtaagagctatggctttgacagttaatactcaagaaatatttactgagcacttggtataaataaatagatatggagcacaatacaaagatacagcagatgctctgaacaattaagtccttatcacaactcaaattccatagctagcattttgctgagccaagaatttaaatggtacttaaaatttatagaggccggggactgtggctcaagcctgtaatcctagcactttgggaggcctggatggctgaggcgggcagattgcctgagctcaggagttcgagaccaccctggcggcaacatggtgaaacccccatctctactaaaatacaaaaaattaaccaggcatggtggtgggcttctgtcatcccagctctttgggaggctgaggcaggagaatcacttgagcctgggagatggaggttgcagtgagctgagatcatgctactgtactccagcctgggcgacagagcaagactctgtctcaaaataataataataataataaataatttaaaaatgtataatcagatgttaaatattttcttgcaaaaaacaagggagctgg

SEQ ID NO: 1864 - DNA, 3464 bp, Homo sapiens
gttgtaatggcatggattattcactagatggcaaacatagtttgagttggaaagaagacattaaaaaatgtaaactgttcaagtttgctgcttggtaagaataaaaggctcacatccctaaatggtgagcaggatagcgaaaaagaacagacaaaaaaaaaaaaaaagaaaagaaaacctaagctattaagctatttccccacagccaacatttaaaagtcaaaaaattaaactggacagttaaaaatggatgtcatttggcctcaactgccttttcagaattcaggattatactgccttacagtataatcctcccatcaccacagcccagtgacaggagactaccaccctttgttcagaggtacaccttcctactaataaagcttggctcatcagccttctgggcctccagtgaatcccacttcttctaggtcaccttattggctatttcctctgccaagccacttggctcttccagtcagagttgttttattcttgcctcggcactcatagcacatggccaggatgtctgttctgcactctttctgctttacacgatagtgatacacacatctgctctctaggctatgtgataagctcctttgaaacacaggatgcctgcccacatatctttctggttttggtagtacccaatcaaagacccttgcacatgctatgcactcggtattatttgctttaggaggatgggatcaggttggaaaaatgtttctggggaagtttctggtagagaagaggttaagctgaacaggaattttttcctttaaattaaattacattttgtttgtaaagtgtatataatatattacatacatttttttctttaaataaaattatattttatgtctttaaattaaattacattttattgtggtaaaatacatgtaatataaaatttgccattttacccttttttttttattttgagatagagtttcgctcttgttgcccaggctggagtgcaatggtgcgatctcggctcactgcaacctccgcctcccaggttcaagcaattctcctgcctcagcctcttgagtagctgggattacaggtgtgcaccaccacgcccaggtaattttgtacttttagtagagacggggtttctccatgttggtcaggctggtctcgaactcctgacctcaggtgatccgcctcggcctcccaaagtgctgggcttacaggagtgagccaccgcgcccagcccccatttttaagtgtacagttcagtggcatcaattacatatacaatgttgtacaactatcataatgatctattcccaaaccttttcaacatcccagacagaaactcggtgactatccagtcataactaccctgtttttccctgcctgcaccccttggaaacctctaatctgcttgtctctatgaatctgctggttctggattttgcatataattagaatcatacaatacttgtcctttatgtctgacttgtttcgcttagcataacatcttcaaggttcacccatgttgtagcatgcgtcagaattccctcctttttaagactgaataatattccatggtatgtacatatcacattcatctgttaatggacacttatgttgtttccaccttttggctattgtgaataatactgctataatactagcatacagtatctgtgagtccctgttttcagttctttggggtttatattcaggaatggaactgctgggtcatgtggtcattctatgtttagcattttgaggaactaccaaacaggttactttcaaatgagtaacatatgctcatagtacaaaatgtaagaggtagatgattatacagtgaaaaaaaatctctctcactccttcatcctgagggcaactcctgttaacagtttcctccatgttcttttagaaatagtgtaagaatttataagaatatatgtattttttccttctacacaaatattagaatactataaacacttttctgaacatgatttttatcatttaacagggtatcttggaaatccttccacataagaacatagttactttttttttttttttgagacccagtctcgctctgtcgcctaggctggagtgccgtggtgcgatctcggctcactgcaagctccacctcccaggttcatgccattctcctgcctcagcttcccgagtagctggcgctacaatcgtctgccaccacgcccggctaattttttgtatttttagcagagacggggtttcaccgtgttagccaggatggtctcgatatcctgacctcgtgatccacccgcctcggcctcccaaagtgctggtattacaggcgtgagccaccgcacctggccagaacatagttactttttaagaacagggaggtaatattctaccatgcatctatactttaatatttaaaccagttctttactgataggcatttaaattgcttctaattttttttctatttcaaagtaactattttgatatttacgctgactaacaaaagtaatttttcacatttgttggaaaaatcttacaagtggtattgctggtctttgacacaaatgtttgtgatgatgtttgtaagagacagttctattttatctttttttttaagcaaaaatgattttacaagggagatctcatatgtatgatattgagaaatgtcctataaaaatattataaaacattcttgcaaattttagtttgtaggaatcagaatattcacattttcttgtttttaggactctcttagctccataacaagccctttgctattttacaatatggtagctcataaatttcctgaatgatgaaaattttaaactgcgttcagcaaactagtggaaactatttagattttcactgctgtagaaaaaagggctctggaatttcaaacgcaaaattgtggttgaatgtaagccaaagcacagaagattccatgggacactgtgtccaatctgcctccttgatccaatccacagaggacaagagttccagctgctgaggaatccaacgtccttcggaaatactgaatcctcacaacatgggggttgtggaaatgatagcattcagcttagggtaagaatctgagcccctagtgtataaaatatttatgatcttaaaagcaatcttgcttttggggctagtgggcactaagccccggataactacccatcatgccagcaatcacttcatccacattagttcaaagcaatttctaccaaacagcattctcaggcttcttgttaaaagtttttcttcaaaattcactaactcttatggcagtgctacgtataatagctaaaaattggaaataaatgtccaataataaaggaatggttaaattatgttgagccagtcaatggaatgatcaccttgtagccactaaaaatgaccgctatgaaggctcagtagcacaatacttctggtactgtgttaaaatggccccaatgcaatgttataagagaataaaaatgtgg

SEQ ID NO: 1865 - DNA, 5970 bp, Homo sapiens
agaccagatcataggcacagagagataagaacattgcataactaagcgtattcctttctccccaaccacatccccaaattcagaatcactgtgacggttgacagaaaagtgcaggagaaatctctttggtcataatgagaaagaaagatggggtggagaagctcggatataccccctgggcaaagccagtggtgtgctgagaaatgcttagcaaccaggtccgggtggaggagaaaccctaactgtagtgtttgccaatttcgatggtgtaaatattcctggaaggccaaggcaggaggatcactaggtcaggagttcaagaccagcctgaccaacatggtgaaagcctgtatctactaaaaatacaaaataagcctggcatggtggtatgcacctgtaatcccagctacttgggaggctgaggcaggagaatcgcttggacctgggaggcggaagttgcagttagctgagatagcaccattgcactcctgcctggacaacaagagtgaaattctgtctcaaaaaaagaaattcctatcatggccgcttccaagttaccaacatgatatcactagaacatacagtttggggaagacgtgcaatagttacagtattttcaccatatagaaataataaacataaatagcatagagagcaataaatttagtaaaataattagtaagtcagaggtgtgggtatttattatcttttaaaaatagttttaacatcacagtgatgttagtgccaaaaatatacttcatccccaaattctgtactcctaccttacctcttacctctttttattccaaagcaggaataatggtgacatttaaaaaacaatatctaaaacatcatcttcatttttttttcctattcttagcccctttggttaaatttctcacttttgggtctgtatcttcagaggaccactgccctacacatctggaaatgtttttctgctccaagtcataaatctccaatcccaacccatggctacctactcaaactctttatttcaaaggactccttcatcagaaattgggcagaaaaagatcaatgaagtgagtacagctgtttacccaaaatgccacagactgtccattctacatctacacattttatttttaagaatagttaaatggcaccatagagcaaataaataagtaaaacgttaattataaagacttattttctggaaatacctatgtattttgaataaaatggattacaccttctcccttcatccatgtaccctttcattcagttcacatctattgtacactacaatggacactggagacacaaaaatgacaaaaacacagtctgtgacctcaaggaccttgccctctcacacggaagacagacaatagaaaaaataatggcaaatccagtgattctaatatcacactacatataaaatccacccatggaaagtggcataaaccaaactagactagactgttatgaagatcccaatcaggggctaagagttcccttgtatcttattgtccacatgctttgttgattagcaacagtttaaacattaagatcccatcaagataaaccaaaggaaagatcatctccaactgcttatgagattttgaaggcatcatccagtggtaacacactgagatgcaaggctttttgtaaagaattgacaaaggtattagctccctgcttcctatctgtggccctctgccaatgcctcgtctctgcatttgtttctcccctccctttctacggctttccttttccccatgtttattcctattctccttcatctaaatgtgccatctgtaaaagcctactttgaaaaagatcactgttaaattctgaacccttattttcctgttcttaatataaagttcataagtttatggcctcagaagtctctctctctctttcttaacaaaagaactgactaaactaagttatttttatttccatgttgcttttggctggttttcttttgtgcgtcagaggcttccaaaaggttcccaactctagatccaaaaagttcaaaaaatgattgagtacagaataaaatattgccctcatccagaggggagctgagggtcacgggcattaggagcaacgggggaagcaatccaggattctggagccctaggaagcaagacctgccatgacccagtcggccataatgtgggcccttatttagcagattagctctagtatggtcataacaattattaaaatattgaaatgcttccctctggaaatattgcacataacacccaaccccttccaaatacacctggcctcccagactctcccaggatccctggcccaatctcctcacaatcaggagttaaggcctggcccagcagaggatctccaggaccctgccccagtgcttctaccctttgacatacccatgctccaccttaatttcgttttccgaaaaataaaggacttgaacagattgtctgagttgcactataattgcaattatgtcaaagaacaaggacgaaatggaaataaaaaaacctaaaaaaaagtttgttaagaggatggaatcacaggttatgtttttttctagacagacagcagtgtcaaaactctgggtgcaagctgcctgggatggatccccagctctaccatgtgctagttgtgggatctcactatgcctcaaactgcctcatctataaaatgggcataggccaggctcagtggctcatgcctgtgaatcccagcacgtttggaagccaaggtaggaggaccacttgaacccagaagtctgaaactagcctgggtgacatagcaagacctcatctctacaaaataaaatacagtaaaacaaacataaataaataaattaaacggccataataagattacctactttacagggttgttctgagggttaaatgtattcatgtttgtaaaatgcttagatgagtgcaaggcacaaagtaaacaccacgtaagtgtttattaaataaataattcattttattctgtcgttgtaatgtttgctcaataaatttaaaaattaagaaagtttcacaacagaaaaaaaacactgtgacactatgaaacacttacgtaacatacacttttgcttaataacccagcactaaaacagctggggtccagattttacactgcactgtgaatttagggaaactaacacactggaatgtgttcccactgaagcataagatgcgatttgtatgattctctttgtaatcagaaatgtcacaggcttatgggaaagttaggtttacatgtttctcattttaaccctgcaacaacttttagccacaccctagcaaatacattttattttgtggtgctaagacttaaaggattgtaaacacaaaaccagaccttgcagagctacagcttttcttgtgaacacaatgactcagcctaactacaagtttaaagagacatatcttatgtgttgggtcccctagtatcaatctttagtaaacatctgggatggacaggaaattgctacacactgcttttagttactaaaaaggcaacactacctgagctcaagcatagtttagataggtactatttgcactgctatagaggacaacactgacaattgttatttttctgatagatactcaggagaggaaatgatcaataacaataattcccttacgtgttccttcctcttgacagctaaaccccacaatacccttagacacaagtttaaatacatcacaagcttatcctcaaacagtaatgtattaggtctttcctgctgtagataagatttgttaaacagtctggctatggctttttaccttttctcttttaaaagtgcatttctcagctgggtatggtagctcatgcctgtaatccagcactttgggaagccgaagtaggaggattgcgggagcccagctgttcaagaccagccctagcaacacagtgagacgccatctttataaaaatacaaacaaaactggccaaggatggtgatgcgcacctctagttccagctactcagaaactgagatgggagtatcacttgagcctaggaggtcaaggctgttgtgccactacactccaacctgggcaacagagtgagaccctgtctcaaaaaaaaaagtttaaaaggtgcatttctctaaagctacgagaaggaactcaaaccttgcttagtgataaaactaaagcctgcaacacaaccattatcattaaaatgttattaaaaccctgtaagaaagatgaagagtcttgtggatggatggtggtgacggtagcacaacgatgtgaatgtatttaatgccactacatgtacacttaaaaatggctacaatggtaaattttatgttgtacatattttaccacaacaaaagtgaaattataagagaaaaaaaattttttaaaaaaacatcctgtaagagaacatttatacactgtcggttggaacgtaaattagttcagtcactgtggaaagcagttgcagatttctcaaagaactcaaaacggaactaccattcaacccagcagccccattactgggtatatatccaaaagaaaataagttgttctaccaaaaacacacacaaattcatatgttcaccacagcactagtcacaatagcaaagacatggagtcagcctagatgcccatcaactatggaccggataagagaaaatgtggtccatatgcatcatagaataccatgcagccataaaaagtaacacaatcgtgtcctttgtagaaacatggatgcggatggaggtcattatcctaagcaaattaatgcaggaacagaaaatcaaacattgcatgttttcactaataagtggaaggtaaacattgggtacttatggatatagagacggcaacaatagacactgggaactactagacgtgggagggaggaaggagagcaaaagttaaaaaattatcaggtactatgctcaccacctgggtgacgggaccagttgtacccccaacctcagctgcatgctgtatgtccatgtaacaaacctgcacatgtaccccctgtatctaaaataaaatttcaaattattaaaaaaaaaaaatagggtcgggtgcagtggctcacgcctgtaatcccagcactttgggaggccgaggcgggcggatcacgaggtcaggaaatcgagaccatcctggctaacacggtgaaaccccgtctctactaaaaatacaaaaaatcaaccgggcgtggcagcaggcgcctgttttcccagctactcaggaggctgaggcaggagaatggcgtgaacccgggaggtggagcttgcagtgagccgagatcgcgccactgcactccagcctgggcgacagagcgagactccgtctcaaaaaataataataataataataatgacagtcctacttttcctttgtaacaaaaataaaagttacctataagagttaaaggtaaataaaatttgtaattttaattaagaaacactaagtaaacatacaacttccaagaagccgggttccccactacctggttataagtaagtctacaaacctaaatgagcattgtacagcgcttactatagttcataattattctgtcatcagggacaaacattgtaaagacactttttcctcaaagccttagcattcaatttttttttttttttttttttttttttgagacagattcttgccctgtcgcccaggctggcgtgcaatggctccatctcggctcactgcaacctccgcctcccgggttcaagcgattctcctgcctcagcctcccgagtggctgggattacaggcgtgtgccaccacgcctggctaatttttgtatttttagtagaggcggggtttcaccatgttggccaggctggtctcaaactcctgacctcaggtgatctgcccgcctcagcctcccaaagtgctgggattacaggcgtgagtcaccgcgcccaggcagcactccaactttttatatggattgttaactgtactggttcttgagaagccagactga

SEQ ID NO: 1866 - DNA, 3176 bp, Homo sapiens
agaccagatcataggcacagagagataagaacattgcataactaagcgtattcctttctccccaaccacatccccaaattcagaatcactgtgacggttgacagaaaagtgcaggagaaatctctttggtcataatgagaaagaaagatggggtggagaagctcggatataccccctgggcaaagccagtggtgtgctgagaaatgcttagcaaccaggtccgggtggaggagaaaccctaactgtagtgtttgccaatttcgatggtgtaaatattcctggaaggccaaggcaggaggatcactaggtcaggagttcaagaccagcctgaccaacatggtgaaagcctgtatctactaaaaatacaaaataagcctggcatggtggtatgcacctgtaatcccagctacttgggaggctgaggcaggagaatcgcttggacctgggaggcggaagttgcagttagctgagatagcaccattgcactcctgcctggacaacaagagtgaaattctgtctcaaaaaaagaaattcctatcatggccgcttccaagttaccaacatgatatcactagaacatacagtttggggaagacgtgcaatagttacagtattttcaccatatagaaataataaacataaatagcatagagagcaataaatttagtaaaataattagtaagtcagaggtgtgggtatttattatcttttaaaaatagttttaacatcacagtgatgttagtgccaaaaatatacttcatccccaaattctgtactcctaccttacctcttacctctttttattccaaagcaggaataatggtgacatttaaaaaacaatatctaaaacatcatcttcatttttttttcctattcttagcccctttggttaaatttctcacttttgggtctgtatcttcagaggaccactgccctacacatctggaaatgtttttctgctccaagtcataaatctccaatcccaacccatggctacctactcaaactctttatttcaaaggactccttcatcagaaattgggcagaaaaagatcaatgaagtgagtacagctgtttacccaaaatgccacagactgtccattctacatctacacattttatttttaagaatagttaaatggcaccatagagcaaataaataagtaaaacgttaattataaagacttattttctggaaatacctatgtattttgaataaaatggattacaccttctcccttcatccatgtaccctttcattcagttcacatctattgtacactacaatggacactggagacacaaaaatgacaaaaacacagtctgtgacctcaaggaccttgccctctcacacggaagacagacaatagaaaaaataatggcaaatccagtgattctaatatcacactacatataaaatccacccatggaaagtggcataaaccaaactagactagactgttatgaagatcccaatcaggggctaagagttcccttgtatcttattgtccacatgctttgttgattagcaacagtttaaacattaagatcccatcaagataaaccaaaggaaagatcatctccaactgcttatgagattttgaaggcatcatccagtggtaacacactgagatgcaaggctttttgtaaagaattgacaaaggtattagctccctgcttcctatctgtggccctctgccaatgcctcgtctctgcatttgtttctcccctccctttctacggctttccttttccccatgtttattcctattctccttcatctaaatgtgccatctgtaaaagcctactttgaaaaagatcactgttaaattctgaacccttattttcctgttcttaatataaagttcataagtttatggcctcagaagtctctctctctctttcttaacaaaagaactgactaaactaagttatttttatttccatgttgcttttggctggttttcttttgtgcgtcagaggcttccaaaaggttcccaactctagatccaaaaagttcaaaaaatgattgagtacagaataaaatattgccctcatccagaggggagctgagggtcacgggcattaggagcaacgggggaagcaatccaggattctggagccctaggaagcaagacctgccatgacccagtcggccataatgtgggcccttatttagcagattagctctagtatggtcataacaattattaaaatattgaaatgcttccctctggaaatattgcacataacacccaaccccttccaaatacacctggcctcccagactctcccaggatccctggcccaatctcctcacaatcaggagttaaggcctggcccagcagaggatctccaggaccctgccccagtgcttctaccctttgacatacccatgctccaccttaatttcgttttccgaaaaataaaggacttgaacagattgtctgagttgcactataattgcaattatgtcaaagaacaaggacgaaatggaaataaaaaaacctaaaaaaaagtttgttaagaggatggaatcacaggttatgtttttttctagacagacagcagtgtcaaaactctgggtgcaagctgcctgggatggatccccagctctaccatgtgctagttgtgggatctcactatgcctcaaactgcctcatctataaaatgggcataggccaggctcagtggctcatgcctgtgaatcccagcacgtttggaagccaaggtaggaggaccacttgaacccagaagtctgaaactagcctgggtgacatagcaagacctcatctctacaaaataaaatacagtaaaacaaacataaataaataaattaaacggccataataagattacctactttacagggttgttctgagggttaaatgtattcatgtttgtaaaatgcttagatgagtgcaaggcacaaagtaaacaccacgtaagtgtttattaaataaataattcattttattctgtcgttgtaatgtttgctcaataaatttaaaaattaagaaagtttcacaacagaaaaaaaacactgtgacactatgaaacacttacgtaacatacacttttgcttaataacccagcactaaaacagctggggtccagattttacactgcactgtgaatttagggaaactaacacactggaatgtgttcccactgaa

SEQ ID NO: 1867 - DNA, 14049 bp, Homo sapiens
aaattcagagagccactatatcctttcttatcctttcaataaaaagatgcacaagtttccagggaaataaaacactaacaataaaagaagttgacgaactgaaagcttttctttaggaaaatcactgaactccaagttcagataagataaccaaaaaggactcaagtgtgccctaattagaacaaatgaacttcaggctacttcattttgttaactctgaagaagattcaacaggacctttaaaaatgtactagaaatgattcagtcttcttcatccatacattagaaaccataattttttttaagtagtggacttgaagtcaacacctgagtacttgtccaactttgtccttaattcattttctttctgtttcctcatttgcaaaatgacatgagactccaagatttctaaggtccgtctgagctctgatattgtattattaatcacaatctccaacttaattgacaaaacaactcaataattatttctatcataaaaataatctgattaaaggacgcaatttattacaaaatcagaaatagacacctcatccaaaggtcaattcctaatttcttgtataatccaaatcttccaaatgcaataatttaatccagaatatctagggagtgacatagcctctgtcccattaaaattggattaaaatccaaaataagaaaatcttgtaaatgtcttttctgtagtcctcagagaaagacagagtgagtgtactccttttgccagagtcagttttctctttagatcatattctttattccaaacacttactggtaactattacgtccactaagtcttctctccttaggttaaagatcacagttctatgacctctcctgacatcacatgattttttcaccactcacatacctgttcactgttaatgtccccctttaaatgtgacacccagaatccaataaaataattctcagagtctcattgtttcagagtatagtggcactgtttctggcacttatttattgatgaagataaaaccaacttgacagcattgctttaacagttaaataagataatgagtgtaaagtcttaacacaaggtttggcagatagtaacctctcaataaatggctactgctgctgtgattgctagtaacaataaattgtaatactatttcatgagtattagagcttatccccccaattcagttgtatgctttagctctcaataacactgaaagtttgccttatacattattagctgtttttccccacatcagggataggtagaaaaaatgctgaggctcaatttaaatcgaagatcaatcagaaaccaagataaagtaactctgaaattaagacttaaattaatggcaaacagggtatgatttatttaaggagttaatttatcctctgttttccagaacaatttgattatatcaaacaatttgattatatcaatataatttgattatatcaatcacttttttcagctaaagagcactatccctcaatcataccatttaaaagatgaagcaaatgtatgtatcactgacatgtgctgagaaggcagtctggcacagagttgaagggagtgagctctggaaccggactgactagagttccgtatcctagatctaccacttacccactgtgtgatctaaggcaaattacttaacctctctggtctcaggcttcacatctataaaatgtgagtcatgacaggacctatctaccttatgaggggcagtaaattatcctaaacaacattgctaaaaatgtattatctggaagtctcagacattttcaatttttataggtcctcatctctgttagccattgctgaagtcaatcaacatgtttgtattctctgcatatttataattatctattttctgaaacatccatttgtttttacggtagattttaagattactgtaaaaaaatccatctttattttaatacttaactaaccatatatgcctcactacagcaaatcatgtgttggtattaacagagaattatgagataaagaaacaaataaaactgtgcttgtcatacctgcagctgctctgcatatacacctgtgctgtctaatacgacagtcacatggggccatttagcacctgaaatatggcagatgtgctgtgagtgtaaaatataggccagatttctaagtacaagcaaagaatataaattatcactaagcttttgtcaaaatgacaatatttcggacacagtaggttaaataaaatatattacctacattacttccattgatttctttttacttttttttaatgtggctactagaaaatttaaacttacttgtgaaattctcatcatatttctattgaatagcacccatacagaagatcctaaaaagtatgcctcattaaaatcaggacaagatctatggtctaaagtatagcagaaactaaatgtagaatttacaggaattttcagagttcagataattaatttcaaactcttctccaacccccaccgagacatatccttttataggtactttttaagtaccgcgtccagtctagagccatctaagaagctttcattagccagtggtgactttcaaaggtttattctattttccacaagctgacaaaatttatttataacaaagccaaaggactgctttccagcaagggagctgtttactgaagagatttggccttagcaagtaggaatccagagaatttaaaagctgacaactgaactggcaaattggccccagtactgggactttgcctatagctccaaagcatgtactcagaggtctaggacaaatatggccttgggatgtgaatgagacccagaagtctggccttccctacataatgcaaatgaaacttggcctagtctcttcagctatctaattactaaacaaaactcccagacgccagtagcttttttgcaaagatcaataaaaatgcagagtggaaagcggagatactgaaatgctatcaacaaatgctacaacaatatattgttgttctgagtctgaaagttccagctggaaaaggcccaatgtggcaataatagagaagtagaggaagagcagaagcaaaatctaaggaggaaaaataaaccaggaagtattaccctaagatctctttctactcaaaatgaggtgcaccagtgtattagtctgttctcaggctgctattaaagacatgcccgggactcagtaatttctaaaggaaagaggtttaattgatgcacagctcagcttgactaggaaggcctcacaaccatggaggaaagcaaacggccaaaggcacatcttacatagtggcaggcaagagagcatgtgcaggggaactgccttttataaaaccatcagatctcgtgagacttattcaccatcaatagaaacagcagggaaaaacccacccccatgattcaattacctcccaccaggtccctcccatgacacgtggggattatgggagctacaactcaagaccagatttgggtggggacacagccaaaccatatcagccagcatccgtagcatcacctagtagcttgttaaacatgcagatctcaggccccactccagaactaaagaatcagaatcttcacttcaacaatgtccccaggtgatttccacagtaatgtctgggaaacaactggtcatccacacaagatccaaggacaccggtttctttaaattcttactcttattacccatctgttgccctgtggttgctacctggaaacatggggccttttgtgtttaatgcatgcaatgaacatttagttgactgaataaattcttggaaaatgtgatcttatacatgcttaatggacggtggggaatctgtgcctcagatgagagctaaagaagtcatcagttactgaaaacatgtggacagagtgtacctcagatccatgcatattgcataactattaacagaactagggactccctgaggttgaacaagatgagcagacacaattcatacccaaaagacatttatttaacggctcagacaaaagaaacagttttgatttttgatggagatgggaagataaggactttatgttgaaaaaaatcaacagcattaacaaaaattagtgtttacaacagtaagctagatgatttgggctgttttaaattacaccaaaggtcctttgggaattatgctactacatgaagcatcatatttttttcctctttactgtctttcccattggtattcgaacatgctgttacttcctgcatttttaaaacatctcttgacctcatttctccctgcagctacatttctcacattctctttacagcaaaaatctttgcaatatttttctacatttgatgtttccgtttctctacttctgcgctctcttacatacccactgatcaacatttggtccccactactacactataatcccagttggttatcaacctcagcaatgacatctccattgctaaatccctgggtcaaatctcatttgcccctcattttactttacttcccgggagaatctgactcatcttgcttgaagtggttttttcacatggctggcaagacctcgcactctcgattcccctcattcgctgctttccttcattctcctttattggtgccttctcatctcttcaatctcagtgtggaagcagcccaggttttggccctcaacttcttttcctttctattgacattcgctccctgtggatttcatccagtttgtatattctgacaactctcaaatgttcacctctaacccagccccttcctctgtaatccagataaatatatccacctgcctaccagacagctccctgactgagctcctgatcctttccaaaatcagcttctccctatctcagttaatgcacctccatccttcaagatgcacaggccagtattttgcaagtcacccatgctttctcccactcacatcccacattcagacaatgagaatatccttcccactcaaccttcaaaacataccatggtggtccaagccaccaccctcactcacctaggttacaacagcctcccaactggttttcctacttccactcttccccgcttcagtctattctcatgagacacagcagcagcatgtcctccaagaacatcagccagatcatgtcccatctttatttgaaactctctaacaggcttctctgctcactctcagtccaaaccgaagcccttgcaatagcaacaaggccccacaggacctggcgacggtgtccggtccgaccccactgctcactgtgctccagtcacactggtgtccctgttcctggaaggcaggaagtatggctctgcctcagggctctgcacctgctgtgccctcttcccggtgcacttaccttccttcttcaggtctttcctcatgcgtcacctcaacaaggtcatccttgaccacccatttgtaactgcaactccaccccctcccaaactccctcctctgccttatttttccctgaagggcttcacactgtcaacatactacacacacgcacatgcagacacaactcatacactgtctgtcttaccttgtaagaacaaggatttttttcttttttaatttttattttacttatttttttgtctgttttgttgaccactgtatccctggaacctaaaataatgcctgcctcataggagacactcaaacaccatctgttgaatgaatgtatgaatgaaggaaaagtgactgtgacacagaactgcatatgacctattacagtacgccctgtagccttttaaaagagttgtattttaaataagtcacttggtatgcacatatattcagataccgtggaaaagacaaagctgcgccaatttgataattaaattaaccacatacaaaatctggcccattgtaaagaaaaagctctcttaactgagagatgccctgaaacactccaagggtgctaggctttctcaaaaccctggaccttgcttcaccagagctcatttaaaagatgggtcctgggccgggtgcggtggctcacgcctgtaatcccagcactttgggaggccgaggcgggtggatcacaaggtcgggagattgagaccatcctggctaacacggtgaaaccccgtctctactaaaaatacgaaaaattagctgggtgtggtggcatgcacctgtagtcccagctactcaggaggctgaggcagaagaatcgcttgaacgcgggaggcggaggttgcagtgagccaagatcttgccactgcactccagcccgagcaacagagcgagattccatctccacaaaaacaaaaaacaaaaaaatgggtcccaaaaggtccaccctttctgcaagcaggtgaatgtagccaggctaatataatggactttgatttctttagatgaaagagaaattatgatgcaaagtacaaagcactttatagttatgatacataaattccaggtgtaacccattttcagtgaacttctggactcaagtacaagacagaaaaaaacgtttttgttatactttagtaactcactcactctgtagatggacatggtgggtcccatttttataaaccacatttcttaaaaacctaaaattatcttccaggtgaaaggaaagcaaaataatctcagcaaacattttagatgtagaaataaattattcaggagggaagcagctttgtacacaacataagtgatgtgaggcagacaaatgccaaaagtgattttagaacaaaatggaaagaatgtcctaatgtctctaccttataataacccttttcattccttagaccataacaggtttgcttttgtttctgaagttatgtatacagcagaaattcttaaccaccctccaattaaccaactccaggatgtctcacaaggtgacacaagttacccgggaagacatgctggctgatgcccattcatacctgctgctcacagctggtgacagataaagaaacagaatgaaaaaatcagtacctggcgctcaggctgtggtcttaagactacagcaagctcatgaaattctgcccacatgactgaggtggcgattaccaagaatcagttgtgtttgcacctgaatggatttgtcctggttgtacttgctaccaaaattatgtaacttaaatattatgtaaaacaaacataagcataatgagagagagaggtgtattgctaaatggaatgctttagaaagaagccattaaatggccacaagagaattctactgacaaattttttattttaaaattattttttactaaacagaggcaaaataaaactttacaaaatatttataaaatacaaatattcatgaaggaaatacctctgtatactaactacaccacccaagttttttaaaaaatggaattaccattatctttctaactcccctctgaatcttactgaacttccctctgaatcattacttaatgattttataaatgataatattttctcactgactaatcacagatacatttgttttagtaacgcttctaaaatttcggctttaattcctctaggcctgtcaagttcttttaaatctataaactatattatctttacataagctccagttttagaatatgatattgtattttattagactttctttcccaagcaggacacagcaatatgagaggccaacaactgatatacaagccacaccgagaaggtaggaagaattgcacccaaaatgaaaaaatatgacttggcacagtgactcacacctgtaatcccagcactttgggaggccaaggtgagaggatcacttcaagccagtggtttgagaccagcctgggcaagatggtgggaccccatccctacaaaaagttaaaatacaaaaattagccaggcatgttagtgtgtgcctgtggtcccagctacttgggaggctgaggtgggaggataacttgagcccaggagttcgaggctgcagtgagctagaatcatgcccctgcattccggccttgctgacagagcaaggctctgtctgaaaaaaaaaaaagagagagaaaaaaaacctgatacaatcaaaagaatgaatgaaacagatctctgagactgctacatcacacccggtgaacacagcctaagcctttatctacttctatcagaagtctctgccagaagggaaagagctgggtgaggaaatccatagtaacacattactcttatcttttatgtcctagattgccatttgcaagagagctattaatgaaagtcacacacctgaagctctaaaagcagcccagggaatggggaaaattccctgtctccaaaacaggagatgaagccactgtgaagccaatagcaaaaaagtgatcaggccagaaatcctgctgactcaggaaattctattctgccgttagacgaagctaaatatcagagcacctactctgccgtatattcttaatagggttcctgtacttagctatgtaacagcctatggggtttaactcattcgctaaagaaacatattgaatgaggaccctgggccaaagcaccacatatagtcgtccatcggtaaagtggggcataagtggggattggtcatagatttggggattcaaaggtgctcaaatctcttatacaaagtgatgtaatgagtaagaaggaactaagcgcacacattctctgagcacctgccacgcgcaaacacagtgctaaatgcttccacatgtattatctttttaaaatgacttttttttttagataagatcttgctctgtcacccagactggaatgcagtgatgtgatcacaactcactgcagccttgacctcctaggctcaagcaatcctccctcctcagtcttccaggtagctgggactacaggctcgcaccatcacatctggctaaattttttcttttttgtagaggtggggtctcactatgttgcccaggcccgtagactttatttattagagtagttctaggttcacagtaaaattaagctgaaggtgaggaaattttcgatacacctcctgcccccaacacatgcacagtttcccccattattatcaacccccaccagagcggtacatttgttgcagtcaatgcacctacactgacacactgatcttatttagaccttagttccagcgtctctggaagagtggcagttttctcattggctgaccctattgcctggtctcgctgctcggtgcaaaggcctttagaaattctctgctttgactgactggctaacaagtggagatttgtacccgaagcatcgaatctgtataggaatcaagcacatggaaaaatctttgattcctccagtgtcttggatctcaaggaaagctccagcctcagccttggtggaggcagcagccccgggctcagagaaggaaggtattcagatgacaggattcagacatctcaggatgaccaaagagtatccaaccattcaccaaggagcagaagcttccctatcactgacagacagtacttcctgcggtgtccccagcatcccccagaaactgtggacaaggcacaagaagaagtctgaatatgtgaaagccagcaacagcgcctttgaggccgactaacggtgaccctccccgggtaccctgcactggctgaggttgactagacaaggggagaagggccaggactggagctgagccacactcatttctgctagcagcttggtgcaaacatatcatcctctctcactaactgatcaccctgccttaggacacagaaaaggaacatcccttgaaggcaaaatgaaactgttccttcttagaactgctaaagctgttggccagaaagtgactttgagaggtcataaagtttatatctctatcttcaagcaaaatcacacctacatggaactttcccagcctaaagacctccaaggaaggaaggcgacaactcccccgtcttccttgtgagttgctggtgttctagggtgtgtaactttctggtcttactgtaagagcttgaccctgaggcacttataaacacatggttcttaccgttcctattatcgcatttatttcaccttgatgaggtatactttttaaggaacaagcatatatcaacttagtagttctagtatctactgaagagtaccatcaagattgattgtgatggtcatttggcatgactgcatgaattctttattcttttatgtgcagtttttctatagaaaaacactgaaagttaaaagttgaaaaaaataaaaccatgtagcatttgcacataacatatttacatcttcccatatactttaagtcatctctaggtttcgtataatacctaatacaatgtaaatgctatgtaaatagttgttatactacatgaataaataatgacaagaaacagatgtccatacatgttcagacacaacattcttccacatattttgatctgaggttgattgaatgcatgatgcagaacccatagaaacagagagctaagtgtattagaatttttctcctggcttccataaagcacacctgtaggcaatcacagtctagggtacaagaaagtccagttttgccgtttaataggtgtgtgactttaagaagggcaataataattccagttcccactcagctaagtataacctaccatccaggtcacatttactgcctacttactgtctttccaaaactgtctaagccccttctaaccactaaatgttggtgaggtattccatgaggtaatgatgcagtgaggcacagagatgttaaaataacttgcccaaggtgacacagatagaagcaaatcagactatccaattcaagggcacactccaaccactatgctgcactgcctctggtaacacagaatatcctttaagagaagaacagggccaagtacaatggcacccctgtagttccagctatttgggaggctgagggaggaggattgtttgaggccaggagttgaaggctgcagtgagctatgatggcgcctgggagtagtcactacactccagcctgggcaactgagcaagaccccgtctttaaaaaacaaaaataaagaggtcaggtaagtgagtctccccctcccaacttcacacttctcactctcctgaaattcttcaggagatcctaatcaaccacataaaacaagcaaagtgtagagattatgtaaaatgtttatttttctttccatgcccttttctccccattgagtttcatggagatctgtgtgactatgggaggcctccagagattcagcaatggtaagaaaatatgagcacattttaaaagaggagggaagaaggagggaggattcctcccaagagagtggtggcaactttacaacttgaaaatgtctgtgagcctggcttaaatttttatgacacatctctaccacactggcagggggtggggggttggggacttgggttgtcttggatcaagacccagtgctgaggtaagcaatgtagccagactggcttgatcagctccttgtaatctccctggcgagggatgtttgtcaactggagaccacacccactaaagagaactaattaggttctaggggcaaccactaaggtcatcattattaccaggtgagatcagtttcccaaacattccgatcttaagacttgcatggggtgattaggaagactgctccttcagaaccactgtaccagaatcttcaggcagccctagaaatctgaaaccaggtaattcttgacagacaagtttgggaaacactatttagatcatgacattacagtatctaaaaagatcaagaagggtcttctaggtagggtgtcctcctttcaagcaattctctgtctaatccaggaggagaagactattttctatacataaaagtctccagagaactggcttccaaaatttcctttcagtatacataagagtctcaagtctgcagagctttgtggtccctctcaaatagctcaggcaaaggttaaatctccatccttcttccaaccagatatttaaaaaacaatatttgttacacaagtcatcatactgaaagttttgttaactcactttggaaaatacgtgagggcctagaactgtgctaagccctctggtgctctgtttaagataaagaacttcacttatttcaaaggtcaggaagaagaaacagaaaagacaacccacagaatgagagaagctatttgcaaagcatatatctgataggagacttcaacccagaatataaaaacaatgcttaaaatgtaagagtaaatagacaaataatataatttaaaaacggtcaaaggatctgaatagacacttctccaaagaaaatatacagatggccaatgatatggtttggctttgtccccacccaaaactcatcttgaatcggaactcccacaattcccatgtgtcgtgtgaggaagccggtggaaggtaattgaattaccggggtgagtctttccaatgctgttctcttgattgtaataagtctcaagagatctgatggctttaaaaatgggagtttgcccacacaagctgtctctttgcctgctgccatacatgtaagacatgacttgatccttcttgccttccaccatgattgtgaggcctccccagccatgtggaactgtaattccattaaacctctttcttttgcaaattgcccagtctcaggaacgtctttatcagcagtgtgaaaatggacgaatacgagccaataagcacgtgaaaatatattcatcatcattagtcattagagaaacgaaaagcaaaaccacaatgagataccacctcacacccactagaatggctacaaaacttgtatgcttgtgttcagaatggcattattcctaactgtcaaaagtggaaacaacccatcaactgatgaacggataaataaaatgtgacccatctagtcaatggcatactattcagcaataacaaggaatgaagtactaacacatgctacttcatggatgagcactgaaaacatgaggaaaaagccagctacaaaaggccacattttgtattgtttcatttacatgatatgtgcagaacagcaaaatccagactcagaaaatagattagtggttgcctgtgatgagggataggagcaatggggagaggtggcaactcatgggtctggaatttttggggtttttttgttttcttttgagacagggtctcattctgtcactcagactagagcacagcgatgcaatcacgacacactgcatgcagcctcaacctcctgggctcaagcaatcctcctgcctcagcctcctgagtggctgcgattacaggcacacatcaccatgctcagctaatttttaaatttttttgctattaaaggggtctcactctatgttgcccagactggtctcaaactcctgagctcaagagatcctcctaccttggcttcccaaagtgctgagattacaggtgtgagccactgtgcctggcctgggctgtttttgaagtgatgaatatgctctaaaattgactatggtgatgggtgcacaactccatgaacatactaaaaatcaatgagtgtacactttaaatgggtgaatcgtatagtatgtgaatatctcaataaagttgtttaaaaaaaggatcccatttaatctccatgagcctcaatttcaccctctgaaaatggagacaccacctacctttcaatactataaaggatatataggccaggtgcggtggctcccagcactctgggaggccgaggcaggcgaatcatgacgtcaagagattcagatcatcctgggccaaaatggtgaaacccgtctctattaaaaatacaaaaattagctgggtgtggtggcacgtgcctgtaatctcagctactcgggaggtggagggaggagaatcacttgaacccgggaggcgggggttgcagtgagccgagatcacgccattgcacccccggcctgggtgacaagagcgaaactccatctcaaaaaaaaaaaaaaaaaaagaatatataaatacatacagatgcatgcatgtacacactcacacatactatgtttcacatagtacctagcccataataaatactaaatagatgtcattctttctcctcttcctatccccacgcttttgtattgttatgccttgatactgtggttccaccacaaattacaaaactcaaaattaaa

SEQ ID NO: 1868 - DNA, 1059 bp, Homo sapiens
attattctggcaaatctcagtttcttgaatctcagttccttgaatcttgacttttgtcgccacccttgatttgaacatcccttggcagctttgtggataatacagtgtgagagacataattgaaaagcatgacaagtgagaaaatgggttacatacctcaaaacaaaggctcattatacatgacaatgcaattcatttgggtctctccattgcatatttgctacaggtattgattgccttccaactcttcccacagccttttgctagtcttaaaggcataaatcacttggtgaaaggatatttctatttcagccagataaactctttcctttttgtttagatttaatatgaaggcaaaatgcactgctctcagtgaacagccttgtttcctttcgtttaatggggaagggaacactgaaacatttcctacattctctaggaaaagcaccttttttttttttcttgtctttataaccctgtatctgttgtcactgattcagctattcagtctgggacaaagcgacttttaagttctagagctatgaggaagctataaagggaatacagttcactctgtagagaaataacagcctgggagatcatggaccagaaatgttactctccaaaggtttgctagagctttactttgaattctattcatcaatatttttgttggcctggatcagtgactctaattatgtatagaagatagaaacagcagttatatttagcaagctggaaaagtccctgcagtctaccctcagaacagctaaacatacggagtcaacctgagattctgaatgctctgttcactccctgagagataatgatgactgaagagtgatagcgcagggaacagagtaaagctagaatgggaggcaaggaaagttatcagtcagacctctaggagaagtcccagcccctgccccatgcttttgttttttatttgtctaactttttttttttttttttggagattttccatttcaggcttttgttgcttttctcaaatgtcaaccctacctacctctctctgaacgaacagcccacactttctac

SEQ ID NO: 1869 - DNA, 7555 bp, Homo sapiens
attatcaggacataagatattgaagacattgaaatatgggttgtgaagactttttctcgtatttgtgaggaaaaatattcaagaatatttgactccattgtcctcattaatcatagatacaggttattgtgcagaaatctctcaagctagtatagccagaaatgtgtcaccttacatgtgatctaatgtcacgaactagtttcgtaggaattgaagtaaatgaatatgcaatagtaattgcctgttcattttgtttgttcattactattcccatgtctcattcccctaagtctgactttttgttttcctttccattctacttttcaggcttcccctcatgctcttttcctcaaattgaggacatctgctctaaggtgaagggccacaagttccagattatattgtgccatttgatgtctttttctgctttttaaccttgaggaatgtaataattgcagacagaattattgttatatttggtttagatggaccatggtgacagtcataaatgcatttgaaatcatttttgtttagggtttctgaaagcaattaacataaagttggaaagacatatattctattttttttttcttttttttgagacggagtctcgctctgtcacccaggctggagtgcagtggcgcaatctcggctcactgcacgctccgcctcccaggttcacaccattctcctgcctcagcctcccaagtagctgggactacaggctcccgccaccatgcctggctaattttttgtatttttagtagagacggggtttcaccgtgttagccaggatggtctcgatctcctgacctcgtgatccgcccgcctctgcctcccaaagtgctgcgattacaggcgtgagccactgtacccggcccatatattctattttaatggaaaacgtaaccagcggaatcaggatgaaagtctaaagatgtgatatctgagtcttaaaattataaagaagaaatcttgagagggtttctgatttttctatagcttcctcattataacctactcatattagtgaactaacaataatctgatagggaagaaaaacttgcagtccttattttctgagctgtatttggcatcttgtgttgtcaataagttcttccttatatcagatgcaaatccttgccaatacaatatgggctcttgtcactaattctttgtttttctgtaaccaagaaaaggagtatcatatatctctctctatctgtctgtctaactgtctctcttttcctgaaatatgtcatttcagggcagtacattttactttaagaaaggatagcatgatgtgttagtttttgtgttgctataatgaaatacttgaggctaggtcattagtaaggaaaagaagtttaactggctcacagttctgcaggatgtacagaagtgtggtgtcatatccacttctggtgagggcctcaggaagttgcaaacatggtgggaggcaaaggaggaaccagtgtagcacatggccagattgagaacaaagagagatgggggaggtgcaacactcttttaagagagctctcccatgaactcataaggaggactcgctgattaccatgagaatggcaccaagcattactgagagattctcccccacgatccaaaccctatcaggccccacctcaaatatgagggattacatttcaccatgagatttggagggaacaaacatccaaactatatcacatgggttggatgcgaaatgctcatttttaagtgccatatttcattttcttaaccaacatttttatagcacttactatgtgctaggcattattccaagcactttgcaaatgctaatttaactcttacaacatacctatgggagaggtactatcactatgcctattgtacagacaagaaaactgaagcagagaacagttgggtagcttgtctaagatcacaattggttaagtgacagaggtgactcttagccactatgctatgcagctctttgtgaaatcatctgtgtgcttttctgacatctttaaggcattttttatggttctgttctccaactgtatcaccaactttggatttatactacagattttcccagtgttcttgtgcagtgtatatctacaatgtatgtgcatgtgcttgtaaatatgtgcttgcatgtgtttgatattatcacagcactcatggagattctggcacaagtggaaccttacattaggaggaaagacatatatattccatagagatacatttggaatatatgtatatatatgtgaatatatatatatggaatatatgtatatatatgtatatatatggaatatatgtatatatatgtatatatatggaatatatgtatatatatgtatatatatggaatatatgtatatatatgtatatatggaatatatgtatatatatgtatatatatggaatatatgtatatatatgtatatatatggaatatatgtatatatatgtatatatatggaatatatgtatatatatgtatatatatggaatatatgtatatatatgtatatatggaatatatgtttatatatgtatatatatgtgtgtgtgtatatatgtgtgtgtgtgtatatatatgtatatattccctatgtatatatatggaatatatgtatatattccctatgtatatatatggaatatatgtatatattccctatgtatatatatggaatatatgtatatattccccttatgtcctccaatagacctcataacgaattgcatgtgagaccatggacaatttatgacacttctgaatcaatttacttatattcaaaataagagagttggactggttgattttttttcatcttcaaattctagaactgaatcaggaacttctaaagcaaccagtaaggagattttttttcagtatagagcaaacccttgacatttgaaagaactacatcctattttggtcaaatattttaaaccttaaacaatcctaagacttttaaaaatctctaagtttgtaagaaccacaataacatatcattttctagtataaaataaattaaatgtttacatggccatgttctaatctctattagctctaaaaatactgaagtaaataatctatagattttttacaataaattatgcaatgaaatcaaagtggacattactgcattatataataatcagataaaactacccccagtatacttgcagtcaaacaaagcttgtgcacttactgcgctaagggataatattccagaggaactttagaaaacattcagaggaggggctatggaagaagaactaatttgattgggtctgcccatttatactggtatcttcttaaatattttgagaaatctgatgagtataacaaacagctgcattcatttgtttgtacaggtggttgtaatcctatataaacttttttatagtttaaaattttaaaaacgtacaaaatattgaaatgtataaggcatgaaaaaatagaacttctttgcatgctagctaggtataaaaatgcaggaggagatgctattgagaacataactcttacctaatgaaggaacataattattatcttgaatatgcaagtaattatactacttcataatatctctgcttagcagagtgcttgattcctggaaagaaaaaaaaatacacacacgcacgcactcacacagacaagatataaggaatagctgtatatgaaatagctacaaatttgcatgctaggagaataattacatgtggaaaaagttatgtgttttacagacagcaaaatctttctattttatcttttgcttgaggtttttggctccttctatgaaggactatgttgctatgcttgcagacaactgacggatagatggatgtattgattgtataattataaaatacatggcattagttatgcctaggacatatgatgtttgataaaagaaaaggaaaaagattcacctgtcaaggaattgcagtttattagagatgaaaacaatgatcaaaatagcaaaaaatctaaagactaatgtaaaggcaaaaatacgtcaaaacataatatgagaagttaacaaatgagaacaacctggtgagttgaatgagtaacatcagcaagatgagagactagactctttctattatcatgcccttgcgcaagtatcaactttgacaactacccacagataagagtacatttgtgagaatctaggagttcactgaagttccagcacatcatcaaagcaagaaatttaagaatagaaacatcaaagaggataaaaagaacagtttcacttcttgtatcccactttcctcaaggtggtacagctcagtgctaagagagacttttggcccactatttatcccatggggaaaaatgagaacatagtgtttgaactcctggctccttctggtgtgcaagatgctgccctagaggcccacttctttcttgcttcacccagattactgagataatcatcatagccgaatggttgagagaggctgggagcaggaagagaggctgtgggctctacttaccactccatggattctatcaggaagcctgacaatgaactcctctcatgttgacaccccttaaccctctcatgggcaccccaaatgtgtccccaagaatcttgctgctgacactaaatataagcatcttgcatagagagctggctggccaggaaaccattttctcctaggcctccaggcctgtgatgagaggagctgccgtgaagtcctctaacatgccctggagacatttttctcattgtcttggggattaatcctttttctatcacattgtcaggctgcaaatttttcacacttttatgctctgcttcccttataaaatcgaacgtctttaacagcacccaagttacctcttgaatgctttgctgcttagaaatttcttcctccagataccctaaatcatctctctgagccctccaaactgttccaaactcttcctgttacccagttccaaagttgcttccacattttcaggtatcttttcagcaacaccccattctcgttaccaatatactgtattagtccattttcacgcttctgataaaaacatacccaagactgggcaatttacaaaagaaggaggtttaattggacttacagttccacatggctggggaagccccacaatcatggtggaaggcaaggagcagcaaatcatttcttatttggatggcagcaggcaaagagagcacttgtgcaggcaaattcccattttttaaaaccatcagatctagtgagactcattcactatcacgagaacagttcaggaaagacctgaccccataattcaatcacctcccaccaggttcctcccatgacatgtgggaattatgggagttacaactcaagatgagatgtgggtggggacacagagccaaaccatatcactggcccgtaggtatatcagtaggggctcaacatcactaatcatcagagaaatggaaaccacaaccaccatgagatatcacctcacacctattatcaaaatgttagaagataacaagtgttggtgaggatatggagaaaaaaataacacttataccctgttggtaggaatgtaaattgacatagccactatggaaaacagtatggagttccctcagaaaattataaatagaagtactatatgatccagcaatctcacttctggatatacatcaagagcaaatgaaatcaatattttgaagagatatctgcacttccatgttcactgtggtgttattcacaataaccaagaagtggcaacaacctaaatgtccactcacagatgaatgaagaaaatgtgataaaaacatacaatgtaatattattcggccttaaaaaagaaggaattcctattatttgtgacaacctggatgaacctggaggatatcatgttaagtgaaataagctagaaaaataccacttatttagaaagaaatataccacttatcacttgtatatggaatctgaaaaagttgaactcatagagaccagaagaatgattactaggcagggcctgggggatgaaggaaatggggagaagtaggtaaaagggtactacctttgagttatgatcaataggtctggatgcctaaaatacagcatgttgactgtactgaataatagtgtattgtatacttgaaatctggtaagagaatagatcttaagtgttctacctccccacacaggcggagaaaagataactactactacttaaggtaatggatatgttgataccttgattgtggtaatcactttacaatgtttatgtattaaaaacatcacttggtatatctcaaatatatataattttatttgtcaattacaattaaagctgagaaaaaatgcaaatggattaatgtgaaaatgcttacaagtgcgaaagcatttatccacatgtaattaaacattttattaattgacatttacggaaataattaaatttcatgaatgcaagactaccagataatccaagatgtaatcatgtataggtatcttatactaatttcttttagagcagataataatcatctgcctaaataatatagaaatatctgtgcaattggtctagtagcactgatgcttaaaaaagcaatctgtccgtacttaggaatgctggaataaaaaacagtataagtctctgaagtttttctctttcaagattgtttttgttcttctttgtcttcagaatgtccatgataattttagactctctttatacaattctggaaaaccttttcgggatttatgtgtcaggcatgtggggaacagactgcatcaaatatatagagcatttgtagaacaacaaatttatacttgttattctgtatttaacaagcacagctctttttatatgtgtcagtgagatcaaattttgtccaactcttctatatccttgctgtttttattctgtatgttctgtcagttacagatgtgtttctgtctcccactgtatttgtgatttgcctatttttttatttaagtttatataggttgagactatgttgttactgcatatgaaatcagagttgtgtgtcttttgggtgaattaatttttcatcataattaaatgctccttttcatctctagtaaggtttactgcatcaagtctactttgtgtgatggctgtactatcgttattataaccatactggttttcttctgtttagtgtttgtataatatttcttttactctatctttctgtatccttatgttctagtagtctttcttctaattagcaaatcattggcttaggttgtttacacagtccattgtgatgattgtttaaatgggaaaatttaattttcttacatactgtaggtggcactatatttgtattgaaatttgtcatctttatattttctatttcccattttattacttcttttggattagttatattagcattctatcttttcattttcttgccagcaatacactctattgctattattttgttattcataaaatcttatgttattaatgcttagtatatactaacatatttaccacaatataagaacctcattcaccattaacatagcttatccccacaaatattttatg

SEQ ID NO: 1870 - DNA, 10896 bp, Homo sapiens
aaggcaaaaatacgtcaaaacataatatgagaagttaacaaatgagaacaacctggtgagttgaatgagtaacatcagcaagatgagagactagactctttctattatcatgcccttgcgcaagtatcaactttgacaactacccacagataagagtacatttgtgagaatctaggagttcactgaagttccagcacatcatcaaagcaagaaatttaagaatagaaacatcaaagaggataaaaagaacagtttcacttcttgtatcccactttcctcaaggtggtacagctcagtgctaagagagacttttggcccactatttatcccatggggaaaaatgagaacatagtgtttgaactcctggctccttctggtgtgcaagatgctgccctagaggcccacttctttcttgcttcacccagattactgagataatcatcatagccgaatggttgagagaggctgggagcaggaagagaggctgtgggctctacttaccactccatggattctatcaggaagcctgacaatgaactcctctcatgttgacaccccttaaccctctcatgggcaccccaaatgtgtccccaagaatcttgctgctgacactaaatataagcatcttgcatagagagctggctggccaggaaaccattttctcctaggcctccaggcctgtgatgagaggagctgccgtgaagtcctctaacatgccctggagacatttttctcattgtcttggggattaatcctttttctatcacattgtcaggctgcaaatttttcacacttttatgctctgcttcccttataaaatcgaacgtctttaacagcacccaagttacctcttgaatgctttgctgcttagaaatttcttcctccagataccctaaatcatctctctgagccctccaaactgttccaaactcttcctgttacccagttccaaagttgcttccacattttcaggtatcttttcagcaacaccccattctcgttaccaatatactgtattagtccattttcacgcttctgataaaaacatacccaagactgggcaatttacaaaagaaggaggtttaattggacttacagttccacatggctggggaagccccacaatcatggtggaaggcaaggagcagcaaatcatttcttatttggatggcagcaggcaaagagagcacttgtgcaggcaaattcccattttttaaaaccatcagatctagtgagactcattcactatcacgagaacagttcaggaaagacctgaccccataattcaatcacctcccaccaggttcctcccatgacatgtgggaattatgggagttacaactcaagatgagatgtgggtggggacacagagccaaaccatatcactggcccgtaggtatatcagtaggggctcaacatcactaatcatcagagaaatggaaaccacaaccaccatgagatatcacctcacacctattatcaaaatgttagaagataacaagtgttggtgaggatatggagaaaaaaataacacttataccctgttggtaggaatgtaaattgacatagccactatggaaaacagtatggagttccctcagaaaattataaatagaagtactatatgatccagcaatctcacttctggatatacatcaagagcaaatgaaatcaatattttgaagagatatctgcacttccatgttcactgtggtgttattcacaataaccaagaagtggcaacaacctaaatgtccactcacagatgaatgaagaaaatgtgataaaaacatacaatgtaatattattcggccttaaaaaagaaggaattcctattatttgtgacaacctggatgaacctggaggatatcatgttaagtgaaataagctagaaaaataccacttatttagaaagaaatataccacttatcacttgtatatggaatctgaaaaagttgaactcatagagaccagaagaatgattactaggcagggcctgggggatgaaggaaatggggagaagtaggtaaaagggtactacctttgagttatgatcaataggtctggatgcctaaaatacagcatgttgactgtactgaataatagtgtattgtatacttgaaatctggtaagagaatagatcttaagtgttctacctccccacacaggcggagaaaagataactactactacttaaggtaatggatatgttgataccttgattgtggtaatcactttacaatgtttatgtattaaaaacatcacttggtatatctcaaatatatataattttatttgtcaattacaattaaagctgagaaaaaatgcaaatggattaatgtgaaaatgcttacaagtgcgaaagcatttatccacatgtaattaaacattttattaattgacatttacggaaataattaaatttcatgaatgcaagactaccagataatccaagatgtaatcatgtataggtatcttatactaatttcttttagagcagataataatcatctgcctaaataatatagaaatatctgtgcaattggtctagtagcactgatgcttaaaaaagcaatctgtccgtacttaggaatgctggaataaaaaacagtataagtctctgaagtttttctctttcaagattgtttttgttcttctttgtcttcagaatgtccatgataattttagactctctttatacaattctggaaaaccttttcgggatttatgtgtcaggcatgtggggaacagactgcatcaaatatatagagcatttgtagaacaacaaatttatacttgttattctgtatttaacaagcacagctctttttatatgtgtcagtgagatcaaattttgtccaactcttctatatccttgctgtttttattctgtatgttctgtcagttacagatgtgtttctgtctcccactgtatttgtgatttgcctatttttttatttaagtttatataggttgagactatgttgttactgcatatgaaatcagagttgtgtgtcttttgggtgaattaatttttcatcataattaaatgctccttttcatctctagtaaggtttactgcatcaagtctactttgtgtgatggctgtactatcgttattataaccatactggttttcttctgtttagtgtttgtataatatttcttttactctatctttctgtatccttatgttctagtagtctttcttctaattagcaaatcattggcttaggttgtttacacagtccattgtgatgattgtttaaatgggaaaatttaattttcttacatactgtaggtggcactatatttgtattgaaatttgtcatctttatattttctatttcccattttattacttcttttggattagttatattagcattctatcttttcattttcttgccagcaatacactctattgctattattttgttattcataaaatcttatgttattaatgcttagtatatactaacatatttaccacaatataagaacctcattcaccattaacatagcttatccccacaaatattttatgttattattgtgtgatttattataatgacaaatatgttaaattatgcttgtttgtcatcaatattcatttatatttaccaactgttgctgtttattctttcctgtatttttatttccatttagcttcattttccttcagctaaaaacactctttagtatttcttttcctgtgatgcttctggtaacacattcactttttgtttgaatcaaaatgcctttatttttaaaaacatgttttcctgttacagaattccatttgacatttattttcctacatcaccaaagtataattgcattgtcttttcttctgttatgttgagaagttagttatcaatattatggttactcctttgaaaataatgtgtcttttatctctggttgttttaaaaagattgtattttttttaatcatactctaagttttaggctacatgtgcacaacgtgcaggtttgttacatatgtatacatgtgccatgttggtgtgctgcacccattaactcgtcatttaacattaggtatatctcctaatgctatccctccgccctccccccaccccacaacaggccctggtgtgtgatgttccccttcctgtgtccatgtgttctcattgctcaattcccacctatgagtgagaacatgcggtgtttggttttttgtccttgcaatagttttctgagaatgatggtttccagcttcatccatgtccctacaaaggacatgaactcatcatttttatggctgcatagtattccatggtgtatatgtgccacattttcttaatccagtctatcattgttggacattggattggttccaggtctttgctattgtgaatggtgtggcaataaacatatgtgtgcatgtgtctttatagcagcatgatttataatcctttgggtataaatgggatggctgggtcaaatggtatttctagttctaggtccctgaggaatcgccacactgacttccacaatggttgaactagtttacagtcccaccaacagtgtaagtgttcctatttctccacatcctctccagcacctgttgtttcctgactttctaatgatcgcaattctaactggtgtgagatggtatctgactgtggttttgatttgcatttctctgatggccagtgatgttgagcattttttcatgtgtcttttggctgcataaatgtcttcttttgagaagtgtctgttcatatctttcacccacttgttgatggggttgtttgtttttttcttgtaaatttgagttcactgtagattctggatattagccctttgtcagataagtagattgcaaaaattttctcccattctgtaggttgcctgttcactctgacggtagtttcttttgctgtgcagaagctctttagttagatcccatttgtcaattttggcttttgttgccattgcttttggtgttttagacatgaagtccttgcccatgcctatgtcctgaatggtattgcctacgttttcttgtagggtttttatggttctaggtctaacatttaaatctttaatccatcttgaattaatttttgtgtaaggtgtaaggaaaggatccagtttcagctttctacatatggctagccagttttcccagcaccatttattaaatagggaatcctttccccattgcttgtttttctcaggtttgtcaaagatcagatagttgtagataggcagcattatttctgagggctctgttctgttccattgatctatatctctgttttggtaccagtaccatgctgttttggttattgtagccttgaagtatagtttgaagtcaggtagtgtgatgtctccagctttgttcttttggctaaggattgacttggcaatgcgggctcttttttggttccatgtgaactttaaagtggttttttccaattctgtcaagaaagtcgttggtagcttgatggggatggcattgaatctataaattaccttgggcagcaaggccattttcacgatattgattcttcctacccatgagcatggaatgttcttccatttgtttgtatcctcttttatttcattgagcagtggtttgtagttcttcttgaagaggtccttcacatccctcttggattcctaggtattttattctctttgaaggaattgtgaatgagagttcactcatgatttggctctctgtttgtcttttgttggtgtataagaatgcttgtgatttttgcaaattgattttgtatcctgagactgctgaagttgcctatcagcttaaagagattttgggctgagacaatggggttttctagatatacaatcatgtcatctgccaacagggacaatttgacttcctcgtttcctaattgaataccctttattttcttctcctgcctgattgccctggccagaacttccaacactatgttgaataggagtggtgagagaggacatccctgtcttgtgccagttttcaaagggaatgcttccagtttttgcccattcagtatgatattggctgtgggtttgtcataaatagctcttattattttgagatgcatcccatcaatacctaatttattgagagtttttagcatgaagggctgttgaattttgtcaaatgccttttctgcatctattgagataatcttgtggttttgtcattggttctgtttatatgctggcttacgtttattgattttcatatgttgaaccagccttgcatcccaaggatgaagcccacttgatcatggtgggtaagttttttgatgtgctgctggatttggtttgccagtattttattgaggatttttgtatcgatgttcatcagggatattggtctgaaattctctttttttgttgtgtctctgccaggctttggtatcaggatgatgctggcctcataaaatgagttagggaggattccctctttttctattgattggaatagtttcagaaggaatggtaccagctcattcttgtatctttggtagaatttggctgtgaatccatctggttctggacttttttttttggttggtaggcaattaattattgcctcaatttcagaagctgttattggtctattaagagattccacttcttcctggtttagttttaggagggtgtatgtgtcaaggaatttatccatttcttctagattttctagtttatttgcatagaggtgtgtatagtattctctgatggtagtttgtatttctgtgggattggtggtgatatcccctttatcagtttttattgcatctgtttgattcttctctcttttcttctttagtagtcttgctagcagtctatcaattttgttgatcttttcaaaaaacgagctcctggattcattgatttttttgaagggctttttgtgtctctgtgtccttcagttctgctctgatcttagttatttcttgccttctgttagcttttgaatgtgtttgctcttgcttctctagttcttttaattgtgatgttagggtgtcaattttagatctttcctgctttctcttgtgggcatttagtgctataaatttccctctaaacactgctttgaatgtgtcccagagattctggtatgttgtgtctttgttctcattggtttcaaagaacatctttatttctgccttcatttcgttatgtccccagtagtcattcaggaggaggttgttcagtatccatgtaggtgagcggttttgagtgagtttcttaagcctgagttctagtttgattgcactgtggtctgagagacagtttgttgtgatttctgtcctttcacatttgctgaggagagctttacttccaactatgtggtcaactttggaataagtgtgatgtggtgctgaaaagaatgtatattctgttgatttggggtggagagttctatagatgtctattaggtccgcttggtgcagagctgagttcaattcctggatatccttgttaactttctgtcttgttgacctgtcaattgttgatagtggggtgttaaatctcccattattattgtatgggagtctaagtctctttgtaggtgtctaaggacttgccttatgaatctgggtgctcctgtattgggtgcacatatatttaggatagttagctcttcttgttgaattgatccctttaccattatgtaatggccttctttgtctcttttgatctttgttggtggaaagtctgttttatcagagaccaggattgcaacccctgcctttttttgttttccatttgcttggtatttcttccttcatccctttattttgaggctatgtgtgtctctgcatgtgagatgggtttcctgaatagagcacactgatgggttttgactctttatccaagttgccagtctgtgtcttttaattggagcatttagcccattgacatttaaggttaatattgttatgtatgaatttgatcctgtcattatgatgttagctggttattttgcttgttagttgatgcagtttcttcctagccttgatggtctttacaatttggtatgttttcgcagtggctggtactggttgttcctttccgtgtttagtgcttccttcaggagctcttgtaaggcaggcctggtggtgacaaaatctctcagcatttgcttgtctgtaaaggattttatttctccttcacttctgaagcttagtttggctggatatgaaattctgggttgaaaattcttttctttaagaatgttgaatattggcccccactgtcttctggcttgtagagtttcttccaagagatcagctgttagtctgatgggcttccctttgtgggtaacctgacctttctctctggctgcccttaacattttttccttcatttcaactttggtgaatctgacaattatgtgtcttggagttgctcttctcgaggagtatctttgtgtcattctctgtatttcctgaatttgaaagttggcctgccttgccagattggggaagttctcctggataatatcctgcagagtgttttccaacttggttccatgctccccgtgactttcaggtatacctatcagatgtagatttggtcttttcacatagtcccatatttcttggaggctttgttcatttctttttattatttttttctctaatcttctcttctcacttcatttcatttcatcttccatcactgataccctttcttccagttgatcgaatcggctactgaggcttctgcattcatcacatagttcttgtgccatggttttcagctccatcaggtcctttaaggacttctctgctttggttattctagttagccatttgtctaattttttttcaaggcttttaacttctttgccatgggttcaaacttcctcctttagttcagagtagtttgatcatctgaagccttcttctctcgactcatcaaagtcattctccatccagctttgtttcattgctggtgaggagctgtgttcctttggaggaggagaggcactctgatttttaatttccagtttttctgctctggtttttccccacctttgtggttttatctacctttggtctttgatgatggtgatgtataaatgggtttttggtgtggatgtcctttctgtttgttagttttccttttagcaggcaagaccctcagctgcaggtctgttggagtttgctggaggtctactccagaccctgtttgcctgggtatcatcagtggaggctgcagaacagcagatattggtgaacagcaaatgttgctgcctgattgttcctctggaagttttgtctcagaggagtacccggccatgtgaggtgtcaatctgcccctactggctggggggggggggcctcccagttaggctactcggtggtcagggacccacttgaggatgcagtctgtccgttctcagatctccagctgcgtgctgggagaaccaatactgtcttccaagctgtcagacagggacatttaagtctccagaggtttctgctgccttttgtttggctatgccctgcccccagaggtggagtttacagaggcaggcaggtctccttgagctgtggtgggctccacccagttcgagcttcccggccactttgtttacatactcaagccttggcaatggtgggcgcccctcccccagtctcgctgctgccttgcagtttgatctcagactgctgtgctagcaatgagcgagactccgtgggcataggaccctccgagccaagtgcaggatataatctcctggtgtgccatttgctaagactgttggcaaagcgcagtattagggtgggagtgacccgattttccaggtgccgtctgtcacccctttctttgactaggaaagggaattccctgatcccttgtgcttcctgggtgaggcaatgcctcaccctgatttggctcacactcggtgcactgcacccactgtcctgcacccactgtctgacactccccagtgagatgaacccggtacctcaattggaaatgcagaaatcacccgtcttctgcatcgctcacgcctggagctgtagactggagctgttcctatttagccatcttggctccacaaaagtttgtatttttctgtagttttattatgatgttcctatatgttgttttctttgtatttattctactgatggtttgcagcagttcttaaatctgtggcataatgtctctcattggtttattagacagttccagctgctataacaatataccatagattatgtggcttgaaaaacaaacatgtctctctcacaggtctagatactagaagttcaacatcaatataacagcagatttgttgtctcaaatcctggtttgcaaacaacaaccttcttactatatctacaaatggcagggagagaacagtgtggtctctttcttcttataaaggaattgatcccatcattgaggtttcacacttatgacctcaagtaaacctaattaccctccaaaggccccaactccaaatatatttcagataagggcttcaataaatgaatctggggtgacaataactttaaattcatagcaattgattttggcaaaccatggccagaagtactgcttctgctccatactctatattatttccttctacgactccaattatacatatattaaatatttttttccatattttatgtgtttattgtaatcatctttgttttgtattttacattttattctccctacttaaggctatgtattttattctaatttgagttcactaatcttactgatcttatattctgttttgtctaatttgaaaatacacaagtctacttagttcttaattacataagttcatttaatgtttagttttagttctagaattttcatttcttttatgtaattcctggctctctgtttaaattctccatgtttttat

SEQ ID NO: 1871 - DNA, 8932 bp, Homo sapiens
agtatatgtcttctagtggtatataccagcaatatgcaatgacattgctgaaaatattttaaaaatcaaaaatctcagggccgggcgccgtggctcatgcctgtaatcccagcactttaggaggccaaggcgggcggatcacgaggtcaggagatcgagaccattctggctaacacggtgaaaccccatctcaactaaaaatacaaaaaattagccgggtgtggtggcgggtgcctgtagtcccagctactagggaggctgaggcaggagaatggcatgaacctgggaggcggagcttgcagtgagccgagattgcgccactgcactccagcctggtacacgaagagagactccgtctcaaaaaaaaaaaaaatcaaaatctcagccgggtgcagtgttgaataggagtggtgagagagggcatccctgtcttgtgccagttttcaaagggaatgtttccagtttttgctggttcaacatgtgcaaatcaataaatgtaatccagcatataaacagaaccaacatagtgttggaagttctggccagggcaattaggcaggagaaggaaataaaaatcactagcattcttatacaccaataacagacaaacagagaaccaaatcatgagtgaactcacattcacaattgtttcaaagagaataaaatacctaggaatccaacttacaagggatgtgaaggacctcttcaaggagaactacaaaccactgctcaatgaaataaaagagatacaaatggaagaacattccatgctcatgggtaggaagaaccaatatcgtgaaaatggccatactgcccaaggtaatttatagattcaacgccacccccatcaagctaccaatgactttcttcacagaattggaaaaaactactttaaagttcatatggagccaaaaaagagcccacatcgctaagtcaatcctaagccaaaagaacaaagctggaggcatcgcgctacctgacttcaaactatactacaaggctacagtaaccaaaacagcatggtactggtaccaaaacagagatatagatcaatggaacagaacagagccctcagaaataatgccacatatctacaaccatctgatctttgacaaacctgacaaaaacaagaaatggggaaaggattccatatttaaaaaatggtgctcggaaaactggctggccatatgtagaaagctgaaactggatcccttccttacaccttatacaaaaattaattcaagatggattaaagacttacatgttaggcttaaaaccatgaaaaccctagaagaaaacctaggcaataccattcaggacataggcatgggcaaggacttcatgtctaaaacaccaaaagcaatggcaacaaaagccaaaattgacaaatgggatctaattcaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaccccatcaaaaggtgggcaaaggatatgaacagacacttctcaaaagaagacatttatgcagccaaaaaacacatgaaaaaatgctcatcatcactggccatcagagaaatgcaaatcaaaaccacaatgagataccatctcacaccagttaggatggcgatcattaaaaagtcaggaaacaacaggtgctggagaggatgtggagaaataggaacacttttacactgttggtgggaccggaaactagttcaaccattgtggaagtcagtgtggcgattcctcagggatctagaactagaaataccatttgacccagccatcccatgactgggtatatacccaaaggattataaatcatgctgctgtaaagacacatgcacacgtatgtttactgcggcactactcacaatagcagacttggaaccaacccaaatgtccaacaacgatagactggattaagaaaatgtggcacatatacaccatggaatactatgcagccataaaaaatgaagagttcatgtcctttgtagggacatggatgaaactggaaaccatcattctcagcaaactatcgcaaggacaaaaaaccaaacactgaatgttctcactcataggtgggaattgaacaatgagaacacatggacacaggaaggggaacatcacactccgggggactgttgtggggttgggggagggatagcattaggagatatgcctaatgctaaatgacgacttaatgggtgcagcacaccaacatggcacatgtatacatatgtaacaaacctgcacatcgtgcacatgtaccctaaaacttaaagtataacaataataaaataaaataaaaagagggggaacaggtttaagggatgtaaactactctccccacttctgtgagtataatgcttattatgtatcagagactgctctaagggcttataatgtactgaatgaatcatcacaataaggaaggtgctatttacaaataaggaaagtgaggcacagagatgttagatgtcttgcccaaagtcaaagaagcagaagaatctagattcaaatccaagcagtctatattgagaattccagcttgtaaccttgtaatcattctgatccatgatctagtaaactaagagccctgattagctgactactcaggcaaagaagtcaacttagatcatatttggctaaggtctgttctggatcagaagaaagatttcctctggggtgtttttctaccatttagatatgtatgcttgtcatacatgtcttatgtatatatatatccctttgtagttttgaacctttaggtttttgaagcttgttttagataattctgctaataataagacatggcgaatgtaggacatgttgagttcataaactttattgttaatcacttgacatgtgtctgtaaccaatgtactgggttttgttttctttcttcaccaagaactcagccccaggaaaaaatctgagaaggccctcatctctcatctatagcttaccttgaggctctgtacaagcaagaaatgactaaggcagagttgcaacctgcctgcctaagagggaaatgtatgcccaacacatacaaaggcccctttggcagtcgctgaagacttactggtttaaggcaaaaagaaatctgtctaatcattaactatcaccatgttaaccaagcagatattttagtggctatacatgataaagaatacagactttacagattggtccaggaaagtttctaaacaaagcaacagcaccagcaacaactgcaacaacaaaccccagagaggggagaatctgatttccagagttgccacattatattatttaaaataactagctggttttcaacaaaaaattataagacacacaaagaaacacgaaagcatggacccatacacagtaaaaaataaagcatcaatggaaattacctccgaggaagtcaagacattgtacttattaaacaaagacattaaggcagctattataaatatgttcaaagacctaaagaaaaccatgtataaagatttaaaagaaattgtgagaatgatatttcactaaatagaaattttagagttgaaaagtataataactgaaataaatgtaccagtgagacataacaaatttaaacatatactcacctaacaaaagagtcccataagacaagaagtaaaaatttataaaattgaaggggcaaagagataattcaacggtagtagctggacaaagtgaaaacagtgctcagagggaaatttatagctataaaatgcctacaatttaaaaagaagaaatcagtaacctaaatttataccttaaggaactagagaaggaagagtgaactaaattttttaggaagctgaaggaagaaaataataaatattagaatggaaataaaatagagaacagaaaaacagcagaggaaataaaaaagggcaaaaattggttatttggaaagataaaaaaatggcaaacccttagctagagtgactaagaaaaaaaagagagaagacacaaattactaaaatcagaatgaaaaagaagacattcctactgaccttaaagaaataagaggattataaaggaacactatgaaccatggtatgcgaacttagatgaaatggacaaattcgtagaaaggcattaactaccaaaactgactcagtgtacagaaaatctggatagatctataacaagtacacttcccacaaagaaaagcctaggttcaaatggtttcatgtgaattataccaaacatttcaagaagaattaataccaatccttcactaactcttccaaaaaatggaagggaaaaattccaaacccactttatgagaccaatattaccaaaactagacaaagacctcagaagaacaccacagaccagcatccttatgaatatggacacaaaattctcaacaaaatactaacaaagtggattcagcaacaactaaaatgccacatatactacagccaaatgggaattatcttaggaatacaaggtttatgtaatatcaaaaaaatcaatcaatagaacaaagaacaacaactgcacatcatcttaatagattcaaatatgtatttgacaaaattcaacaaactaaaaatagaagcaaacatcatcaacctgataaagactctctatgaaaacctacatctagcctcatacttaatggtaaacagctgaatgcattcttcctgagatcacaaagacaacaatgtcccttctcacttttctttttctttctttctctctctctctctttttttttggatacaggatcttgctcatcgcccaggctggagtacagtggtgcaattttggctcattgcaacctccacctccccagttcaagggatcctcccgtctcagcatcccaagtagccgggattacaggtgtgtgccaccatgcctggctaatttttgtattttttagtagagacagggtttcaccatgttggccaggctagtctcgaactcctggcctcaagtgatccacccacctcagcctcctaaagtgctgggattacaggcatgggccaccatgcccagacattccttctcacttctattcaacattatatcgtacattttgcaagggaaatttgaaaaggaaaagaaatacaaggtacccagacaggaaaggagaaagcaaattttgatttgcaaatgatataatctctctatacagttaatgttatcttgcatataaaaccctaataaatccacatatacacaaacaatttagttctattagaataacctagttcagcaaggttcaggatacaagatctatatgtgtgtgtttaagtcaattatctgtatacactatcaataactatttcaaaaggaaattaagaaaaaattcatttataatagcaaaaataagaaaacacaggaatgaagttttaacaaaagatgtgtaaaacatgcacactgaaaactataaaactacaaaactgaaagaaactaaagaatacataaataaatgggaggacaatcgatgttcaagtatggaagacttaatcttgcgaatatagcattactctccaaattgatcaacagattcaacataagacttataaaaattccatctggctttttttttcctgaaatggaaaagctgatcctaaaattcatttggaagtgaatttgtttttttaaaacaatactgaaaaagaagaaaggtgaggcactcatacctcctaatttcaaaacgtacttcaaaggtatttccaaaacttagttcaaagctacagtgctcaagacagtatggtactgacattaggatagacatttacatcaatggaatagaactgacagtctaggaataaatccctacattaatggtcagttgatttttaataagggtactaagacaatgagtagagaatagtcttttcaacaaacagtgctgagacaactgaatattcacatgccaaagaatgaagctgaatctctacctcagaccataaacaaaacttaactcaaaatggactatagacctaaatgtaagaactaaactataaaactgttagaaggaaagacagaggaacatcttcatgacctccgatttggtaatgaattattagatatgacaccaaaagcacactagacaaaagacaagaagagatcattaggacttcattaaaattaaaaacttctgtgcttcaaaggacatcatcaaaaactcaaaaagccaaccgaagaatgtaagaaaatatttacaaaccatttatctgaaaagggatttgtatttagaacatataaagaacccttacaagtcaaacataaaaggacaaataacccaataaaaaatgggcaaaggacttgaatagatatttctccaaaggagatatacaagtggccaataagtatgctcaagagaagatgctggaagttcttagtaattagggaaataaagtctctaagatacagtaagctaccacttcacacccaataagatgtgtataatcaaaaaagccagacaatatcaagcgttgttgaagaagtagagcaactgcaacactcatacgttgctggtgggaatgtaatatggggcagctgctttgtaaaacaatctgacagttctccaaatggtttaacatagaattatcatatgatccagcaaaattccaaccctaggtatataccaagagaaatgaaaacacatgctcacacaaaaacgtatacacaaatgtattagcatcattattaattgccccaaagtggaaacaactcaaatactcatcaactgacaaacggataagtgatatggataagctatatccatacaactggaatattatttggccataaaaaggaataaagtactgacacatgctacaacacacataaaccttgaaaatattatgctaaaatgaaagcagtcaccaaggacaacatattatatcatttcatttatatgaaatgtccagaataggcaaatctatacagatgaaaagattagtggttgtcagaggctgtaaggagggggaatggagagtactgctagtgggtatggggtttctttttcagggtgatggaatgttctgtaattccatacagtgatggttacaaactctgtgaatatatttaaaaaccactgaaatgtatactttatgaattttatgatatattaattacatcttagtaaagtgtcattaaaaatactgccagaaggacaatctttttcttccctcccaggggaaaatcaggtaaataaataatcataaaaaatcaaaggtttgtgttgtgtgaagaacgaatgaaaaattgattgtagaatgtagaagtgtgagttaactttgaaacataaaactgctgcgacagtttggatgccttcccccaaaacctcatgttcaaaactgatccccatgttggagatggggcctaatgggaggtgtttgtgtcatggggctggatccctcatgaatgccttggtgccatcctcatggtaatgagtgagttctccctctattattagtagttcccatgaaagctggctgttaaaaagagcatggcccctcccctctccctctcttgctatgtagtctctatacacactgtctctctttccttttcactgtgaatggaagcagcctgaggccctcacaagatgcagatactggcagtatgcttcttgtacaaactgcagaactgtgagccaaataaaccccttttctttataaattacccactcttgggtatgcctttatatggcaacaaacacactaaaacaacttctaagaatgttgagggcattttgatcttgtgaaagtaaattcacttaagtatcctttattcagaaactgaactttgtcaaactgaagaaactattactataactaaagttttatttttattgcaaaaagttcctagggagctaaaagagtacccatttatttcaaatttcaccatcccagaccaactctattcataatttagacaaataaaattggaaacctaatatataatacccaaaaattgttgattctaagataatacactgatgcatacaatggaaaccagaaatcataagcctcatattctctacctcaaagacactgggcaaataacattaagccagactgatgtaaaagtttctttttgatagagttcgagaaagtaaaaattagcttatactgagaaagtaaaattctgcccttccacacctcaagctagaatagagatacagataaaaccaactgacaagttaacggcaaacaatatttcttctaaagtcattctgcagctgtaaaatgtcataattacccgttttgagcaactactgctttcttactcattagacacctcatcttttaaagtcatagactgtcagaaattgtgtagtctgaaatcacatcagaaagaatgaaagtgactttgatgctgagaagcagttatttgcaacccagatgcagactttcacatgaggggtttctgaatatgtcattttacatttaactttgtattttccaaggaaataggactccagatccattatgcagtctggacatggtattgactcttttatacagagcctattttgctgtaagcctatcacatccctgatctcattaaaatttcatcagaattccctccttcgtcaagattatataataacccagctgggtgccatggctcatgcctgtaatcccagcactttgggaggctgaggtgggcagatcacttgagttcaggagttgaagaccagtctggccaacacggtgaaaccccgtacactaaaaatacaaaaattagccggacatggtggtgggtgcctagtcccggttactgggaggcttttaaaggcttattatctcctcttcatcttgaggctatgcttatctagttgtttgttgttggtaaattaagtt

SEQ ID NO: 1872 - DNA, 2871 bp, Homo sapiens
agtatatgtcttctagtggtatataccagcaatatgcaatgacattgctgaaaatattttaaaaatcaaaaatctcagggccgggcgccgtggctcatgcctgtaatcccagcactttaggaggccaaggcgggcggatcacgaggtcaggagatcgagaccattctggctaacacggtgaaaccccatctcaactaaaaatacaaaaaattagccgggtgtggtggcgggtgcctgtagtcccagctactagggaggctgaggcaggagaatggcatgaacctgggaggcggagcttgcagtgagccgagattgcgccactgcactccagcctggtacacgaagagagactccgtctcaaaaaaaaaaaaaatcaaaatctcagccgggtgcagtgttgaataggagtggtgagagagggcatccctgtcttgtgccagttttcaaagggaatgtttccagtttttgctggttcaacatgtgcaaatcaataaatgtaatccagcatataaacagaaccaacatagtgttggaagttctggccagggcaattaggcaggagaaggaaataaaaatcactagcattcttatacaccaataacagacaaacagagaaccaaatcatgagtgaactcacattcacaattgtttcaaagagaataaaatacctaggaatccaacttacaagggatgtgaaggacctcttcaaggagaactacaaaccactgctcaatgaaataaaagagatacaaatggaagaacattccatgctcatgggtaggaagaaccaatatcgtgaaaatggccatactgcccaaggtaatttatagattcaacgccacccccatcaagctaccaatgactttcttcacagaattggaaaaaactactttaaagttcatatggagccaaaaaagagcccacatcgctaagtcaatcctaagccaaaagaacaaagctggaggcatcgcgctacctgacttcaaactatactacaaggctacagtaaccaaaacagcatggtactggtaccaaaacagagatatagatcaatggaacagaacagagccctcagaaataatgccacatatctacaaccatctgatctttgacaaacctgacaaaaacaagaaatggggaaaggattccatatttaaaaaatggtgctcggaaaactggctggccatatgtagaaagctgaaactggatcccttccttacaccttatacaaaaattaattcaagatggattaaagacttacatgttaggcttaaaaccatgaaaaccctagaagaaaacctaggcaataccattcaggacataggcatgggcaaggacttcatgtctaaaacaccaaaagcaatggcaacaaaagccaaaattgacaaatgggatctaattcaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaccccatcaaaaggtgggcaaaggatatgaacagacacttctcaaaagaagacatttatgcagccaaaaaacacatgaaaaaatgctcatcatcactggccatcagagaaatgcaaatcaaaaccacaatgagataccatctcacaccagttaggatggcgatcattaaaaagtcaggaaacaacaggtgctggagaggatgtggagaaataggaacacttttacactgttggtgggaccggaaactagttcaaccattgtggaagtcagtgtggcgattcctcagggatctagaactagaaataccatttgacccagccatcccatgactgggtatatacccaaaggattataaatcatgctgctgtaaagacacatgcacacgtatgtttactgcggcactactcacaatagcagacttggaaccaacccaaatgtccaacaacgatagactggattaagaaaatgtggcacatatacaccatggaatactatgcagccataaaaaatgaagagttcatgtcctttgtagggacatggatgaaactggaaaccatcattctcagcaaactatcgcaaggacaaaaaaccaaacactgaatgttctcactcataggtgggaattgaacaatgagaacacatggacacaggaaggggaacatcacactccgggggactgttgtggggttgggggagggatagcattaggagatatgcctaatgctaaatgacgacttaatgggtgcagcacaccaacatggcacatgtatacatatgtaacaaacctgcacatcgtgcacatgtaccctaaaacttaaagtataacaataataaaataaaataaaaagagggggaacaggtttaagggatgtaaactactctccccacttctgtgagtataatgcttattatgtatcagagactgctctaagggcttataatgtactgaatgaatcatcacaataaggaaggtgctatttacaaataaggaaagtgaggcacagagatgttagatgtcttgcccaaagtcaaagaagcagaagaatctagattcaaatccaagcagtctatattgagaattccagcttgtaaccttgtaatcattctgatccatgatctagtaaactaagagccctgattagctgactactcaggcaaagaagtcaacttagatcatatttggctaaggtctgttctggatcagaagaaagatttcctctggggtgtttttctaccatttagatatgtatgcttgtcatacatgtcttatgtatatatatatccctttgtagttttgaacctttaggtttttgaagc

SEQ ID NO: 1873 - DNA, 8396 bp, Homo sapiens
acgaggtaactaattgtaaaattatatgaagaaagtgatagagatatacttcatgtttcaattagtaatgtaattagtaaataaatagttgatttgaactacacaattagcaaatttgatttaatagacaaatacagaactcaaagaatatacattcttttaaagtatacatggagtattttcttaaattggctacataatagatcataaaggaaatatcaagattgcaaagaatatcaatagatcacattctctaactgcaataaaattaagttgtaagtcaataaataaaaataacaagtctccacacattcataaatatttaaatgcatttttatgtaattcatgaagcagcaaataaatcatgatggaatttaaatatgatttacatacatttagaatttttaatgacatggaaaataccaataaaaacttatgggacacaaaaaagtgataccttaaagtaaattgatagtctcaaataataaaattagaaaagaagaaatcctggacattaatcagttaagcaatcaacttacaaatagaacagcaggagtaaattgaaaaacaaagctacaagaaagacaacaaagagcagacattcatgaaataaaaataagacacaaaaagcaaatagttggttcattaaaaagacaaataaacaatatttcagtgaattgacctattaaaaaagagaggcacaaacaatatcagaaataaattgagacacaactagagtgagaaagcttaaaacaataagaaaatgctatgaaaatcatttaagctaataaatgttactagtaaaagaaatagtcaaatatctagaaagaataacttttcaaatatatttaagaagacataaataaaatctgatttccactggagaaactccataaatggttaaccttccgcaaagtaaatcttctagacttggggaaaaaataatacaccttaactcattttataaggtgaatgaaaccttataatcaaaattagaaaactacactaaaagagaggaaaattacaggccatcttcactcctgaaaatatatgcatgaaattagcaagtagaatctagcagtgtgtggggggtaaagaaggaagagtcttgttcaaggctggtttactgttagaaaaatctatgctgcaataaacatggaagtgcaactgtttcttcatcatactgatttcagttcctttcgatatatacccaggagtgggattgctatatcatatggtagttctattttcagctttttgagaaatcttcatactattttccataatggctgtagtaatttactttacagtatacaacataagtatacatcaatgcataagtagataaagaaaatgtggtatatatacataatggaacacaattcagcctttaaagaagaagaacattctgtcatttgcaacagcatggatgaatctgtaggacattacgctcagtgaaataagccaggcatagaaagacaaatatcacatgatctcatttacatggaatctaaaaaagtcgaactctgataagtagagagaagaatggtggtttccacatgctgagggagtgtgggcagatattagaggtagggaatggggaagttcttagtcaaagggtacatagtttcagttagacaggagaaatacgtttttgagatctattgcacaggagggtgactatagttataataatgtattataataactaagaaagtatgtttcagatgtctcaccaaaaaaaagaataagataataggtttgttaattagcttgatttaatcattccacattgcctacgtatatcaaaacactacattttacccccaaaaatgtatataattatgatttgtcaactaaaaataatattaattttaaaattctatggaattcaccagattaacccatttatacaggaggttgcacattttttgtgtgtgaaaaatcagaccttggtgatgaccttgagcagtaggatataaataacttccacaagcttagcgttccaataatggaacactaggcctaaatgggttaagatgaaataatcatatgatcatttcactatctgcagaaaaaacacttaagaaaataaaacatgtatcattttttaaaagactcagaaaacaaggataataaatttatctgctaagaacctacagcaaatatttttcttaatggtgcaaccttaaagtattccttttaaaatccagaaacgtctcttcatcattctataagagatttttatcttgcagtaagacaagaaaagagttataaggattaaagaagaggaaatatattgccataattcacaaatataattattcacataacaatcaaaaagaatctacaagtgaaactatgagaattaattaaagtgatgaatcaggtggctgcatttaaaaatcaacaagccaaataatctgttgcatttctatggaccggcatcataaaacatttactttaacaatagaaaataaaagtcatttttttgttttattttttttctccaagatggctaactggaggtatttttggcatgcctctcccacccggaaagacaaaatagcgtgtggaactcacactgtgaacttttttccaagaagcaacacaggaacttaaccgaaaaatggaaagaaaccacagaccctttgaaggaagcaatgggcaacagcctacatcatgaaccagacggaaaatggagcctcccaagggtgaattggggagagcctgccaccgtgacacacactcccactgggaagccaggaaatccaggccatggggagaaggcgttaaccctacccagtgctgcagctgatttagtgagcagcggggaatatatgagaaggaacggcatcagtgtgtactcccagtctccagcagggatggaagaaagccatttctgatccattctcacaacgaacctcgcaaaagttggccagctaattcaggcagtggtcacaggttgagagaagctcccaaatgaggtttgcaatataatctcaagtgggaacgaacctcgttggccagaccagaggagcgagcctgaagtgtgttgtcaccacgggggcaggagctggacacctttgcttcatgggcagacaggaaagggtgtggcgtgaaagtcactccatctccatagggaaggcttatagtctggggaagtttcgagttctgaaacaagctgcctgaaacccagttagctgctgttagcagatcactgtgggtgtaagacttgccttgcaagagtgtgggagctgagtggggcttactgccacctcccagtgtagattcttttgtgtagcagaggcagctgtgctcctccccggaacattactccagcagccagggagctgccttctgcttcccactggggctgctgcttgtgcctacatgtggagagccagagcacagacttgcctgacccatccccaacctagctttacccctccacctgccctggtagcataacacaaaagacaaggacacttgggagttccatggctccacccattgcctgagacatcagagtacctcccctgggtaacataaggcaagcacaaattccactgctaccaccataactgctgtacttttgaaagcaccatctcctggctggtgtgcaactgaacagccagttacaacatctgtaggtcagataacagattgtatcttcttcctggctcaggaaggagaaaacctttgcacaacctcagctgtcaccactgcctgcatcagcctggctaaccaggagatcttgagtctgtccatgagccagtatatcactactacagctgacatttgagaaagccaacacactaaggctacttataatgaaagaaatctcagagtctacgtcactcctcttccacctccatcagagctggtactggtacctgctactgggaaactagaggacaggtcacatctctggattccttgcagacattccccagcaccaacctggggtgtggcagcctcactgggcagctagacccaaagaagcagcaagattcacggtagcctggctctcagggactgctaattctagggggaaggggagtgttccatattaaggaagcaccctgtgggacaaaagaaaccagactggaggccatgagcccctgaattttccacctgtggggagtttcagcagaggcataggtacagtactgagctcaagagtcaggcagccctggtgctcatgaagggtcttagagaagggtacttctccccctcaccatctgtggacagccttactggagtacttcagggtgacaacatccccacaggaggaacaccctccaggtccaggcttgcacaagaggtagagtcacaacccctctctaaatggaacatcagcattcctaaaaatgaaatgaggtgtttgtctgatctgaataaccagaacattgggttgggaatgtgactgggtggtggatcgctttcctgctggcttggaaggagagtcacggtggctccttctcttccccttgaaaagtcctcagtgcagcttccccagcctgctctgtcaaggctgagatgtctgcccaacactggggtattgcatttactcacctgctttagccgcagccagtttttacccatgggtaccgcttactggcctgaagcatgaactattcaatccagtgaataaagtaattgggataaaacactttttaaagtgcacaccatggggcaacaagataagtgtcatgagacctcttccattccagccacacaggagacagtgaacccatagacccaccacatcactacgactaccagcatctgagaaacccattgcatgaagattttctataatcaaggaactcatactgagtccaccactgaaagcagccagaaccaaagctaggtgacaataaactataaacattaaaagcacatcctcaagggggaaaaatgaaattcttaaaaaaacccagttgaatcaaaaataaatacaaaaataattagaagacatagtctacccaaatgagaaggaaccagaaaaataattctggcaatattaaaaacagggttctgtgacatccccaaaagattatactaactctccagaagtgggtgtaagccaaaatgaaatctttgaaataccagataaagaatccaaaaggttgattattaagtaactcaaggagatacaatagagaggtgaaaaacaaataggatttttaaagaattcaggatataaattaaaaatgttctaaagagatattttaaataaaaaaacaatcagaacttctggaaatgaaagacacatttacgaaactagaaaatgcagtgcaaattttaacaatagactagaaggagtctaacaacagactagaagagataatttcagagctcaaagacaagactttcaaattaacccaatcagacaatttttttaaaaaagaatgaaaagaaatgaacaaagtctccaagaaatatgagattatgtaaaatggccaaacctaggaattataggtgttcctaagagagaagaaaaatcaaaaagtttgtaaaatctatttgagggaataactgaggaaaacttctctggccttgctagagatttagacattcagatacattcagacattcagaagctcaaagaactcctgagaaaatcattgcaaaaaggatatcaccaaggcttacagtcatcaggctatctaaagtcaacatgtaggaaagaacctcagggccagacggattcactactgaattcgatcagacattcaaacaagaattagtatcaattctactaaaactgttccaaaagatggaggagggaatcctccttaactaattttataaagccagtatttccctgataccagtcaagaaaggacgtagccaaaaaaaaaaaaaaaaagcaacaacaacaacaacaaaaccactactgaacaatatccctgatgaatataggtagaaaaatcctcaacaaaatactagcaaactgaagagtgcatcgaaaacataattcaccatgatcaaagaagtttaattctaagaatgcagggatggttcaacataaacaagtcaataaatgtgattcatcacataaacaattaaaaacaagaactatatgatcatatcaatagattcagaaaaagaacttgataaaatccaacatccctttatgataaaaatcctcaaactaggcatagaaagaacatatctcaaaataataaaagccatatatgacaaacccacagccactatcatattgaacagggaaaagctgaaagcattctccctgagaagtggaacaagacaaagatgcccactttcactacttctattcaacatattactagaagtcttagccagagcaatcaggcaagagaaagaaataaagggcatccaaattggaaaagtggaagtcaaactatctctgttcactgattatatgattgtatacctagaccatcttacagactcctccaaaagactcctagatctgataaatgaattcagtaaagtcttaggttcccaaatcaacatacacaaatcagtatcactgctatacaccaaaaacaatcaagcagagaatcaaatcaagaactcaatcccttttacaacagctgcaaaaaataaaataaaatacctaggaatacacttaaccaaggaggtggaaaatcgcaacaaggagaactataaaacactgctgaaagaaaacatagatgaataataaatgaaacaaacagaaatacatcccatgcttgtggactggaaaaatcaatatcattgaaaatgaccatattgccaaaaaatctacacattcaatgcatttctatcaaaatatcaatatcatttttcaaagaattataaaacaacaattataaaattcatatagaaccaaacaggaacccagtagctaaggcaatcctaagcaaaaagaataaacctggaagcaacacatacccaacttcaaactatactacaaggctatagtaaccaaaacggtatggtactggtataaaagcagacacatagatcaatggaacagaatagaagacccacaaataaagccaaatacttacaactaactgatttttgacaaagcatacaaaaatataaattggggaaagaataccctatttaataaatggtggtgggaaagttggatagccacatgtagaagaatgaaactgtatccctatatttcaccttatacaaaaatcaactcaagatggattaaatacttaaatctaagacttgaaaccataaaaattctagaagaaaacctaggaaaaactcttctggacattggcctaggcaaagaatttatgactaagaccccaaaagcaaatgcaacaaaaacaaaaataaataaatggaatctgattaaattcaaaagcttctgcacagcaaaagaaataatcatcagagtaaaaagacaatgcagagtgggagaaaatatttgcaaacgatgcatgtgacaaaggactaatatccagaatctacaagatactcaaacaaatcggcaagaaaacaaataatcccattaaaaagtgagcaaaggacatgaacagacatttctcaaaggagatgtacaattggccaacaaacatatgaaaaaatgctcatcattactaatcatcaggaaaatgcaaattaaaactacaatgagataccatcttaccacaaccagaaaggccattattataaagtcaaacaacaacagatattggcatagatgtggtaaaaaagaaatgcaagtacactgctgataacaatgtaagttagtataacctctgtggaaaatagtatgaagatttctcaaagaactaaaaatagatctaccatttgatccagtaatcccactactgggtatttacccaaaggaacagaagtcactatatcaaaaagacacctgcacacatatgctatctcagcacaattcacaactgcaaaaatacctaactatccatcaactgatgagtgggcaaagaaaatgtggtatgtatacaccatggattactactcagacacacacacaaaaacaatgaaataatgtcctttgtagcaatttggatggaactggaggcattactctaagtgaagttactcaagaatcaaaaaccaaatactgcatgttctcacttataagtgaaaactaagctatgggtatgcaaaggcatacagagtggcacaatggacactggaagctcggaagagggaagagtgggagggtgggaggggggtgaggagtgaaaaactacctattaggtacaatgtacactactcaagtgatgggtgcacgaaaatcttaagacttcaccactatataattaatccatgtaaccaaaaaccacttgtatccatgaaactattgaaataaaaaaattaataaattaaaaaattaaagtctagcaacagttgtacat

SEQ ID NO: 1874 - DNA, 9661 bp, Homo sapiens
gggatttgctgactttctggatactcaattgccaagaaacatttagaaataaaacgtgttatatttaggaatcatcattttagctaaataataatgcatgattagaattgatgattcaagctgcaaccactttgattgatacccagtcttactcttgagatcacttttttttctgagacagtcttgctttgtcacccagactggagtgtagtggcgtgatcttgtgtcactgcagcctccacttctcgggcctaagcagtcctcctgcctcagtcccccaagtgactgaggctataggtgcgtgccaccatgccaggctaatttttgtagagacggggttttgccctgttgtccaggctggtctcatactacagggctcaagtgatcctcctgcatcggcctcccaaagtgctgggatgacaagcatgaaccaccacgttcggctgagatgactttttattttttatttactgggtttttttttttttgagatggaatctagctctgtcacccaggctggagtgcagtggcatgatcttggctcaccgcaacctctgcctcctgtgttcaagcaattctcccacctcagcctcctgagtagctgggattacatgcatgcaccaccacgcctagctaatttttgttttttttagcagagacggggttttaccatgttggccaggctggtctcaaactcccgacctcagctgatctgcctgcctctgcctcccaaagtgctgggattacagacgtgagccaccgcgcctgtcttgagatgactttttaaatgccataacaactcacagatcctgtgtcctcccattcttaaatgaaactagagctttgtgttcctttaggttaaactaaattatctaataggtaacagaagagtggtctgttagctggctttctcctttcagtagatttgctaagagaaaggaaataaaagcaagtagactgtgaataaacattgaagatgacttaaatgacattgttttccctaataatgaaataatttatatattatttaaatataatttctataaaagaatctatttgcaagtgataatgaagaaaggaatttttttttttttttttgagacaaagtcttgctcttgtcccccaggctgcagtgcgatggcgcgatcttggttcattgcaacctccgccgccttggttcaagcgattctcctgcctcgccccccaagtagctaggattacaggtgctgaacaccacgctgggctaatttttgtatttttagttgagacaccatgttggccaggctggtcttgaactcctgacctcaggtgattcacccacctcggcctcccaaagtgctgggattacaggtgtgagctaccgcacccagcctaaaaaaggaatatttaatggtagagggctctgtaaaaaccccctaattttcaaagccatgtgccactgtagaatttatgaaaagttatgggctattattattaggtttcaaaaagtctggaatactggcggtagcatcagaattatttatttatttatcttttgagacagagtctatctctgtcgcccaggctagagtgcagtgatgcaagctccacttctcgagttcacgccattctcctgcctcagcctcttgggtagctgggaccacaggcgcccaccaccacacctggctaatttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctctatctcctgacctcatgatccgtccgcctctgcctcccaaagtgctcggattacagacgttagcctccacctccacgcctggctaaagcgttatcatttttatctaaccctgaaccaatcagtgattggttagttctctagctgtgaaggctttgcacttcctagacagcttgtagaacaagcccacttggattcccagctcaaactctttcctttttactatttatttattatttatttattcgttacttattattaattaaaaaaattttttagagacaagagtcttgatctgtcacccaggctagagtgccatcacagctcactgcaaccttgaactcttgggttcaagtgatcctcctgcctcagcctcctgagtagtgaggactacgggcgtgtgccaccacacccggctaattcttttttaattttatggagaaagggtcttgctatgttgcgcaggcttgtcttgtactcctggcctcaagcagtcatcctgtctcagcctcccaaagtgccaggcttacaggcatgagccgctgtgcctggcttgtactctttcactagctgggaatgctggtgagcaggactcaaggatcccagcagagctgcatcctgtgctgtctttgctgccacttaggtggaccaggagctagaagcctttctctccatggcctccataccttcttttaccagatggtatttctgcatttatcactcttgattccagcacagcttttcctcatcttgcttttctcagacctcagctcttatgtaatgagatagttggtagtcattttgaggggattcatgtgttgggtaaagggttttcctagcgatgacctcgaaagttccttcccattaataataattactattaataattaatagcaataactaatgataaaacagaacagttgcagcaatatactgtaataaaagttgtgtgaatgtggtctctctctctctctgattatcttattgtaccatactcacctatttttggaccttagttgaccgcttgtaactgaaaccatggataagagggggactattgtgtaaggaaatgaagtcggagatatggaatttcatttcagggcttgctttcctgatattcagctattctgtataactgtatcttttccttttgaggtccttgctccaggacaagaataatatgttgactcaagctgtatggggggatttgaactacagacactcagatatctcctttctgaggtacatagagggcttaattttttaggtctgtctgtttaatatactatatttactttaaaaaacgtaggccgggtgctgtggctcggtgcctataatctaagcactttgggaggccgagacgggaggattgctttagccctggagttcgagaccagcctgggcaacatagtgagaccttgtctctactaaaaatagaaaaaattagccagatgtgttggtgtgcgcctgtgatcccaggtacctgggaggctgaggttggaggattacttgagcccttgaggtcaaggctgcagtgagctacgatcacgccactgcactccagtctggatgacagagtgagatcctgtctcaaaacaaacaaaatgtaaaaaaatttaaatttattaaaaaagatgtacaacaccaaaatgttcatagttattctgtatgacagatctgaggtctttgttcagacatagatgagggttcatagttttggaaaatagacttaaataatatatgattacagatgaaaaatatttgctaacctcagactttttatgtttaaggtagtatttatattcatttagttgtactttctggagttgattaatataactgttattaaaatctatcgattcccagtaattcagtaaatgaagactcttcctatttagaaactcgtgtggattggggagttgctgtgggcccactgtcattgatcatatcacatcttcacttgaacctgctccctgggcctcctataggcctcgcgtttggagaggccgtgaacataatttatttttggaagtttctttcatttttaaagatactgagaggcaagttgaagttcctggtgttcgtgtaaacattccctgccttatcctttccatctcagccattatgaaatgttctggctgaatcatttgctttcacaaagctttgatgaaagtttcttcctcatttggttttcttgatagaggctgttgtgctaaaaagaaagctataacaagttagaagggtggagagtgggcacttaacatttttgaagtacttgtctttcttcctaggggtcctccagaaattgatcatagataacttgaccaaattcaaggcccagagatttcttccaggcattctgggagggaaggaacatcaggctttctgtactgaatctaattattctaaatatttcccactgcagcttgtatgagtgttttctgatgcaaatatggtgatagtggcgacctctctaactgggctaaatatccttgacagctttttatctgtcctctccaagtatttttagtctctttagcttctgtggccatgtctggaggaactgaggatggatttagctgctctggtgctgctccaagttgttgtgggtgctctttgctaccttcgtcactgtcctgccacagtcctgccactgatgaggctcctggcccttgtcatttgatgagggaacataaacacttgtttaataaaaataaaaaagtcatgattttcagaatgctttgaaaataagctatggctaatggtgatacacaataggaatgtccctaatttcactaaattgtatgctcaaaaagggttaaagtggtaaattttatgttatgcatattttgccacaattaaaaaaataaaaacttcaaatggatttgaagcttaatgagaaaactagttataatgtcctaacagtaaatatatggccaatattttcatgaccccaaggtgggaggctgtgccttaaataaactgtcagaatcacacattaaaaaaaaaaaaaagtgatggtaatcaggccctgaggttcatttatacagaaagtgatttttaggtgagattttaatatttgcaatatttatatttgtaaagaggattggctagctcattcagaaaagtctgaggttcttaataaacactaggaaacagatggtttggggttgatgtcagggaaggtaagcaggccgtgctttagattagagcacttttgattgcaagtcccatgagccacacagtttaggccaagtgaaagcagttttagtctaagaagagcagaagcaatcgtagcctctcgggacagaaactgaagtgcagctgggcagtgggaactggatctggagagtctggagtacatgtcttctctggagctgggctttttccattcacatgtagcttccttgcttgagttacatgtagtggccttagtcatggctcctgcatgtcctgactctagttccagtactcatcatcatctgactcccatttctatggctcagtacaaaaatattcaagactgggtattggactgactcctctcagccatttgctttgtttccataggccaggtgatcatctcactctggtcgactatgaaagaaggttggttagatccagcagcctgctgatcatttagagggtcttagagtgagaggagattgtgtgagaagctggttatcatagcagggggtcctggcacctcaaactctgtccccatcaaacagtgtaaaagaaaagatattgactcctaaaggagtgtcttatgttcagatgctatagagttttgcagagaaagtgttcagtgtagctacagatagaaggccaagtgtccttggtcagccagcctgggtgtgtgtggagtaagttagtggtaggtgtagtaactgtctcaaagctttttctttgtctctctctctctcttttttttttttgagacaaggtcttattctgtcgcccaggctggagtgcagtagcacaatttcagctcactgaagcctcgacagcctgggctcaagtgatcctcccacctcagccccccaagctgaggacttagctggaaaacacaggcatatgccacaacgcccggctgatttttatgtttttagtagagacaggggtttcattatgttgcctaggctggtcttgaactcttggccagctcaagcaatccacctgcctcagtctctcaaagggctgggattacaggcgtgagccaccgtgcccggccccagaactttttctttgaatagtggagaagcagaacaccttggaatgctatggtctgtgcggtctttgccctgtgggtgttctcaggtggaatcaggcagtttgggtgatgtcagtatcatttgaggtcttccacagttcagctatttgggtgggcttccccacttttccccttgttttgggtcggtaaacataaaaggatggagatgtgtatccttagtaagaatgggagacgttgccttcagaatgggtagaaagcagaaaacaagcggggaagaaaacagaaaacagcctctctttaagtgtatgtggctgcctgtgtgcacagtccttcaccttttccttagtatatccctcctgcctctgatctcttgttgttcttgatttttcatggtagaaggaggaaacaaaattatagaagacaggtggaatactgtgaaagaatagtagtttggagataactatgtaaagggctactagcctgcgcaccgttgaattctctgaatttacagctgtttagtcattgatgtttcatagtgttgaccttgagtaaattcagaaaagcaatactgagtatgttctgctaaacaaaagaggaaagtgtatgtttttaaagaaacaaccttcacagtggtttcagtagttacagggatttggttcttttttaaattattttatttctttttaaagatggtctcactctgtcatccaggctggagtgcagaggtgtgatcgtagctcactggcaccttgaattcctggactcaagtgatcctcctgcctcagactcccaagtggttaggagtacaggcatgtatcaccatgcctagctgattaaaatttttttttttttggccaggcatggtggctcacgcctgtaatcccagcactttgggaggctgaggcgggtggatctcctgaggtcaggagttccagaccagcttggccaacatgggtgaaaccccttctctactaaaaaaaatacaaaaagctgggcatggtggcgggtgccagtaatcctagctacttgggaggctgaggcaggagaatcagttgaacccgggaggcagaggttgcagtgtgtcgagattgtgccatcgcactccagcctgggaaacgagcgaaactctttttttttttttttttttttggtaaagacagggtctcaatatgttgcccaggctgatcttaaactcctggcctcaagtgatcctccagccttggcctcccgaagtgctgggattgcaggtataagccactgtgcccagcctgatttgttttttaataatagcttaagatgtaattcatatattataaaattaacccttttaaaatatataattgagtgggttttcttttgtatatttacatgtttcgtgcaactgtccccactctctaattccacattttcatcactccaaaaagaaaatctgtacccattagcagccactccctgttgcctcctcctcccggccctagtcaattactaatctgctttatttctttatgcatatttatgcctagtgtgaacatttcatataaatagaatcatgtagtgtttgtccttttgtgacttgactggcttatttcccttagcataatgttttcaaggtttttatctatgttgtatgtagcatgtactgttacttcatcccttttttaaaattaaaaaattttaaatttaatataatagagatgggggtctcgccatgttgccaggctggtcttgaactcctgggctcaagtgatccttctgcctcggactcccaagtgctgggattacaggtgtaaaccactacacctggccacttcactccttttatttttgaataatcctctgttgtgtggatatataccacattttgtttatccattcaccagttaatagacatttgagttattccactttttggctattaagaaaaatgctgctgtgaacatttgtgtacaagcttttatatggacatatgttttcatttctgttggaaagatacctaggagtggaattgtggtgtcgtagttaactctgtttaactttttgaggaactgttttccaaacttttccaaagtggttagatcatattacattcccaccagcaagtatgagagttgtaatttctccacattcttgcaaacacttgttattgtccatctttttgattatagccattgttgtagatgggaagtggtatattattgtggttttgatttgcatttccctagtgactaatgatgttgagcatctgttcatgagcttattagccatttgtatgtctgctttgacaaatgtctattcaaatcctcttccatttttgaattgagtcaattgaatttttgctgttcagttgtaggaattctttatatgtgttctagatatcagtcccttatcagatatgtgatttcaaatgtatgattgacatgtgatatgtgatttttctctgattctgtgtgggttgtcttttcgcttttgttttttgagagagggtctcattctgtcacccaggcaggagtgtagtgatgcagtcatgtctccctgcagtcttgcctgcctgggcttaagcggtcctcccaccttagtctcctgagcagctgggacttcaggggggcaccactggtctggctaatttagaaattttttaatagaaacggagtctctatattatattatgcccaggctggtcttgaactcctgggctcaagtgatcctcctgccttggcctcccaaaatgctgggattacaagtatgagctgctgtgctggcctttactttcttgatagtgtcctttgaagaacagaagttttaaatttgattgtgtcccatttatctgtttttttgtttttttttttggtcacttatgcttttggtatcataataagaaaccattgtcatatccaaggtcgtgaaggtttacacctgtgtttttttgttagagttctgtagttttagctctgacatttagttctctgatagatcttcagttaatttttgtacacagtgtgaggtaggcttccagcttcatttttttgcatgtggatattcagttgtcctagcccatttgttgaaaagaccattctttcctcactgaagtgtcttggcacccttgttgaaaatcaactgactataaatctgtgggtttatttttagagtcttgattctattccattgatctatatgtctatctttgtgccattaccacaatgtcttgattctgtagctttgtagtaagttttgaaatcaggaactgtcagtcctttaactctgttcttctttttcaagattgttttggctgtgctagctcccttgtatttccgtatgaatattaggatcagcttgttagtttccacagaagagacaactgagatataatggggattatattcaatctgaggatctatttggggagtttaaattcattttatggatttgctgtatgcttaggaagtcctggctaactcagacacccaagcatcttgccttaaaaacacaaaattttgttttaatttattgatgtagtaggctgccttggtg

SEQ ID NO: 1875 - DNA, 4242 bp, Homo sapiens
tgatgtttcatagtgttgaccttgagtaaattcagaaaagcaatactgagtatgttctgctaaacaaaagaggaaagtgtatgtttttaaagaaacaaccttcacagtggtttcagtagttacagggatttggttcttttttaaattattttatttctttttaaagatggtctcactctgtcatccaggctggagtgcagaggtgtgatcgtagctcactggcaccttgaattcctggactcaagtgatcctcctgcctcagactcccaagtggttaggagtacaggcatgtatcaccatgcctagctgattaaaatttttttttttttggccaggcatggtggctcacgcctgtaatcccagcactttgggaggctgaggcgggtggatctcctgaggtcaggagttccagaccagcttggccaacatgggtgaaaccccttctctactaaaaaaaatacaaaaagctgggcatggtggcgggtgccagtaatcctagctacttgggaggctgaggcaggagaatcagttgaacccgggaggcagaggttgcagtgtgtcgagattgtgccatcgcactccagcctgggaaacgagcgaaactctttttttttttttttttttttggtaaagacagggtctcaatatgttgcccaggctgatcttaaactcctggcctcaagtgatcctccagccttggcctcccgaagtgctgggattgcaggtataagccactgtgcccagcctgatttgttttttaataatagcttaagatgtaattcatatattataaaattaacccttttaaaatatataattgagtgggttttcttttgtatatttacatgtttcgtgcaactgtccccactctctaattccacattttcatcactccaaaaagaaaatctgtacccattagcagccactccctgttgcctcctcctcccggccctagtcaattactaatctgctttatttctttatgcatatttatgcctagtgtgaacatttcatataaatagaatcatgtagtgtttgtccttttgtgacttgactggcttatttcccttagcataatgttttcaaggtttttatctatgttgtatgtagcatgtactgttacttcatcccttttttaaaattaaaaaattttaaatttaatataatagagatgggggtctcgccatgttgccaggctggtcttgaactcctgggctcaagtgatccttctgcctcggactcccaagtgctgggattacaggtgtaaaccactacacctggccacttcactccttttatttttgaataatcctctgttgtgtggatatataccacattttgtttatccattcaccagttaatagacatttgagttattccactttttggctattaagaaaaatgctgctgtgaacatttgtgtacaagcttttatatggacatatgttttcatttctgttggaaagatacctaggagtggaattgtggtgtcgtagttaactctgtttaactttttgaggaactgttttccaaacttttccaaagtggttagatcatattacattcccaccagcaagtatgagagttgtaatttctccacattcttgcaaacacttgttattgtccatctttttgattatagccattgttgtagatgggaagtggtatattattgtggttttgatttgcatttccctagtgactaatgatgttgagcatctgttcatgagcttattagccatttgtatgtctgctttgacaaatgtctattcaaatcctcttccatttttgaattgagtcaattgaatttttgctgttcagttgtaggaattctttatatgtgttctagatatcagtcccttatcagatatgtgatttcaaatgtatgattgacatgtgatatgtgatttttctctgattctgtgtgggttgtcttttcgcttttgttttttgagagagggtctcattctgtcacccaggcaggagtgtagtgatgcagtcatgtctccctgcagtcttgcctgcctgggcttaagcggtcctcccaccttagtctcctgagcagctgggacttcaggggggcaccactggtctggctaatttagaaattttttaatagaaacggagtctctatattatattatgcccaggctggtcttgaactcctgggctcaagtgatcctcctgccttggcctcccaaaatgctgggattacaagtatgagctgctgtgctggcctttactttcttgatagtgtcctttgaagaacagaagttttaaatttgattgtgtcccatttatctgtttttttgtttttttttttggtcacttatgcttttggtatcataataagaaaccattgtcatatccaaggtcgtgaaggtttacacctgtgtttttttgttagagttctgtagttttagctctgacatttagttctctgatagatcttcagttaatttttgtacacagtgtgaggtaggcttccagcttcatttttttgcatgtggatattcagttgtcctagcccatttgttgaaaagaccattctttcctcactgaagtgtcttggcacccttgttgaaaatcaactgactataaatctgtgggtttatttttagagtcttgattctattccattgatctatatgtctatctttgtgccattaccacaatgtcttgattctgtagctttgtagtaagttttgaaatcaggaactgtcagtcctttaactctgttcttctttttcaagattgttttggctgtgctagctcccttgtatttccgtatgaatattaggatcagcttgttagtttccacagaagagacaactgagatataatggggattatattcaatctgaggatctatttggggagtttaaattcattttatggatttgctgtatgcttaggaagtcctggctaactcagacacccaagcatcttgccttaaaaacacaaaattttgttttaatttattgatgtagtaggctgccttggtgaaacactgtaattcactgttagactggaattggacttttcaggttctaagagagcaaacagctcttccacgtagcgtgtaggttgacttcctgtagtaaatgtttttttgatgtgaaagtttgctgataccttgcatgttttaaaaaaaatgtggtattctggttaatatacattctggttaatagagaactagcagattatatatatgaatatttatcaaagagttaggacatgttacaataaaattgtgacattaaaatttatataattgttattattactggaggaatcagaagatattttaggaccttgtagtcccgcaggggccacgtgaacattggttattgttatacttttaagtcacttcatttactcaacaaataacaaagtgcctatctgtgccaggcacaaggaaggacagacccagtctctgtccttatggagctaagggggagacggacattaatcaagatgccatatgaaatttcagctgggactcagtgctgtgaaggtgcgtgcaatatgtcataaagggatttgactaatctgcaaggttgggggaggcttcttgagagctctggaggaaaatgggaattaattgtgggaagaattaaggagaaaagttccaggtaattgggtgagtttgttagtgagttgtgtggagatactctggttatatcctgtttatcacttttgggaaagagtatctgaatacttggctctggcctttactctgtcccttaaatgccttgtggctgagcaggtactctttctgagcttgttcacatactgttttttaaatttctgtagccatttttatttacagatacttacatgaaaacatacagaaatctaggcttttggttgattgttttcatataattaaaaaatcattcactttgggaggccgaggcgggtggatcatgaggtcaggagatcgagaccatcctggctaacatggtgaaaccccgtctctactaaaaatacaaaaaattagctgagcgtggtggcacgtgcctgtagtctcagctacttgggaggctgaggcaggagaatcgcttgaatccaggaggcggaggttgcagtgagctgagatcgtgccactgcacttcagcctggaggacagagcaagacttcatctcaaaaaaaaaaaaaaaaaattatttctttgtgaccttccatggttagctatttagaactgctttagtggtaaattgaatacttttctgaacattt

SEQ ID NO: 1876 - DNA, 2622 bp, Homo sapiens
atggcacatttcaagattaaagccattttgactttgagttactgtctttgaagtataggatttcctaattataaaaacacatactaattgtagaaaaataggaaaatagaagaaaatatgcagaaaagaaatttatctaaggcctcctacccaaatccaactgctgttaatgttttagtgaatttgcttccaatacttttatgaactctttaaaaacatatttgagataatactgttatatagtgttgtatcttgctttttctcctcaatgttgttagtgtaagcattaagttcttcattaatgtttttaatggctatgtgccagggaatctttacattttccatctcaacttatatccaagtgaaatggtaggaatagttaacccttttatagcattcactggattccaggccctgttttaagtactttacataaattagctcatttaattctcataactaccttctcacataggaacgatcattattcccagtttacagttagagcctttaacacacattaaagcctttcattgggtgtgaggaccaaggatgaagggacagacaccctttagcagacagtgttgccttccatgtgagggctctggtgagctggcatgcagtcatgttcttcttgaaacccctgtggagctggaagtagagctggagacatgcctcctacttcaacttttcaggaaaaatatccaaacagttttggtaactgttaagtgaaaacaataacaacctattcccagctctcccttcacaatctctttgtggttcttattctgtatttctcttgatttacatcttgtgttctctcctaccgctgattcttggtcacaactttggtcataattcctgcaaaaagtggtcgggagtcttcagtgtccaagggtagaaagaagaaactgggccctagagcaatggtttgccaaagctatgtccttagcaagtcgtcagaaatgttagttcatgttataacccagaacacatatacatatattcatttatgatgataatatctggacagaagtttcaggaaacaatgttacctatggtgcactttgatactttccactccactccgttccatttgattaaaacaataccaatttccactttaaattggtttcaggactcactggttaccacaaactgcagaagtcaaattgctgccctggagcacagcgttggttcagcaccaaggacagcagcccatcgctcccttcccggccctgtgctcttccttccctgctgtcacattttggttccttattctgacttctccagcctgtgttgacctggctcttctttgacttcccgtggtgcactttcaatctcagtgattttttttttttttttttgagacggagtcttgctctgtcatccaggctggagtgcagtggcactctctctgcttactgaaacctccacctccggagttcaagtgattcttgtgcctcagccttccgagtagttgggattacaggtgtgtgccaccacgcccggctaatttttgtatttttagtagagacggggtttcgtcatgttggccaggctggtcttgaactcctgatctcaggcgatccacacacctcggcctcccaaagtgctgggattataggtgtaaaccaccacgcccggcccaatctcagtgattttagaccctaacttaggtgcctggtcttcgtagatcataagcttattggagagaagacctaggttttcactatggcttatgttccctttaatgcttgacccagatctccagggaattagtggaactttaaagatgaggataaggataatgcatcagggttcctctcctgggagtgttgctggctgcagatctgctgggactgactttgtagactgtcatcacgttggacaagaagggcctcgttttattggaacctctttctttttcacaggactggaaaaaaaatttagtcctcctcctcttgctattgctctgttgtaaccctttgaaaagcaagctccctttttatggctttgacattattgcatcgctgaatcacaaggttttcaggaagatatatttgattgtgttttttccctgcagcccatgctgctcttcaggtgacacaatatgagcttttgcgctccttatctttcatcttactccttgataacattaacgagcaagagaagaggaataagatatctcttcttttctttctaataaaatctgaggttctaaggatagggcccatctggttaaagggaagactgatatagacttatcagtggtcagtttttttgacacatccaccaattttagtttgaactaagtcctcacgtggacccaggctcatgtctttgggaatggggcactggcgtgattgattaataatatgtgagtgttggagcccagtcccattctgctttcccaagcagtggcaacatagcagcgggtcttctgagtcatgtgtcagctaggagggctgtgttcatgcatatgttaaggtcttctgagaccgacctctactcctcttcaaagcagggtagaacaattacctctgtaaaattcatgaattctcctcctgtttactcttcaattccaaatgctcaaagctgggttgcttgtttgtcatgtgg

SEQ ID NO: 1877 - DNA, 8564 bp, Homo sapiens
aatgttgtatgacaaactcccaataacaggatttaagagaataccacttgttcttaccccttcagttctcttaacagggaagaaatatcataaccacataacacatgtttatatatatagatatgcccttacatcaaaataaattcttgatgataccaagatacgtgttcaaggcaaccataaaacactggaaaaaaatcaatcagaggtgaattttttcttatcttatggtcaggcagagtttaagcatgacaccaaaagttaaaataagctgaaaattgatatcattggctacataaaattttaatgcttctgtacaataaaaactgtataagtattaaacaaatgacatgtttaaaaacacagtttgcactatatattccgaagggcaaggacccctctccagcagctgtcgtccagcacatatttaacgtttccatatatctctgtcctcatcaataagatgaggctaatgacgctgcctctgcggtccttctaagaagcagatgggataaaagagtgtgcaccagtagctctaaacccgggacaatttcaccccctgagggcatttggcagtgtctaatgacatttttggtggtcatgctgggggatgctgctggcatcttgtgggtagaattcagagatgctgttaaacatcttgcaatgcttaagacatccatgcagaacaacaacaacaaaaaaatatcctgcccaaaatgtcaatagtgctgtggctgaaaaaccctggtctatacagggtggaggatgttgcggagcgtttggtacctggtaagtgctcagtaaatgtcagtcatttttacatcttattgggcaattctatgtaaatgccttgtccctaggaatatccacaggtttagcttatttttttttttttttttttttttttttttttttttttttttgagacagagtttttcctcttgttgcccagactgtagtgcaaagctgcgatctcggctcgctgcaacctccacctcccaggttcaagcaattgtcttgcctcagcctcgcgagtagctgggattacaggcgcccgccaccacgcccagctaattttttgtatttgtcgtagagacacggtttcaccatgttggccaggttggtctcactactgacctcaggtgatccactcaccttgggctcccaaagtgctaggattacaggtgtgagccacctcacccgaccccaaggttgtctcttttttcttttctcttttttttttttttttgttttgttttgttttttgagagggagtctcgttctgttgcccaggctagagtgcagtggcgcaactgcaagctccgcctcctgggttcacgccattctcctgcctcagcttcccaggtagctgggattacaggtacccgccaccatgcccggctaattttttgtatttttagtagagacagggtttcaccgtgttagccaagatgatctcaatctcctgcccgcatgatccgcccgcctcggcctcccaaggttctgggattaccggcgtgagccaccgcgcctggccatttatctgttaaggacagaacatgacttgagggacagcttactcattctatgcctatttgcttttctctctttcctcagcgcttttcactctcagctaccccttccaaacctcagctgattttactaccattcagatgtatcacttgtctcctgaaaaacacatagagcttcctttgtgaattcttactgctctacttacctgcttttaatctgtttatgtgagaatgttgtcaagatcttctagtagatcgtaagtcccttgaagaaaaagatgactttatatttattccaaaaaacccctgtggtgaccacacagcatagaaatctgcacagagcaggcaagtaacttacgtttgcttcgcaattccatcttcttaagtcgttcttgcaattgagaatgcatttctagccttctattggagctgcttagcacaagtagtgttgcattggtgtgaattcctccaacccatttaaatgagtttattgtgcattcaagtgagggttattcagcatgttcaagcaaatagtgaccaataatgataatggatattttttcatctcttcctgctccaatgggccagtattcaaaatgccattgctcacatgaaaacagagctgccagaccgtgtccagggcctcagccagggagctgccactttcattttaatttaagaaaaagagaaattgactgggaggtatttatgtaaatcagtagagttctaaggagttatctggcagccatgttaatggatgtgccactctgagaagcgaatctcgcattttgcttctcttgtcagaaggggttctgtgtgaccatttacacctacggatgattggctgtgacccagaggacatttgatgtaaaggatattttgtgcatgtcaatgagtcctgtccaggtggtgggatacaggctcgagacacatgttggagaagatcacttttgactgctggggagctatgggaagcccttccaaatgggcagaatgtgcaattactatctcagtaaatttgtctcaggagagctgtacacctcaggaacatcatatcatagaaaagggaagacaaaaaaggagctcaccttaaaagttccaaccacattccagggactgtttgtatttgactcattcatttattcaacaaatgtgaactgagcacttcaacgtgccatactgtcttctaggcactgaagatacaacagtggatatgatgggttgaatgtcggccccaaaaagatatgtccacatcctaatccctagaacctgtgattgtgaccttctttggaaaaagggtctttgaagatgtagttaagaatctgataatgagaggagcctggattatctgggtgagccctaaatccattgacatgtgtgcttttaagagacacacagaggaacaacactgcaggaggaggagaaggccatatgaatacggaggcaactcttggagtgatgtggcctcaagccaagaaacacctggagccacaggaagctgaaaaaggcaaggggtggaatctcctctagaacctatggaggaagtgtggtcccatcaacatcttgattttgcagcttccagaactgctagagaaaaatttctgttgttttaagccacaaagcttatagtttgttatagcagccacaggaaattaatacaataggctaaacagacaaaaatccctgccattgtgatgtgttcattctcgcttggtgcagacaggcaataaacaaataaaatgtattcaatgttgggttgtgatcaatgtaacacagtaacgaagcagaataagcggggaagaggtttgcttgtgagtggcatgatcatcaggaaagatgctactgagaaggggcgttcagagactgggaggaggtgagggaatgtgccgtgtaggtatgtggaggaaaagctgtctagacagaagggaatgaaactgcaaaggccgtgacactggagtgtgcctagtgtattggaggagatataaggcagcaaaggctgacaagaccagattatttagggcttttacttcaatttacccattgacttaacacttatctattgagcatgtaccaaatatattgttttacgacattcttgcaaaagcctggagaggtaggtaacaaaattcccactttaaagaggaaaacactgaatactggtccagcatgactcagctcatatgtggtggtactagaataggaatcttaatttgatgccaaccccagtgtcctttccccaacactggaatgacttatgtaaatatttatctcatttgtaatttgtctgtgtgttcagtcccatatgacagtcttgataagcccagctggcctctgaggccaatgcaaatatattttgagctgagaattgctcttgggcggtgagaggactgtagtttggaaaaggtcaagggctgtggattgccatctctcatggtgtcttcagaatgtttcagtagctttgtgactccaggtagcattgcattgataatttatctatttaactggcttaagtgggtttttttttttaattttctatctcaaaaatccaggctcataaatagggacagtatggaaaatgctgtatagggagaataaataaatgtataatcaggttagtaacatattatcattgatgcagctactgagcaaggaaaagcaaacaaagaaggagctttatttcatacccaagcaagtatagctcaattgcaaacctctcagacttgaatatatcacattggtcagtgcatatcatgtcctggaatgttacagaaagcagtaatggagagacaggtggatgaactaaaacttaacttacctctctcttcacatagcattagagcacagagaagattactacgacccttgggcatctgtgactactccattcaaaggttccttagaatgtttgctggaagcagttacagaaatgtgaacagggcttaaccagtgtactccataccctaaataattctgtataaataagagcttacatatctatgatgcctctctgtcacttcttttatattctcctttagtttgttttggggaaaattctaagtggatttgctccatgtaaatactgtacttccttatcgtattaacaaaggaagaggtaggagaatcaagacaatcgaatgtgtcagactaaagtagataataaatgctctttgggaaaaaaatattctcagtcaatgacagggaattctgatttgataaggaaattttcttgggttaatgaatgcaactgtagaatactgagtccgaccagcagaaacctacagccccaggccagctgaatcccattccttataccgtgagtatctgtgttcccttgcagcgggttttgtaggagtcagggataaagatagggaagcaggaggaaagggtcatagaatgctgccaaaggctctggaggctcaaaaggaagaactttgaattcacaaaacactatgccagctcagacctgggcatccaaatcagttaggatattggctaacagctgtaataaagaatgctacaaaaacagaagcttaaaccaaatagaattatacttcttcctcataaaccactccagggcagcaaggtaactcttcttttgaatgtcatgcaaggacccctgttttgttttgttttgttttgtttttttcccaagactgagtctcattctgtcacccaggctggagtgtattggtgtgctcactgcaacgtgtgcctcccaggttcaagcgattctcgtgcctcagcttcccaagcagctaggactacaggtgcccgccaccacacccagcaaattttttgtctctttagtagagtttgtctgtgttagtcaggctggcctcaaactcctgacctcaagtgatccgcccacctcagcctcccaaagggctgggattacaggagtgagctactgtgccacccagccaaggactcatgttttgaaaaggctgtggattatcatctcacattatgtctccagcaagttacagcagctttgtgattccaagtagcatggatggagatggcacttgtcatccccagggtggtatcctcattcctacctcctgcaccatagccaggctgtaggaaacagactgggaggaacaggagaagagcatcttccttttaaaggacattgactagaagtttctcctaatgctccctttcattccctgttgagcagagctgagtcacatggctatggcccgctgcaatggaggctgggaagtgtagtttctaactaagtagccaggtacctgaataaaacccagagggtaggagatgagattctattattacaagaagacacaatttctgccagggctttaaccggtggctctacccttcacagctggacattgctggatttttggatgattatttcattgtctccactcaaagattaagtttggaaaatagggaatttttctaccaaagcataggaactccaggccccagcccctcctcactctttctccctgttcattctcatctctttccagttccttacctcctgtaacctgtgggcatactaaagtaccaaggtaggcttagctgcaggcacggtacttccatgattcagtgccccgcccccaccactgagctaggccactcccaccaacaacctcaggccttcagatgcccaatttctgtgtagagctttgagcagtgttttccagttgtgaagggcaaaggaaattctccaattatttgtgtgttcatcttctctacctcccaggtaaaaaggagttgtctcaccattatagcttgtttcagaaacagtgtcaaattctcatcacagctcatgcatgccttctcaccagaagtaccctaattggttctctgactccaacaagagagctaggctttttgtttcttttgctttgttttgttttgatttgctcctttaaaaatgtttatggtgagctcagttatttaaaacaattcctggcagaggatttaagaggcctggcagaaattatgtaagcttgtacagtcatcttcactgataatgagtaaatcagatagcagacattaaaagattaagcactggtgtttggttttttggttggttggttttgttcacttgtttttaatgttgcaaaagtccttcatatgtcattgacaatagaatttaagtatttttgaaatgtactcagttcagattcaccattacatttcatgtccttaaggttggtagcttaagatagcttgtgcttcagttgcacaatactggcgtcagctctcctttaactcaaagctttctggtaattttcatctactggcagctcagtgggggcattttcaagtctcaatcacatcactttaatacataaacaaaaaagacccaacacaatagcaaatgaccatgagcttagtgccatcttgagtgtatgcttttagaccccagtgatgatacaacctttccttaatacagagaggaaaacaattttgatccgagaggctttctcccaggtgcatctgaaaaaacgttcagatatgtctcctgaatggttttgactaacacaacttactttcccccagaatagctcctctctaaaaaatgccaaagcttgcctttcagggacaaatcaaaggctaagcctgaggatgatggggtgacttgaaaaagactagccaagcgcttgactgctcagtgcagcctcgataacaccattcttggtggtgccatttgctccttgtccacagcccatatcccaatgagggttattcacttttgtaaccactggtttccctctgatagtgtctaaagaagcaaataatgatgaagtgagctgtacctccaacagagtttgaagctagccaggagcccttactgatgtttaaaaactggttcttttcaaaattgtggcaactttattttcagaaacaggtttcatcccaataagttatttggatgttttagaatagaataacgccatttgttgaaattcactgaagtaaggaacaatgtaatttgccactaaaattttgcacatttcatttttcttcaaaacacccagttttgattttttttgtttgtttgtttgtttgtttgtttgttttttttgagacagagtttcactcttattgcccaggctggagtgcaatggcatgatctcggctcatcacaacctctgcctcccgggctcaggcgattttcctgcctcaacttcccaagtagctgggattacaggcatgcaccacgcccagctaattttttgtatttgtggtagagacggggtttctccatgttggtcaggctggtcttgaactctcgacctaaggtgatctgcccacctcggcctcccagagtgctgggattacaggcatgagccaccgcgcccagcatgatgacttaaattctaatcatagtgatgttatgttcattgacacattactctgtgctaggcaccgtgacaggtgatctatgaatgctgtctcatgtagtcttcactataatccatgaattatatatattaacatgaaacccatttcacacgtgaggaaactatggttcaaaatggcagttagcttctccaaggttatataactcttcaggttttatccagaatcaaatctgagctctgattccagagttcttgctctgaactctattgctttcatgataaatttccctaagggctaaaaaatacctcgtaagaaaaatgtcttaaggccgggctcagtggctcatgcctgtaaccccagcactttgggaggctggggcaggtggattgcttgagtccaggagtttgagaccagcctaggcagcatggcaaaaccctgtatctactaaaaatattagctgggcagggtggcttgtgcctgtagtcccagtaacttgggaggctgagatgggaggatcacttgaacccaggaggcgggggtggcagtgagctaagatcacaccactgcactctagtctgggcaacagagcaagacgactctgtcaaaaaaaaaaaaagagagaaaagaaaaatgccttaaaattattatgcatgcaactttttctttctttcttttatccatagc

SEQ ID NO: 1878 - DNA, 6346 bp, Homo sapiens
agaaattgactgggaggtatttatgtaaatcagtagagttctaaggagttatctggcagccatgttaatggatgtgccactctgagaagcgaatctcgcattttgcttctcttgtcagaaggggttctgtgtgaccatttacacctacggatgattggctgtgacccagaggacatttgatgtaaaggatattttgtgcatgtcaatgagtcctgtccaggtggtgggatacaggctcgagacacatgttggagaagatcacttttgactgctggggagctatgggaagcccttccaaatgggcagaatgtgcaattactatctcagtaaatttgtctcaggagagctgtacacctcaggaacatcatatcatagaaaagggaagacaaaaaaggagctcaccttaaaagttccaaccacattccagggactgtttgtatttgactcattcatttattcaacaaatgtgaactgagcacttcaacgtgccatactgtcttctaggcactgaagatacaacagtggatatgatgggttgaatgtcggccccaaaaagatatgtccacatcctaatccctagaacctgtgattgtgaccttctttggaaaaagggtctttgaagatgtagttaagaatctgataatgagaggagcctggattatctgggtgagccctaaatccattgacatgtgtgcttttaagagacacacagaggaacaacactgcaggaggaggagaaggccatatgaatacggaggcaactcttggagtgatgtggcctcaagccaagaaacacctggagccacaggaagctgaaaaaggcaaggggtggaatctcctctagaacctatggaggaagtgtggtcccatcaacatcttgattttgcagcttccagaactgctagagaaaaatttctgttgttttaagccacaaagcttatagtttgttatagcagccacaggaaattaatacaataggctaaacagacaaaaatccctgccattgtgatgtgttcattctcgcttggtgcagacaggcaataaacaaataaaatgtattcaatgttgggttgtgatcaatgtaacacagtaacgaagcagaataagcggggaagaggtttgcttgtgagtggcatgatcatcaggaaagatgctactgagaaggggcgttcagagactgggaggaggtgagggaatgtgccgtgtaggtatgtggaggaaaagctgtctagacagaagggaatgaaactgcaaaggccgtgacactggagtgtgcctagtgtattggaggagatataaggcagcaaaggctgacaagaccagattatttagggcttttacttcaatttacccattgacttaacacttatctattgagcatgtaccaaatatattgttttacgacattcttgcaaaagcctggagaggtaggtaacaaaattcccactttaaagaggaaaacactgaatactggtccagcatgactcagctcatatgtggtggtactagaataggaatcttaatttgatgccaaccccagtgtcctttccccaacactggaatgacttatgtaaatatttatctcatttgtaatttgtctgtgtgttcagtcccatatgacagtcttgataagcccagctggcctctgaggccaatgcaaatatattttgagctgagaattgctcttgggcggtgagaggactgtagtttggaaaaggtcaagggctgtggattgccatctctcatggtgtcttcagaatgtttcagtagctttgtgactccaggtagcattgcattgataatttatctatttaactggcttaagtgggtttttttttttaattttctatctcaaaaatccaggctcataaatagggacagtatggaaaatgctgtatagggagaataaataaatgtataatcaggttagtaacatattatcattgatgcagctactgagcaaggaaaagcaaacaaagaaggagctttatttcatacccaagcaagtatagctcaattgcaaacctctcagacttgaatatatcacattggtcagtgcatatcatgtcctggaatgttacagaaagcagtaatggagagacaggtggatgaactaaaacttaacttacctctctcttcacatagcattagagcacagagaagattactacgacccttgggcatctgtgactactccattcaaaggttccttagaatgtttgctggaagcagttacagaaatgtgaacagggcttaaccagtgtactccataccctaaataattctgtataaataagagcttacatatctatgatgcctctctgtcacttcttttatattctcctttagtttgttttggggaaaattctaagtggatttgctccatgtaaatactgtacttccttatcgtattaacaaaggaagaggtaggagaatcaagacaatcgaatgtgtcagactaaagtagataataaatgctctttgggaaaaaaatattctcagtcaatgacagggaattctgatttgataaggaaattttcttgggttaatgaatgcaactgtagaatactgagtccgaccagcagaaacctacagccccaggccagctgaatcccattccttataccgtgagtatctgtgttcccttgcagcgggttttgtaggagtcagggataaagatagggaagcaggaggaaagggtcatagaatgctgccaaaggctctggaggctcaaaaggaagaactttgaattcacaaaacactatgccagctcagacctgggcatccaaatcagttaggatattggctaacagctgtaataaagaatgctacaaaaacagaagcttaaaccaaatagaattatacttcttcctcataaaccactccagggcagcaaggtaactcttcttttgaatgtcatgcaaggacccctgttttgttttgttttgttttgtttttttcccaagactgagtctcattctgtcacccaggctggagtgtattggtgtgctcactgcaacgtgtgcctcccaggttcaagcgattctcgtgcctcagcttcccaagcagctaggactacaggtgcccgccaccacacccagcaaattttttgtctctttagtagagtttgtctgtgttagtcaggctggcctcaaactcctgacctcaagtgatccgcccacctcagcctcccaaagggctgggattacaggagtgagctactgtgccacccagccaaggactcatgttttgaaaaggctgtggattatcatctcacattatgtctccagcaagttacagcagctttgtgattccaagtagcatggatggagatggcacttgtcatccccagggtggtatcctcattcctacctcctgcaccatagccaggctgtaggaaacagactgggaggaacaggagaagagcatcttccttttaaaggacattgactagaagtttctcctaatgctccctttcattccctgttgagcagagctgagtcacatggctatggcccgctgcaatggaggctgggaagtgtagtttctaactaagtagccaggtacctgaataaaacccagagggtaggagatgagattctattattacaagaagacacaatttctgccagggctttaaccggtggctctacccttcacagctggacattgctggatttttggatgattatttcattgtctccactcaaagattaagtttggaaaatagggaatttttctaccaaagcataggaactccaggccccagcccctcctcactctttctccctgttcattctcatctctttccagttccttacctcctgtaacctgtgggcatactaaagtaccaaggtaggcttagctgcaggcacggtacttccatgattcagtgccccgcccccaccactgagctaggccactcccaccaacaacctcaggccttcagatgcccaatttctgtgtagagctttgagcagtgttttccagttgtgaagggcaaaggaaattctccaattatttgtgtgttcatcttctctacctcccaggtaaaaaggagttgtctcaccattatagcttgtttcagaaacagtgtcaaattctcatcacagctcatgcatgccttctcaccagaagtaccctaattggttctctgactccaacaagagagctaggctttttgtttcttttgctttgttttgttttgatttgctcctttaaaaatgtttatggtgagctcagttatttaaaacaattcctggcagaggatttaagaggcctggcagaaattatgtaagcttgtacagtcatcttcactgataatgagtaaatcagatagcagacattaaaagattaagcactggtgtttggttttttggttggttggttttgttcacttgtttttaatgttgcaaaagtccttcatatgtcattgacaatagaatttaagtatttttgaaatgtactcagttcagattcaccattacatttcatgtccttaaggttggtagcttaagatagcttgtgcttcagttgcacaatactggcgtcagctctcctttaactcaaagctttctggtaattttcatctactggcagctcagtgggggcattttcaagtctcaatcacatcactttaatacataaacaaaaaagacccaacacaatagcaaatgaccatgagcttagtgccatcttgagtgtatgcttttagaccccagtgatgatacaacctttccttaatacagagaggaaaacaattttgatccgagaggctttctcccaggtgcatctgaaaaaacgttcagatatgtctcctgaatggttttgactaacacaacttactttcccccagaatagctcctctctaaaaaatgccaaagcttgcctttcagggacaaatcaaaggctaagcctgaggatgatggggtgacttgaaaaagactagccaagcgcttgactgctcagtgcagcctcgataacaccattcttggtggtgccatttgctccttgtccacagcccatatcccaatgagggttattcacttttgtaaccactggtttccctctgatagtgtctaaagaagcaaataatgatgaagtgagctgtacctccaacagagtttgaagctagccaggagcccttactgatgtttaaaaactggttcttttcaaaattgtggcaactttattttcagaaacaggtttcatcccaataagttatttggatgttttagaatagaataacgccatttgttgaaattcactgaagtaaggaacaatgtaatttgccactaaaattttgcacatttcatttttcttcaaaacacccagttttgattttttttgtttgtttgtttgtttgtttgtttgttttttttgagacagagtttcactcttattgcccaggctggagtgcaatggcatgatctcggctcatcacaacctctgcctcccgggctcaggcgattttcctgcctcaacttcccaagtagctgggattacaggcatgcaccacgcccagctaattttttgtatttgtggtagagacggggtttctccatgttggtcaggctggtcttgaactctcgacctaaggtgatctgcccacctcggcctcccagagtgctgggattacaggcatgagccaccgcgcccagcatgatgacttaaattctaatcatagtgatgttatgttcattgacacattactctgtgctaggcaccgtgacaggtgatctatgaatgctgtctcatgtagtcttcactataatccatgaattatatatattaacatgaaacccatttcacacgtgaggaaactatggttcaaaatggcagttagcttctccaaggttatataactcttcaggttttatccagaatcaaatctgagctctgattccagagttcttgctctgaactctattgctttcatgataaatttccctaagggctaaaaaatacctcgtaagaaaaatgtcttaaggccgggctcagtggctcatgcctgtaaccccagcactttgggaggctggggcaggtggattgcttgagtccaggagtttgagaccagcctaggcagcatggcaaaaccctgtatctactaaaaatattagctgggcagggtggcttgtgcctgtagtcccagtaacttgggaggctgagatgggaggatcacttgaacccaggaggcgggggtggcagtgagctaagatcacaccactgcactctagtctgggcaacagagcaagacgactctgtcaaaaaaaaaaaaagagagaaaagaaaaatgccttaaaattattatgcatgcaactttttctttctttcttttatccatagc

SEQ ID NO: 1879 - DNA, 2668 bp, Homo sapiens
acctcttccctactaattacattaatcaacaacaaacaacaactctaaaagattccccgagatgagagtttcagaagcctgagacgctatgtcaaacaacccaccgtagttattcagggacactgcaactcaaaatgaggtagccatcgatccagagaacaaatgatcattattcatgtaactctcttctttgcttaagaatccatctttttctatcagtgccaaattctctcactactttcctggttctaattcagaagtaagtaaagtcagctagtccctttgtttgggggttaggcccattttataaagaattaaaggaaaataggttaaacatgaactgcttctcagacgtggcatttacatgcctggtgcttccttagctcatcatataaccaagtactggaatctgttttacagataataagaaacattcacgtgttccatcttttacatatgtgaggaccaggcactgactagaaaattttcatcaccattgtcctcatcatcaccatcattagcatcttgtcgtcatcattgtcacgatgacaaagatgctttcatgatgatgaaagcatcatcatgctttatttacgtgatatcattgaatccttccaacaagataccagaccattttattgtagacattttacagatatttacactgaagttcagagttgttgagtggtttacccaagaatacgtagcaagtaaatgatagagctgaaaattcaatctgtctttctctagtgctaagccttagtttccctaccaagttttaaaggttgaacaaagcaaggtgttgaaagagcaccctgagtctgacagtcagaggggaatcagggcaggaagtatctactgaagaggtcctcaaatttcaggttgcctaaacagttactgaatgagcttgtcaaaatgcataaagaaggccctacaccactaccactaccaccaccctctgacacacatacacacagattgtgattcaataggcctgagattagtccaaaatctgtatttgtggcaaactccccaggtgatttcaacagagacagtctgtaggccacccttggagaaatggtgttatagctggattggggactgttgagatgcctaaatccccaacttgtagagctagcttgggctgctcccaagtctagcacactcattgatatggtttggctgtgtccccacgtaaatctcatcttgaattgtaacccccacaattcccatgtgtcgtaggaggaacctggtgggaggtgattgaatcattgaggcaggtctttcccatgctgttcttgtgatagtgaataagcctcacaagatctgatggttatataaaaatgagaatttccctgcacaagttctcttctcttatctgccaccatgtgagacatgccattcaccttccaccatgattgtgaggcttccccagccacatggaactgtaagtccaataaacctttatttttgtaaattgcccaatctcgagtatgtctttatcagtagtgcaaaaaatggactaatacactcacctatgtagggaaacctctttgttccctacataggttctctgcattggttcagagtccatctcttccactgggatgtccatcttgtggtcaaaacctgcaccccaggtaacataaaataaaaataacaatggctataattgtgaaccgcccgctaacctcctcttgtagtgctccaggccagacgctcatcaccttgttttgttgtctttgccatcagcattatagtagagccattggcactcacccatgtccagccccgttcctcctgggcacacagaaatttccgactctgttttctattgcctttgcagtcagatggaaccatatgactagtgctagccaaagtgtgtcatctccactctctttctttccttggtaccatggatgtgtttgatatggtgccagctgcaaagtagtggaggcttcttcagtgtgggttcttgagctgtcatatagcataaagccgccacccaccattctgaattcacagcatgagcaagagataaacaaacctttgttgagttaaggctctgggattttgttttattttgttcagtttttaatttctgtaccatatcctaacccatcctaaccaataaaacctcgtcgctgtcaacatcatcatcatcatcgcaataataaaatgtattaattatgaacataaaaccttaccgtgtgctgaacattagactaagcattttgcaaacattatctaatttaataatcacaccaacactataaaaaagacatagttgttatctgtgtcttacccagctggtaactgatcgggaaaaaaatgaaaacccagcagcctgactccaaagcccgtgtgcttatccaaacactacagcgtaggttgcttagtgccagcttcagtggttagttctttacatgcttatcataggtaatcctctgtcaacctgtagaagtaggcatgattaacttaattttccattgtgaacactgaaggttggacagattcaatgtctggtctgaggccacacatcacacaccacacactacataccacacatcacacaccacacatcacataccacacaccacacaccacacatggtggagttaggtcacaatccacgtccctctgactcttgaaggaagcatcatttatt

SEQ ID NO: 1880 - DNA, 21196 bp, Homo sapiens
tttttacgctagatgaattcaagtttttcagatgctttcatagtggtaggactatggggtgggggtggggaagagtgccaggaaaagaaaaataaagctgtaaaagttgaatacagcacccagattttggtttttaaatatcgtcccccaataagaataaccaagactcaacagagcagttgctgattccggggctgcggaaaggaaaacagaagatgaactggagcatttcatagtgtcagaaaaaagtgctcaagacaaataggattggtgtatgttaaacaacaggatgggtgccaacactggaacaatttaaatgaaataaacagtaatagcagtacattatgacccaaagagtaaaaaaaatatactcatgagtctgtacttttataaatgaatgactgaataattaaatcaatgagggagaaggaacaactcttcattacagaagaattccaactaataaatataggatgaatgaagggaatagaaaaatcatcattagaatagcacataattcaggcaagatctactgttgaatactaaaattcatggttgaatgtttaaggagacagaatatttacaaagtctgaaagtatctctcccaaaatattaattacagaagaaaaatagtaattttacagctgagaaacctggcagacattaactgaaacacatgatcaaggttagtatcatttgtaacaagacataccgataccacatatcccctgatataaaaaaaaggcacatcacttctgtggcatttttcccccaaaatgcataaccttaatctaactatgagaaaatatcagataaaatcaaattgaggagcagtctacaaaatacttcgccaggtaatgatatactgtatctgagtaagatggccaactggaagcccctagcactcatcgccatcacaaagacagacagaacaacaaataaacaaatgtattttgaagaaaatagctaagggagaacactggggtatatcacaggaacagaaaccctggtgagtacagaaacttaggatggccacacggagaatggaaggaaatgccgggcctccaccacctcatcctccaaatgggatcagctgaaagccaggaggaacttctcatggtgaggagataagcaagaggatcccagcaacctccatcaacaccttgaacatgtagagatcttacctcacaggtacaaagtccagctgacggaattacctggagtccacgtaactgtgctcaccgtagagaaaaagcaaacactaggctccacaccctgcagctacagggctactacgctatgccatcgtagaattggaactatggctggagggtgtcttgctctggcggtgagtagccgtgactctccttcatctctgagactaagatgcaactgaaccaccgccccagccaagtggtccaacatccccaagccaagcttcctttcctgtggggccaagcagagacagagccactttacttacccctccacccttgtgcttgagctgaagtagtatcttgcctcttgcaaaaacagtaccttggccactctgagcagtcatgtctccctgaagtctaagatgaagcagtgccctgcatcccaggaaatggtgacttggccacccagaagaatgatcatgcattacagtacctaagctgaagtggagccctacatcccagggaaatggttcctggtcttcccagaataatcacactctaccaagcttgagctgaagcagcattatcaccctctgggaataggtgccttggctgagccgagcagctgcacatctcagagctgagctgatgtagtaccctgcatcccagggcaaaaaagcagtggctaagctgagatactctgctctacaggccaaacagctctagtatcctgcttctgtggagctggactagctacctagagtgtgagttgctgagatacccatctcccttgatggtggggtcagaactgtgctgttccctgttcctcgcagggtccaatgacagctgtgctctgccattctgggtatttgctgccactacatctggcctcccagagggaggatactgctgagccccactataccacggtctagagttattactacacagttgctcatcctctagaacccaaattgccactgagccctattggctcagattcctaaactgcagctgaattttgctccccaggctcaaacctccaaagtaccccttactccatggagtcaggccagagctgtgttctgcctccttcaggggtagaatcatagctacaactcagcttcctgagaccaggctgctagatggtacctgagtcacagattttggttctatggacaaccggtatccaaccctgccacagaaagcgaacctgtactccaagacccagttgccaaaacagggtcatgagaccctgagattaggacctccatctgccccacagctgctctggacatctgcacctggaacccagagctgctgcagctgcttgtaggttgtgtcagacctgacaataagaggaatccccttggctaagtctcctaattgtggggaaaatgagaatagaagaatcccaaaaagcctatgacaccaagaacattaacaatctatgctgctgcagctgctgccgccacaaagttctacagcctaggctactgaggtgcccacagttattgctgatgttcaatgcagctggagcagctgcatggagactataccactgcacctatctggaaagagagtcaccataccctttccaaatggcacactaaaacccaataacaggtgaaagtctgtctctatgaaagatattttaggaagtttggaagagacaactgttctaccagatgcacagacatcaatgcagggaccaatacagacagactattcaatgaaatcaggaaaacaattcacaatataaacaagaaattcaacaaagagatataaataaaaagaaccaaacaaaaacgctgtagctgaagaattcaataaatgaaatttaaagaaatacattagagagcttcagcagcacactttgatcaaaaagaaagaatctctgaatatgaaggtaagttatttgaaatttgtcattggagaaagaaaaggaaataagaatgaaaaagaacgaagaaagcctacaagacttatgagacaacattaagcaaacaaaactttctattatgggagtttcagaagaagaagggaaaaggtgtagaaaaacctatttaatgaaatcatagcagaaaacttctcaagtctggggagaaatatgcacattcagatccaggaagctcaaaggtccccaaatagattcaatccaaatcattcctcacggcacattacagtcaaattgtcaaaagttaaagacaaagagagaattctaaaaacagcaagagaaaagtgtcaagtcatataaaaggaaatctccattagactaatagcagatttctctgaagaaagctcacaggccaggagaaaatgggatgatctattcaaagtgctaagagaaaaaaaaaatgccaccaaaaataccatactcagcaaagatatccttcagaaacaagggagaaataaaatctttcccagacaagcaaaactgaggaaatttatcaccactagataaggcttacaagaaattctcaagggcagccgggtgcagtggctcatgctcgtaatcccagcactttgggaggctgaagtgggtggatcatgaggtcaagagatagagacaagcatggccaacgtggcgaaaccctgtctctactaaaaatacaaaaatttgtcagttttggcttctgttgccattgcttttggtattttatacatgaagtccttgcccatgcctatgtcccgaatggtattgcctaggttttcttctagggtttttatggttttaggtctaacatttaagtctttaatccatcttgaattaatttttgtataaggtgtaaggaagggatccagtttcagccttctacctatggctagccagttgtcccagctcactcatagtgggggaactgaacaatgagaacacttggacacaggaagggggacatcacacaccggggcctgttgtggggtgcggggagcgggggagggatagcattaggagatatacctaatgtaaatgataagttaatgggtgcagcacaccaacatggcacatgtatacatatgtaacaaacctgcatgttgtccacatgtaccctagaacttaaagtataattacaaaaaaatacaaaaattagctaggtgtggtggccagcacctgtagtcccagctattcaggaggctggggcaggagaattgcttgaacctaggaggcggaggttgcagtgagccgagattgcaccactgcactccagcctggcgacagagcaagactctgtcttaaaaaaaaaaaaaaaaaattagttgggcatggtggcacacacctgtcatcccagctactcgggaggctgaggcacaagaatcacttgaacccaggaagtggaggttccagtgagccaagatcatgtgactgcactccaggctgggtgacagagtgagactttgcctcaaaaaaaaaaaatgctcaaaggcatcctacatctaaaaacacaaagacaataatcactatcacgtaaatatgcacaagtataaaactcactggtagaacagataacacaaattagaaaaagaataaaaacttacaactacagaaaaccaccaaaccacaatgataaacaataagagagaaagaaagaaacaaagaatacacaaaacaactaacaaagtgacaggaataagacctcaccaatcagtaataaccttgaataataaattgattaaattccccactaaaaagctacagagtagccaaatggattttaaaaacaaaatgatccaattgtattctgccaacaagaaacttaattcacctgtaagaaacatacagaatgaaagtgaagggatgaataaagatattccacacaaacaaaaaccaaaagcaaaaaggaatagcaatatttacactagacaaagcagaatttaagtcaaaaactaaaaagaaacaaaagctcataatataatgataaaaggatcaattcaacaagaggatataacaactgttaatataatgtatccaacactggagcacccagatataaagcaaatattattcaatctaaaaggatagattccattacaataatagggacttaatcatccaactctcagcattgagaagatcatctaggcagaagaaaatcaacaaagaaacactggacttaaactgcactcaagaccaaatggacccaacagacatttagaacacttcgttccacagttgtagaatacacattcttttcattggcatatgaaacgttcttgtggacagaccacacgttaggtcacaaaacaagacacaacaaatttaagataactgaaatcatatcaagtatcttttctgaccacaatggaataaaattataaatcactacaagaacttttgaagttatacaaatatagggaaatcaaagaacccacttctgaatgaccagtggatcaatgaagaaattaagaaaaagatttaaacatttaaatcatttcatttgaaacaaatgaaaattaaaaaccaacataccaaaacctatggactacaacaaaaacagtattaagaagcttatagcaataaacactgatatggtttggctctgtgtccacacccaaatctcatcttgaattgtagttcccataatcccaaagtgtcatgggaggaactaggtggaaggtaattgaatcatggaggcagttcccaccatgctgttctccttatagtgaatttgttctcacaagatctgatgattttataagaagcttccccctttgcttggcactcattttccttcctgctgccacgtgaagaaggatgagtttgcttccccttctgccatgattgtaaggtttcttaaggcctccccagccctgcagaactgtgagtcaattaaacctcttttctttataaattacccagtctcaggtatttcttcacagcggtataagaacagactaatacaaacacctatgtcagaaaagtaggaagatttcaaataaacaatctaacaatgcattacaaggaaccagacaagcaaaaacaaagcaaacccaaaattcatagagaaaaaaaccaatcaaggttggtgcaaaataaacaaaattgagactaaaaaaaattacaaaagatcaacaaaatgaaaatttttaaagacaaaattgacaaaccaataggtagactaatatagaaaacaagtactattataaaataactgttcaaagcaattatattattttttgaatgctagtatccattcagatttttttttttgagatggactcttgctctgtcgcccaggctggagtgcaatggcattatctccatttactgcaacctccgccccctgggttcaagcaattctcctgcctcagacttctgagtagctgggattacaggcacctgccaccacacctggctaactttttgtatttttagtagagacagggtttcactacgttggccaggctggtctcgaactctggacctcatgatccacccacctcggcctcccaaagtgctgggattacaggcgtgcgctactgtgcccagccattcattcagatttatccacatacttatggtttctattgctctttatatctttctgtatctctgtatttctatatagaatcattttccttttgcctggcaaaacccctctagatttccttcatatttgatctgcagattctgtttatctgtcctctccttttgggatttcaatacaaacatttcagattcctttaccaaataccgtatgtctctcatgctattttctgtattttccatcctattattttgtgtttgaatctggctatttcttctgaactatcagtttatcaattctctcctcagctatatctaatcttctgataaacctatccactgacttgttaacttcagctatcgtatttttcatttctaatattttcatttgagtatttaaagctctctgtcaaaattccctattgtattcaatttttgaaaatattaatcacagctgtttttaaatccataattgataagtctaatgtggatttcctatgagtctaattgtctggtttttttcctcctggtttcagtcattttttgtctttcaaaatgcctggttattttttaccgtgttccagacattatatttaaaaagctatagatatcctcctttagagaaccttaacatttacttgtggcacacttctaaaatatgatctaacaccattaatcacttaagtattaagctgatttccctatggactttagtgcttgtataggatattttactcactctattcctaggatattgcctttcaggggtttcaaccaaaagctgaaatagtccagggctcctcttccttgttagtctctgaactccatttttttccctttcagcccaacacaactgctaaaaattctgctcagtctctcagtcaccattgtaattttcagaattgacttttgcattaaggaaaaaacagcatcaaatgtcaagttcgattatcttggttttccttttcttccagatcttagccccacaaattcttactatcttttttttgtttgttttgggatggggtctcattctgttggccaggccagagtgcagtagtgcgatcttggctcactgcagcctccgcctcctggggtcaagtgattctcctgactcagcctcctgagtagctgggactacaggcacgtgccaccaaacctgactaatttttgtatttttttaagtagagttggggtttcaccatgttggccagcctggtctcaaactcctgacctcaagtgatctccctacttcggcctcccaaagtgctggaattacaggtgtgagccatcgtgtccagacaaattcttattatctgtgtaactctctgatggcttcaaagagatttttaaaaaatattttctcagctttcctatgtatttttagtatacatacctggtgtttggtctaggacaaccaaatcagccacttccagaagtagaaatgcccagtttaacatgtatttagtttgaagtgcctatgagacatccaagaggacttgttaattataaaatgatgtacataattctggaatttaagctagacatctgcaatagtagacataaatttgggacttactgtagaaatggccctaattgctataaaactagatatacaagtggaagaacagttggaaggaagaaaaactaaggcattcaaggaagtaaggagataaagaaaatggagtggttacaaaagacaaagtgggggagacacaaggggaaagtaaaagcaagagagcatctttccataagaaaataggaataatggaaagagaagaagaaaaagctagaaaaaatggaaaggtagagagaaaaacaatgaggagggctgggaagaaagatggcaaggggagggaagtttggaagaaggaaggtaggataggcaggtagcaccaaaaaaggaagggagagacagaataagtgatatgatttggacattgtgtcccctacaaagctcatgttgaaatgtgacctccagtattggaggtgggcctaggggggagccatttgggtcactggggcagatacctcatcaatgggttggtgctatcgtcatgatgcgtgagttttcactctattagttcatgtaagatttggttgtttaaaagaccctggcacctcctcccctctctcttgctccctctcttgtcatgtgattctcctgcttccctttcaccttctgccacaattgtaagtttcctgaggccctcaacagaagcaagtgttagcagcagcttccagtatagcctacagaagtgtgtgccaaaatatctcttttctttataaattacctagtctgagatgttccctcatagcagcacaaacagaaataacacaaaaaggaagaaaggctgacagaaaggacagacctttgtaagatggatctttgtaaagatgacagagacagactaaccagccttggaaggacagactaaccagtcttagaaaggacaaatgggtgtttggatgtcaattatgaaagaaggagggggcagcatgaaagaaaggaagagtggaatggatgagaaagagcaggacagaaagattcagacactttgataaggagacttaacaggaagtgagtatgagagctctagaaaaaagaaaataatgaaagaacaacaaaataaatccaattaagatagccactaaatatgatgtggttttcaaaagaaaggtggagaaacagtttaaaaatttcaaacaagagggttatgaacctgtcatggactgaaaacaaatttcaattacatgcgtttacacatttgaaaataaaaatgttccctaaccatatagctgttatgtaattatatgaaaaacatgtgttatgtagagaaaaaacaaacaaacaaacagaaacaacagaactattcttaactaatcctgtgagtcacattatcttatttaggtaaaaagttacatttaggcctgtattaatttttaaatattcttatagtcctactgcttttatgtcctttttatggtaaaatattagtgaccaataaaatgcagaaaattgtatctgaagcactttcattcactcattctttcaatcaacatttgggtattttcttgagttaaaaaaaatcaataaagctttaaaaatagataaataagaagatacagaattcccatccttgaagcctcccaaatttaatgagaataagatatggatattacctatcaaactgcattattaaagttcatggcacagaggagtcaatctgtcaaggaaggtccataaagtttcacgaagataatctttgatatgggccttttaactatcatagcatttcactttgtgacagcagcataaaatgatctgtaatagaagtatatataccttctagagttgaattacactagcacaagtctatataacttatgccaccatgatttcaaaaaccacatagaggtaattgtaatctaaggctcctactaatttttatctatttttaaagaacactatattgtgactccaaaggggagggaaaatcagcagaacatctacttggggactttaggagacttatataaaattaaataaaatctgttaagcatttgtaaaaggcaaattagaactatatataatgattttctgtagtctaaaagaaatttcccttctcaaaaaaattattcaaaaatgctgaaaattattctgatttttctgacctatgatataaattgtaaacaactatcccaagtttgcacgaggtttttctaacggttacttggtaaggatgatttttaaagagaaagacaagaaaaagaaaatcaagaaggtcataaaagaacctagaattctatacccagtgtaaataaggatggtatcttcagacaaacttgggagagtttaccattagcagccttttactatagagaattctaaaaaatctaacgtaattagatttgagactctcctaaaatgacagtacctctttaccacaagggcagtcccttgaataacactttataatcatttatttattcaacaaatatttattgagaacttatgtactaaagactgtactagatattagaaacacacctgtggttttttaaagtcaaacttcctacaatttgaagctaatattctagaaggagagggagtaaagacagaataatacaaaaacagtaaagcaaactgttcaaatggtaataactgaataacataaagttaaaggggaaactgggacttcagggaataaaggaatggagactggtattttatatgaaacaagtcaagaaaatactcactgataatagaacatctgtgcagaaacctgaaggaaagttggagagcaagcagtgctggtaaggaaacattttgtgcagagggaacagcagatgtacaacacaggtgaagaacatgcatggcactttaaaaagaatactcaaaaaaccagtatggccacagcacagagagtgaaagagtggcaagagattattaggttagaaagttatcaagttccagttcacatgacatcttgtagactatggtaagggctctgccttttactctgagatataagccactagagattgatcctacttgtgattatgaaggatcacaatgagctgaagaggaagaaggagagaaccagagaatctgaagggaaattattcggtagttaatgtggaagcatgagatggtccgaacttggatacattttgaaggcagagcccatataatttaatcaacatgtttaaagtaaaaaaagcaaggaataagaaatggcagatttgaaaaagaaccaaagaaaatctccatatatgaaaaatataataattgaaatccaaacttaacagatacagttaaaaataacatttatagaatagctgataaaaagacatttttaaaaatgaagtacagagaaccaaagagatggaaaatatgaagaaaataaaagagtgcagtaaaaatgtctaacacacgtacaaatgtattttttttttgagacggagtttcactcttgctgcccaggctggagtgcaatggcgcaatctcagctcaccataacctctgcctcccgggttcaagcaattctcctgcctcagcctcctgagtagctgggattacaggcatgtgccaccacacccgacaaattttttgtatttttagtagagagggggtttctccatgttggtcaggctgatctcgaacttccaacctcaggtgatttgcctgcctcggcctcccaaagtgctgggattacaggcataagccacggtggccggctacaaatgtatttccaaaaagagaaaataaagcaaggcaaagcaagatctgaaaaagtaacagctgaaaaactttcaaagctgatgaaagatagcaacagacaggtttcaaggagcactgtaaatccaagagaagtaaatacaaagaaactcagacggagattcatcatcgaaaaacttcagaacatgtcagagaaagagaatatttaaaattagacaaaaagaaacaagatattacccccaaaaaaagtatgagtgggagtggcagctgactataactacatccccaacaggctcagagaaaatcactgtcaacctagaattctatatccagtgtaaacaaggccagtatcttcaaacaaacctaagagagtttaccatcaccagtctttttctatagagaattctaaaagatacatctgagataaaagaaaaatgttccccaatggaagagctgagatgctaggaagaataaagaacattgtaaatagtagatatgtgggtaaatgaatactggccttataaaacaagaataatatattttggtttttaaaaacaaaaacagagaaatgaccagaattagaatatataaatcagaagaaaggtaattagagtttgcgtttcaagggccttgaattatctaataaatagacaaaattattgattaactttagacattaaccaatgtgcttctggtaatttctagagtaaacactaaaagaatagctaaaataatgtgtaattattttattaattaataaatttattaagtctgataaattaataaatctagttattagaaagaaattaatgaaatttaaaacaacagaatttaaaagaatattaaaaaatagaacaggaaggacaaaaagaaaacacaaaataatatgacaataaatccaaatactttggtaattataacaaatgtaaacagactaacgaaaggcttcaattaattaaaaactatcagactaaataaacaaaagttaatatatgctatttacaagagacatctaaaagactccagaaagtttgaaaaaaaaaaaaagggatacaaaaaagttgactataaacataccaaagaaagctgccatagctatattaattataaacataatgaactgtaaagaaatatactataaagtcacgttcataatgactttaaccaggttaataatcatctaaatatatacatattttacacatttctccacacctcgtaatgataagaacaaaagccttcacttcaccaggagaacatatatttaattttagcatttcaaattgtataaagtaaaaatgacagagcttcaaataaagacagatctatgattaaactgtggggattttaacattcttctgataataattgagataagcagaccaaaaatgagtacagaagatttggacaacttattaacaaccttgacctaatggaaaaacaaagaatatcccgtctaataacaatgaagacagcagtatacacatggaacatttttaaaaattcagcatatattggaccatttaaaaaaaagtctatataaatttcaaagaactgaaattatttacagcatagtctctgaccttgacgtatttatgctaaaaattaatactgaaaagacaattagaaaactttgcatgtttggaatataataaatattataagtaacaaaggatataattctaaataattcacagaccaaagaaaaaaatcataacaaaatttagaaaatattttgaactgaataatgaaaataccacattaaagagaatgtggaataaaactacagtagcaattagagggatatttacacacctaaataattgtatcagataaaaaggaaaggctaaaaatagcctaagaattcagcctattaaattgaataggctaaatagggtattcaataggctaactccatttcaataagttagcgtaaaaaaaagcagaacaaagaaataaaattaacacattctgaaataaaaaacaaacctaccatagtgaaggcaaataaagttggttgtctgaaaagacaataaaactaaccaacctctgatgaaatgtatcaggacaaaaggtaggagacacaaataagcaatatcaaaaatgaaaaggtttgggtgtaattgctcacacctgtaatcccagcactttgggagactgaggcaggagaatggcttgagtgtaggagacagagcaagaccctgtctcaaaaaaaaaaagaatgaaagaaaagggcaaaataaccatagatactacatatatttatatcaaacaagaataaagctaaatgggtttcaatttcaagtaacagcttaggttatttagatcaatctaattggtctaaacaaacaaaaatactggttaagatatataaaatatctccctaaagagttggcaagacaataaggaattcccaaaccaaaagctaagtcgaacatataattagtttttgccctaagaacatttgctaataatcccagagaaccttaatagtggttttgacagcctcacggtacaaggacagaaattaaagcctagaaccagctcaagacagagagtctaagatactccaaaacattaagccaagatgccaaaaggctagacatcgttagggaagacgtgaaccagaaacaaaatcctcctccacaccttttgtgaggttgccttggcactcagcagaaaaagatggaaaatataaataaaaagtaaagaatttataggctgtaagcactggccagcccttaggtggattttcatcagaggggcacaagaaatctcaaacaataaatttaaagtgccctgcagtggtaatgactctaatgccattaagaagtaagttcaaattctagagcaagcttgcccaacctgtggcctgcgggctgcatgtggcccaggtcagctttgaatgtggcccaacacaattttgtaaactttctcaaaacattatgagatttaagcacagacttttttttttttaagctcatcagctatcattaatgttagtatattttatgtgtagcctatgacaattcttccaatgtggcccagggaagccaaaagattgttctagaggaagacaaccttataaaaggcctcaggaagttcccacaaataatctttcaaaaaatgagaaaaatcttcaaagcagctagaggataggagtagatgacaaattacattcaaaggagaaacagtttccaacagcaataaaggtaaccagaagacaacagaatattttcaataaactggtaacaaacccagaaacctaaaattctatattcatgaagatatctttcaagaattaagacaaacatatagacattttgataaaagataaaagagtttgtctccaaaagatgtcactaaaaaaaattctaaatgatatattttaggcagaagtaaagtgattacagatgattgtctagtatgtaagaaatatgtaaagctatcatgtaacaataaaaaaaagaaaaaattaagagaaaatgaagtcactgcattagatgcctcctaagtacttacaatacagaagagcaaatagttacataagcaccataatatactgcagtaagtattgtacaatacttagtcatacttttgttaacaagattgaaaaatctacactgactaaacaatgaaaatggtataaagaaagcccaataaatgccaagtagaaagatttatggagtgcctgtcacttaataggcataaataataatcagcaaataatgggttggcaaatcaggaggcaatatggcacaggaatttaaaaagaaagccctgcctacccactcgtgaatgagtaaaacgagcggaatctaacatcaggagtgagggaatagaagaatgcctctttctttctctccaaagttttctcacaaacccacatttcaaagatgagaggactggcatataattgagtaaaactgcaaaaacaaacaaaagcctttaagaaaagtttcagcttagctgggcgtggtggtatgtgcctgtactcctagctacttgggaggctgaggtgggaggatcacctgagtccaggagctgggggccacagtggactatcatcatgccactgtactccagcctgggtgacagagcaagaccctgtctctataagaatgaataaataaatgaaaaaataagaatgagttaattaaggttaggactggtggctcacacctgtaactgcaacactttggaaggctgagtcaagagaactgattgaggccaggagttcaagaccagcctgggcaacaaagtgagacgccgtctctccaaaaaaacaacaaaaaaaattagctgggcatggtggcatgtgcctgtggtcccagttactcaggaggctgaggccacttgagcccaggagtttgaggctgtagtaagccatgatcacaccactgcactccagcctgggcaacagagcaaggccctgtctcaaaaataaaaaaacaaacaaatatataaagtgtcaggaatattcaaactgaagtttaaaaaaaagttaaagatgagaatataactccttttaaaattcatgctcatggcaagaaaattaacaaagagaatacaagcctataactcagaataatataatattaataaatgacagagagaatgcagaacgtcctcttccactagcacctggtaaatacatacacacagacacagatgcacacacacacactcacacgcttcaataagaaactttaaataggagtgtacaaacctaaagagagaacaaaagtccaagataaacctcttggcaagagtaacagaacaccacagacacaatgaatgagctcaagttgagaaaatagttacaggactggagatgaaaaaacaagttggatttttaaaggtggctatcagtggggaaaattccttacaagccagtaagtgtgcttactttcctcaggaaggtaacataaagggttattaaacaaagtttagaagtacttagaaaacagagcttgttctaaaataaaaaactgaattactaataaggtcatgtcaagataacctcttttcactttctgattattagactggcaataacatatgacaatagtatatggcaaagtaaatgatgctttttgcgaagacagaaaattctgaatgttgataagatttttaactggatgaattgtagccaataaagtattgttgaatgaataaattctaacctggaataaggattctaataccaatgagcctatcatgaggctttctgtacccatacagctcttgatgatttcataattattttcaattatacaaaaaagctaaaaggatttggaatctaatcaatcacgttttatattaagacactgtaagcacagatatggcctagggcaagtggtttaatctcactggacctatttcctcatctaataagtggacgaaatcagtgacattcaaactttctggcagtccctcatattaatagtaagaaaaatgatccagtgcaactaacatgtatgtgtttggtgtatgtaactaaaacaaaagtttcataaaacagaatgctcttatgacataatgtgcctaatattttctagtctatttcattatttttaatgtaagttacaaccccccaaattgatatcataaccaaaaatgggacatgaatagagattttgtttatttttctgaaacagggtcttgttctgttgcccaggctggagtgcagtagcatgatcacagctcactgcagcctcaacctccctggctcaagtggcccttctgcctcagcctcctgagtactgaaactagtgggcaccaccatacttgtctaattttttttccgtttttttagtagagatgaagtctcgctatgttgcccaggctggtcttgaactcatggcctcaagcaatcctcccacttcagcctcccaaagtgttgagattacaggcatgagctaccatgcctgatcatgaatacaggtttgaaaaaataatggacaagacttctaaagtcatctatatacagctgtacaatttaataaatagttctccaatttagatatcaaacaaaatccatgatatccaaccagtagatgatgtatactatatcaacataaatagtaatgatgatctcacagtgacagaactcagaattataccaaacaactgaacactgggttgaaaacaaaatgaatctacacaggtaaggctctgcatttaggttcagaaatcctctcaacagagcctggcagcaggtgaaatgaacaagacctgcaggctttagttaacttcaagcctattatgtgatctcagtgtaattcaccaatttattgttatctataaataatactgtttttaataaatatgtgtgatataaataaatattttggtactatgcagatcaaaggtaatctgagatcaaatttaatctggatcagagtgatcagttgtagtccccatccatgtaacataaaagaacaaaatattgatattatatgcgttgatattaatatacattttactgagtataatttccccaatatagtatgctaagtatttttctttatctcatttaatactcaaacaattctatgagatatgtggtgctatagtttgaatgtgtcccccaaaaagcacatgttagaaacttaatccccaatgcaacaacgttcagaagtgggacctttaagatgtgatgaggccaggagggctctatttcattaatgccattatcacagaagtgggttcttcatctaaggacaagttcagcctcctattgctctctctctcttgtcctctctttgctcttctgccatgggatgatggggcaagaaggtcctatcaaatgccagccccttcatcttgggacttcccagcctccaaacccataagcaatatatttttgttcattaaaaattacccagtctttggtactgtgttatagcagcacacaacagactaagatagtattatctccatttaaaaataaagaaacaatcttagaaaagttaaatatcctacccaggtcacacatgttgttagtgggtaaatgctcaaatcaggaactgaacgcaggtctttctgaagagaaactatgaccttttaactcttttttaaaaaaatttgggccgggtgtggtggctcacgcctgtaatcccagccgaggtgggcggatcacgaggtcaggagatggataccatcctggctaacacagtgaaaccccgtctctactaaaaatacaaaaaattagccaggtgtggtggcgggcacctgtagtcccagctactcgggagggtgaggcaggagaatggcttgaacccgggaggcggaagttgtgagctgagatcgcgccactgcactccagcctgggtgacagagtgagactctgtctcaaaaaacaaaaatcaaacaaacaaaaaaaattatttctctttactgagattcccaaaaagctggaagtctgtgtttattaaactcctatttcttatcaaacttttattaaaaagttcattaaaggatctatggctataacaactatttaacatatatgtggaccactaaattcaggtaaattaatagaaaatatattaaaatgtttaataaaatgtaaacatattttaattaataataacaatgatcgttttctaccacaatattttaccagtgtctctttaccttattagtgatggctcactactataagcactcagaagttaattcagtgaaccctaaaaaagctgacagccaaatgcttcaattcaggaaatagtaataaactgattcctaatacagtcttttttttttttttaagatggagtctcactctgttgtccaggctagagtacagagttcagtggcgtgatcttagctcactgcaacctctgcctcccaggttcaagcaattctcctgcctcagcctcctgggtagctgggattacaggcatccaccaccacgcccggctaatttttttgtctttttagtagagatggggtttcaccatgttggccaggctggtcttgaactcctgacctcaagtgatccatccacctcagcctcccaaagtgctaggatcacaggcatgagccactgcgcccggcccctaatacattctttagttgcatttggacttggaaaatatttcttcaaatcctatttcaatgcacaaaaatacacatttttcttaccatatccactagcatatcattaatttctttctctaaacaagtgatcaaaattatccaatgctgggaaggagttaaacttcaccatcacagttcaatctttagaaatcctattatctactcaggcacagtggtgtagtcccagctacttgggaggctgaggcacgagaactccttgaaccctggaagtggaggcggatgcagtgagccaaggttgtgccactgcactccagcctggacaacagagcaagaccctgtctcaaaaaaaaaaaaaaaaaaagaaaaaaagaaaaaaaaaaagaaaagaaaccctattatcttatcctcaacattcaacattaaaaatcctattttggctctattccggaaactaaaaagtcacagaagtaactttttattgacatcgtattatgaataaatgttttcatctcatcctatatttcaaaaacttacatgagcaccttttgtttttataatatacttcagaaatggaaaccaaagccttgactcaagatattttcaggaagatgaaacaattttcacttgattattatagttttaattatattcataatttgtattacattcaacaattaatcatgattaggaagcaaaatgttgactaccaactcttttttctgaataaaacaatgtcagcaattacattacagtacaagttattttattctactatcacttaaaacttagtttttccttgatgctcaaagctagtactgtgtcagcgctgacataatatatattttccagtctaaaaaaagtcacaaaagaatcattaaactaagaatttcttctcctggtttttctgtgataaaatagtaagttatcttgcagatctccctcatacatacaccatagaagtacaaatacctcatttctacaatgcacactgggagttgcattcaaacaaaaggaaatatatattcaagccagtatttaacagtactgactcttttacattgtataccatgaatacaggattatccataacgtcatacgataaaagaatattgtcaaatagcttattctgcctcttcttccagaacagtccagtcaatagcttcataagtgaatttcagtctttttggcaaatatttccctacttcctaaaacattcattaatgattaagtttttctcaatttaaa

SEQ ID NO: 1881 - DNA, 768 bp, Homo sapiens
ctatagatatcctcctttagagaaccttaacatttacttgtggcacacttctaaaatatgatctaacaccattaatcacttaagtattaagctgatttccctatggactttagtgcttgtataggatattttactcactctattcctaggatattgcctttcaggggtttcaaccaaaagctgaaatagtccagggctcctcttccttgttagtctctgaactccatttttttccctttcagcccaacacaactgctaaaaattctgctcagtctctcagtcaccattgtaattttcagaattgacttttgcattaaggaaaaaacagcatcaaatgtcaagttcgattatcttggttttccttttcttccagatcttagccccacaaattcttactatcttttttttgtttgttttgggatggggtctcattctgttggccaggccagagtgcagtagtgcgatcttggctcactgcagcctccgcctcctggggtcaagtgattctcctgactcagcctcctgagtagctgggactacaggcacgtgccaccaaacctgactaatttttgtatttttttaagtagagttggggtttcaccatgttggccagcctggtctcaaactcctgacctcaagtgatctccctacttcggcctcccaaagtgctggaattacaggtgtgagccatcgtgtccagacaaattcttattatctgtgtaactctctgatggcttcaaagagatttttaaaaaatattttctcagc

SEQ ID NO: 1882 - DNA, 6556 bp, Homo sapiens
ggactcttctcagattatttcttgtgaaaacctcaagagtctgaatttacagggaaatcttacaattagctcgatgtggattacagagcggcaaacaaccttaagtggtagagctggttctgcaagatttttccaaccctttgtggtctagttttcatttttccccttttaaagttgttttcagctaaagctgtgaggacagtatagagttttgccttgtaaaattggtagtgagtaattttagaatagatgcttatgaagtctgtaaataaatagtaaggcgcctcgcctagttccacgcacatgtcagtttcgtaactatctccccaagctgagctcacctgccagtgccttggatggacctagccaccaggggctgcagatgagtaggagagcgggtgttgcccagagcagggcggacacccctgttccctgtcatgttttcttctcaaaacctgctgcaggccattggagagcattcctgttgctctctgcacccctctttctgaagcattttactgtgtgatcctagcatccgtggttcaggagatcctgctacattttcctgactgccttgctctgcccgggaatacctggcttatcagcagaatacaggcctctgcttaactgaatttggtcctgtagtgaggactaagaagtgatgtactcagttacatgataattctaaaaaataaaaaaaagcctttttttttttttgttaacacccatcatagtggcagaatcttaagtctgcatgtagagggggttggcagggcagtagaagcagggggccctgtgtcctgttggtagaagagtgagcagaatggccactggagagccacttggtggaggtgcctgcagcacagcgagcagcctccttcccagatgaagcatgcatcttagaggcgaccttgggcacgtgcacagtgagacaggtacaggagtgtctgttgtcatatattccatgggagtgcaagagccggaaggatgcagatgtgcatgggtggtgctggcccccatcaggtggcatctagtagaagtaagtaagggtggtggtggcatgtgtggtcaccttgccagcgtcgcctcgcacaggaaagggctgttgaaaatttgtgggccgggtgccgtggctctcgcctgtaatcccagttctttgggaggccaaggcgggtggatcacctgaggtcaggagttcaagaccaccctggccaagttggtgaaaccccgtctctactaaaaattaaaaaattgactgggcatggcagtgtgtgcctgtaatcccagctacttgggaggctgaggcaggagaatcgcttgaaccccggaagtggaggttgcagtgagccaagattgcaccactgcactccagccttggcgacagagcgagactccatccccccaaaaaaaaaaaaagaaaagaaagttgtgtgcagcgtgattctgtgagttcaagatgcaaagcaatgactttacattattaaagatctagcagacatagaaggatattttatttatttgtttatttatttttgagacagagtctctctctgttgcccagtttggagtgcagtggcatgatcttggctcactgcaacctctgcctcttgggttcaagtgattctcatgctgcagtctcccgagtagctgggattacaggcgcccatcaccacgcccggctaatttttgtatttttagtagagacggggtttcaccatgttggccaggttggtcttgaattcctgacctcaaatgatccacccaccttggcctcccaaagtgttgggattacaggcatgagccaccgcgcccggcccatagaaggatttttttggggggaaagaatctgtaaagtgattattttggaggtggagaggagaaaatgagactaaagaagatagagtgggggcttctatgattttttttttttttttaaatagatatgacaaaatgataaaatttggtaaagctatgtgttaggtacataggaatttatacttttctgtatgcgtgaaatattacgaaaaaataaagccacatacactatctgtttttgtgtgtgtatgtgtcaataggatttaggccttttttgcacttctaggttaaagttttcaagatgagggtattttttccccctctctgttagagaatactaaagttatgttggttttattttttattttatttatttacttagtttttacaatgtaccattttaatcatttgggtatcctttttaaaatctctgagcttttttattttttattttttttgagacggagtctcgctctgtcacccgggctggagtgcagtggcccgatctcagctcgctgcaacctccgcctcccaggttcaagtgattctcctgcctcagcctcccgagtagctgggattacaggcatgcactgtcatggccagttaatttttgtatttttagtagagacggggtttcaccatgttggccaggatggtcttgatctcctgaccttgtgatcctcccatctaggtctcccaaagtgctaggattacaggcgtgagccaccgcgcctggcctcagcttcttttttttttttttttttttaatttttattttaagttccatagtacatgtgcaggatgtacaggtttgttacataggtaaacgtgtgtaccatggtggtttgctgcacctaggtattaagcccagcatgcattagctatttttcctaatgctatccctccccccaccccatatgttttattttattttttatagagacagggcctcactatgttgcccaggctgatctcaaattcctggcctaaagcgatcctcccacctcagcctcccaaaatgttgggattaccaagtgtgagccaccatgcctggtattatgttggctttaattatatttgtggaagaacttctatgttctctttccttattttaaatattgggagatagatgaaacattttaggtttctctacatttgaagaagaggtatattttcttaggttcttctttttgtgagacagagtgcagtggcacgatcttggctcactgcaacctccacttcccgagttcaagcgattctcctgcctcagcctccggagtagctgggattacaggcgtgcactaccacactcggctaattttttgtatttttagtagagacagggttttgccatattggtcaggttggtctcgaactcctggcctcaggtgatccgcctgcctcagcctcccaaagtgctgggaatacaggcatgagctaccgcgtcctgccaggttctccttttgatagaataatataggtacttgcctctgtttctattcagtatcagtgaattatctacaggaaaatgaacacaggaagactgctgaagtaaagaggcccacagtgcctgcattcccttgcctcatgtagtcttagactattcaggatgctttgaaaagagtaaactgtaaatcatatttcatattctttgggccaggagtctggaatggtttcatattgcctgtgaaacaagagatgcttctcagaatgagatttctggcttaattgaattcggattattgcaggcaggatgggagtgaaatggtacattcctttcatgccagttgtggagaggatctccgtgcaggccgttgatagaataatatcctgtgcttccttggtgtctctctctgaggaaataagggcttaatatgtcctattcaattaatcctcaccgcatccttaaaggtgactggaaggcagatagtattaactccattttacttaaaaagcagcggaaacatggtgatttggaactccctgggagccctcgaacttttctctaaactccaccggtagctgaggagcaggacacacgcacagaggaaggacatatttatggcgcatcgccttggtgccaggcaccgttgggaactttttaggatcgtgatgtctttgaattctcaggacgtttctgcgaggtggtgggcggtatcatcctggtttttcagggagaagtcaagtcactggcccaggtcctcaagctggccagtgtggcccggtctgaccccgaggttctgcccgggtttctgtccctccagcctggcatcgtgaactcaggggaaacagatggggaatctgttgttgtaacaaagattctaaggatttgaagcaaaatcaacacactcagttgtagagggtaccacgtggttgataccattgaagacaattgcacctaaatgaaataatttgatggcgtggagtccagtttcagagcgtttgcatcacaccttctgacaccaggctggggggccgcctgtcccagagcatcgaggacagacaccgctgctgttagacctcattccacccctttagtggggacccaccgcgcgctggccgcaagcctattttaatttgtaacaattctgcttgatgacaggaagacgtcaaaaaggagaaatcaggctaactggggctccttgtccacttggggggcatgtctcagtgtcttgcctggggccttgtacacaccctctcttaccgggagtaaagtgaggtttagaaagattacctttgtcctgggtcattcttccttaaatcacagctaggatgcaaacccagacctctctgatgtcagtttgcaagctctttcaggtaccgtcagccacatgccaggccttcagtggggtgatgttttttgttgtttttagaaaatactgctattcactcatgggaaatagggacgagggcttagatttcagctgctttgcattagacaatgatttctcttattataagcagagctctctattaaccaaaaacacttggctgttagacatggtgtttaattgctgttagaatgtatttttgtcacactgccctataataagccaaagaactgtttgtgccaaacagtgaagggaagctaggggaggatgaaaactgtgcctgctactccacctcccttctttcgaggtcgtggtgttttgtttgctgttttagctgtggtgtgtgtgtaccactcgtacctttcacaggaggacacctcatctgaataccagtcaggacctgagacgcgttgagcccctccccacagtgcccacgggtaggtgcgccgctctctgccccttccgggagctctgctttttctacctttagagatttctttcatcctctattacgtaggcctgactttttgcctaataaaggaaaaacaaccatctatttagcactctttttttttttcccaaaatggaaatgactttctctctgatttttacaaagcaaaaaatgagagtaaagattaagaaactacaagaaattatggtgaagggagtaaagatggccatgaatcctatgactgccgatggtttggtcccaggatgcattattcagatattttctccctgtgggcttatgtaaacagaaagctaggtgagtggaagtaacacgtcaaatactgatttgtggctgggtgcggtggctcacgcctgtaatcccagcactttgggaggccgaagtgggtggatcacctgaggccaggagttcgagactagcctggccaacatggcgaaaccccatctctactaaaaataaaaaattaaccaggtgtggtggcacacgcttgtagtcccagctactctggaggctgaggcaggagagtcgcttgatcctaggaggcggaggttgcagtgagccgagatggtgccactgcgttccagcctgggcgacagattaaaaaaaaaacaaaaaaaaaacctgatttgcaacaattttgtgtcctagcctagagtttaccgtgctattgaaaatatctttcggctgggcgcgctggctcatgcctgtaatcccagcagtttgggaggccaaggcaggcggatcacgagatcaggagatcgagaccatcctggccaacatggtgaaaccctgtctccactaaaatagaaaaaattagccaggcgtggtggcacgcacctgtagtcccagctactcaggaggctgaggcaggggaatcgtttgaacctgggaggtggaggttgcagtgagttgagatcgggccactgtgctctgacctggcaacatagcaaaactccgtctaaaaaaaaaaagaaaaatgaaaaagaaaatatctttcaatgatagttaatatatatatacacacacacactgtatttgaagtgacatgttacatggttttccactatatgatttctcatatttcatcaaattgatcctcttgaactcctgacctcaagtgatctgcctgcctcggcctcccaaagtgctgagattccaggcgtgagccaccgcacccggcctctgatctttttttcatctttttcctagtttctgacctcactaccactctgcaccacgttgggatgggtatccttgtacatccgtgcagcttttctatgatttttaatgtctgattattttcttaggttaaatttctaaaagtagaagtgaacagcgtgtgcacatttttatgactttgggtacatttcattacattactttccagaaaagttggaacaattcatagcagtaactgcactgaatttcttgtattacttac

SEQ ID NO: 1883 - DNA, 36786 bp, Homo sapiens
ttgtagcattggctttcattcccaaatcacatttctccaagagcaatgcaatgtttttatctgtatgtggaacagtgtttgcgccctaggagaggggctccacattacgagtcttggcacattttctatttattttctcgacagagagagagagagagagagagagagagcgagagcaagagagagtgctttattctgaagcataaaccaattctctccagtgagatgtaatagtctgtagacttacaacacaaatgtcttcaggggaaataaataagattgtctgcatttaccacactggaatgtgagtatacatctttggagcaatacttaatctctaacttccaaggcgaattgttatttaattatcctgtaagctcatttgccagtaactttttctcagaaagttctcaacatgtagaaacatgaaaatattcatgtgtcgttgattcttcccaccagggacaaaagaagaaggaaggaagccagtgaggaagattgcatggtgtgggctctggtgatggtgaccaagagacatctaggagtgcaagctgggcttgggtttctggaaagaggatggatcttcagagtttatttcatgttagactgaggagtcctcagagcttgtgtggttttcaagggtgtttttccttctctccaggatgaagatgggaaggagttgtctgatgaggacataagagtgtaggctgacaccttcatgtttgagggagaggatcccagtgaggaccaagatgtctcatcccagggacgtggtgggtggaccctggatggcttcacccttcccatcccccttcccccatcctctctgaggccctcaatccatgggtgctgtccaccctgttgtgctgaagcagcccagagacccaagactgcctggctgcccctcaggctatgacaccaggaccagtggtctctcctgggtccagtacaaccttgcaatgcacccagaatgccaggagcgctgcgggcaggaaaggcaagagtttctgaaggtctgggagcctaaagagattgaatggtgagtgcaggtgctggtggctgttcctgagctccatgactcatgttggcaatgccgatggctctgctccccaggtggggatgggaggaggagttgtttttgtctattctgctactattgcttagtgggagtaggagtagaggatgacaggcaaggcttaatacccagtctggctatcaggggagaagttgcaggctgtttggacagcaaagatctgctctgctgagagaattggtgacaacatgtgaggggagatgatgccacttaacacatgtttagtagatgaacttcccctttactcccttctttttatccctgaaatgtcattttgcatgcataatctgttttcgttattgcaacaaccttgtgaggtgctgctgctgaaacgcccatttacggacgtgaaggagcacagcctggtggtgaggggggcacaatgtgaggctgggtgggtggtctgggtgcacagcccagatccaccagctctatgactgtgggtagtcactcaaatattttccagactggatttctcatttgtaaaatggaaaaacaaaatggttaatatagttaaaagacttaaaacaggctccatgactcatgttggcaatgtcgatggccgccattcctgctctaacctgcttgcccatcccaggcacacaggaggtctgcagtgagctgagcccctctagccactgggggcactttcttctgtgtccctaggaccctgcctgttcatcaacccctggctttgctccctgagcctaagaaggatggaaccaccagcaggtgaggtctgtccttgcagaggtagtggggattttgggggatgcaccctacgcgaatgaagctgtaggaccaggtgcctgaatcccctggctgattgagctggcaggggtggtggggtgggggtggtctaggggctccccagtacccagccagtgtcaggagtactgtcttccccaccctcctgctcagcagttctgctaggagccccctccttcaagcgcccccctcacctgagtccaccccacaggacaattcaggacaggatctagggagggccaggaggggagccctggatctgttgggaggagaatcctgcatgtgggagaaggagccaggtgctgatccaagggcctcaagatatttcccctttggggctatcacactgcctgagattactccattataaatgtccctatattaatatggcattgacactaaagaatgggggtggagcagcatggcagagggaacggatttggacttgagggtctcatagtcttgagttcctatgagctctgcaacttggactagaggcctgccctctctgagcctcagtttgcttttgtgttaaatggacaccttctctcctctggatgccatcactcaggtctcttcaacaatgcccagggttctggcctagggagctgttgggagggtggtgggacagctttgggcactgtgatgcaggtgagcatctgatacaagcaggtgcacgttatatagagcacctggcacatagtaggtgcaccttatgtagagcacctggcacacagtaggtgtactttatgtggcgtacctagcacatagtaggtacactttatgcggcatacctggcacacagtaggtgctctttatgtagcatatctggcacacaataaggcacactttatatagtgtacctggcacacagtatgtgtgctttatgtcaagtatgttgcaccgagtagttttactttatgtaggggacctaacacacgggagaagcattttatgtggaacatctggcacacagtaggtgtgctttatttagagcacctggcacacagcaagcatggtttatataaagggccagggactcaagatacaggatttgtgaagggctcccagcatacagtagacagtatttatgtggagctcctggcacacagtaggtgcactatatgtagaatagccagcacacagtagacaagatttatgtagattacttgatgcagagtaggtgcgctttctgtgggtcaccaggtacgtagtacacatgctcaatgtggagcacctgacacacagtaggtatgctttatatacagcacatggcacagagtaggcacgctttatatgaagtactctgcataaagtaagcttacattatgtacagcatgctgcacacagtaggtgagctttatgtggcatacctggcacatagtagacagaatttatgtacagtatctgatacacagtaagtgcactttatatagtgaaactggcacacagtaggtgcacacagtagtgctttccgtacagtctttcgcatggagtagagacaggcacacagcagctcaagtgctagttgtcatccccttcccttcagtccctctttttggagctcccttttcttaggagccttcctccgtcgccctctaaggcctcatctgacatcccatttcccagatgggaagcctgagcccaggatggccacactgcccacagtcagagaaaggacagggcagaacaaggactccactcgggatccccttgctctgccctcccctgcctggaccccgtcagctcaaggcccctctcagcctcatcccctgtgcctccgctctgtcctcctaagctgagcccagcttctaggtttgctcctccagctgggctctttatccccagaatctgacgaaggtaatcctcagcggggttggggctggattctttcttcctgcttcaagcagtcaggcctcaactcaggccctgggctgccaggaggcaggacttgaactcttgccaggctgtgaagccagagatgagaggcttctgtctctgaatctcctaagtctgcaccaagatgtagtgcctgacatcctccccgcccatgtttggagaggagcccagatgatctgggacaagggttggcctggcccagctcagctggctgccaactgtcatgataagtatatgcttttatctgaacacccttgtcttggaagggcagggtggaggtaaacttggggttcagagtcccctctaaccaccctccaacttcccctgcaaactcccaagaaggtactgagacctgagaattcagtgctcgtgctggggcaccctgagctgcacccagtgggcccaaccccaggttttggctggctgcccaggcacggaagacacacccaggctgtggggattggctgcctcagcccagcccagcccagccccgcctcctacggccttccctagatcaggggccagggccaaagacctcccagcagaagaggagaagaggttgtgtgggacaagctgctcccgacagaaggtaccaggctgggggtggcagggctggaaggtcctggcctgggatgaagaggggactgcctaaggctggggtggctccaagatgctggcatgggaaactgggggtttcctggtaactggactcctagcaaactcccaaggattcaggtggggcccttctggactctaatcggcccatctctttccctttctgtgtggttaccaggttactggaggccacttagttgttggttttggttgggactttctggacttcagatctcagccctcgtttactcacccctgagccctccctgccctgcccccagcagttcctgacttcgcccctatacactgtccccggagctcttccctgggcctcaggtcctcaccctgcatcccctctgccctgcaggatgtcgctgctgagcctgccctggctgggcctcagaccggtggcaacgtccccatggctactcctgctgctggttgtgggctcctggctactcgcccgcatcctggcttggacctatgccttctataacaactgccgccggctccagtgtttcccacagcccccaaaacggaactggttttggggtcacctgggcctggtgagtgtgacagcaaaatgtgtctggggtctcagggtggatggacttccagaggagcaggaatggggctcagtgagctaggtattgatggtggctggggtctgcgaccccagagaagcaagagagatggctcactcattcctctgctaactcactcattcctctacccactcactcctctacccactcactcactcctctacccactcactcactcctctacccactcactcattcctctacccactcactcattcctctacccactcactcctctacccactcactcactcctctacccactcactcactcctctcctcactcactcattcctctcctcactcactcattcctctacccactcactcactcctttcctcactcactcactcctctcctcactcactcattcctctcctcactcactcattcctctcctcactcactcattcctctacccactcactcactcctctacccactcactcaatcctctacccactcactcactcctctacccactcacacattgccctcctcactcactcattcctctcctcactcactcattcccctcctcactcattcctctcctcactcactcattcctctacccactcactcattcctctcctcactcactcattcctctacccactcactcattcctctcctcactcactcattcctctcctcactcgcgcattcctctcattcgcgcattcctctcattcactcattcctctcctcactcactcattcctctcctcactcttattcgtctgctcactcactcattcctctgctcactcattcctctcctcattcactccttcccctcatcactcactcattcctctgcccactcactcattcctctacccattcacttattcctctatccactcactttttgctctccccactcactcattcctctcctcactcactcattcctctcctcattcactgattcctctacccaccgactcattcctttcctcattcattcattcctctgcagttccatgccaaacctttctcacctccctgtcctcccacctcagcctgcttggatccttttcctgcctgtcttccctaccgtagtgcccctcccagaggctcctgtatggttgtggggtgcacagagcagggctctcctggcattcccaccttctccactgctggacttgaagccttctgagccccgatagacaggctgctccctgcatggcccatttgcttgtatctgcccatctctgggctgctgctttcccgcaggaattatctctgacttccttccccacggagggacacagctggaccagaagagaagtgcaggcagtctcccacaccctctccttccagggacaatgtgctcttccccagtaagatgtcccagtgagccctgtagcccaacctggatataatttggccactcccttcccctttcagaagccgtccttggtactcccaaacctttccctccgactgggaccggccctcccctttgggggatgtggcctctgtctgctcacttacaaaaggcaggattgatcggtgtgtccacaggtgcacaggaggcactagcacagaacctggcataagtgaggctctcctaggtgggagctgccatcctgatggacattagagtcacctctgctcccctggaggctgctgagaatggagggccctcaggacgcaggccctttgtctgtgggaggaaccagtgcccatgtggaccaaccaggacacaaaaggatatggcaaccagctctagggatatgtcctgaggccacactgctgcccacaaacctccttccatggggaccttcccatatagcaatccccagattgaaatcaatccaggatgagaaaacacatcctcttgagcagacagcttgtcttctctctctgctttggtatttacccttggatcttggggacagctccaagagagaaggagcagaagtcagcagaaacccactgcagctgctgagaatccagacacgctgctcactgcagaggctgcaccacatccggtggctgtggggggacttgctgtggcttcatctagggaggtgcattagtcagggttctccctagaaacggaatctccttagaaacagatagggtgtttcttcttatctctaatgcatgtatgtatggagacagaaagagatagagagataagaatttattatgggaattggataatgtgatgatggaggccaagaagtcccatgatatatcatctgcaagccagaaaccagggacactggtggtgtaaattcagcctgagtccagaaaggcctgagtccctggagttctgagggcaggagaagacggatatcccagcagcagaagagagagcaagttcttcctttcctctgccttttgtcctgttcatgccctcaatggattggatggggtctggcgtctcagggtgggtggacttccagaggggtgggacttccagtaggggttcagggagctgtgtattgatggtggctggggtctgggaacccagagaaccaagggagacggctcactcattcctctcctcacttactcattcctgtgcccattcactcattcctctcctcactcactcattctaataccaactcactcattcctctcctcactcactcattcctctcctcactcactcattcctgtgcccattcactcattcctctcctcactcactcattcctctcctcattcagtcattcctgtcctcactcactcattccttttctcactcattcattcctctcctcacccactcattcctctgcccactcactcattcatatcctcactcactcattcctctacccacactcattcctctcctcactaattccaataccaactcactcattcctctcctcacttactcattcctctatccattcactcattcctctcctcactcactcattcctctgctcacttagtcattcctctcctcactcaactcattcctcactcactcattcctctcctcactcactcattcccctcctcactcactcatttctctcctcactcattcattcctttacccactcactcattcctctacccactcactcattcctctcctcactcattcccttcctcccattcctttacccactcactcattcctctcctcactcactcattcctctcctcacttactcattcctctccccactcactcattcctctcctcactcactcattcctgtgcccattcactcattcctctcctcactcactcattccaataccaactcactcattcctctcctcactcactcattcctcccctcattcagtcattcctgtcctcactcactcattcctctcctcactcactcattcctctgctcactcactcattcatatcctcactcactcattcctctacccacactcattcctctcctcactaattccaataccaactcactcattcctctcctcacttactcattcctctacccattcactcattcctctcctcactcactcattcctctgctcacttagtcattcctctcctcactcaactcattcctctgctcacttagtcattcctctcctcactcaactcattcctcactcactcattcctgtcctcactcactcattcctctgctcactctctcattcccctcctcactcactcatttctctcctcactcattcattcctttacccactcactcattcctctacccactcactcattcctctcctcactcattcccctcctcccattcctttacccactcactcattcctctcctcactcgctcattcctctcctcactcactcgttcctctcctcactcgctcattcctctcctcactcactcgttcctctcctcactcactcattcctctcctcacttactcattcctctcctcactcactcattcctctcctcactcactcattcctctcctccctcacttattcctctacccacacactcattcctctcctcactcactcattcctctacccatgcactcattcttctcctcactcattccttcctctcctcactcactcattcttctgctcgctcactcactcattcctctgctcactcttattcttctcctcactcattcctctcctcactcactcattcctctcctcactcactcattcctctacccatgcactcattcctctccttactcactcattcctctcctcactcactcattcctctcctcactcactcattcctctcctcactcactcattcctctcctcactcactccttcctctccacactcactcattcctctcctcactcactcattcctttcctcactcactcattcctctgcactactatttccatcctgtttaccttcaaatgctaatctcttctcaaacaccctcacagacacacacagcaataatgtttgactggctatctgggcatcccttagcccagtctagtggacacctaaaattaaccatcacaggaagtgacagcccttgacttgctttcagatcactcctacagaggagggcttgaagaactcgacccagatgtcggccacctattcccagggctttacgatatggctgggtcccatcatccccttcatcgttttatgccaccctgacaccatccggtctatcaccaatgcctcaggtacccatgcagagcttgtggtggtgggtgccagaccaagcttctgtgtggtctctgcagtacccacgtccctccttgagtactcgtgcccctcattgagacttccttctcaatgtcttctccctccattgccatctgctccctgtcttggtgttctgggcaccactggggctccaagaggcctcaattcagggccctttctggaaggaacccccatgcttaaggacacgggtctagacagagacatttccagcctcatagggtcaggaatgggcaagagagagatgggtatgacaacacagagaactgggtgtctgctggggcaggctggaatgtttcctggaggaagagttgttggagctatgtctagaccaataagtaggattttttaagtgtggggcaggatgatgcagtgggcatcattggtatttggggtcccagccagtccttgcaccagccttgcccatccctcagtccaaagcggtaggaggatttgtggctggtggagaatctgggctgctatttatgtgacatccacctatgatgggtcagttccttctacctcatcctatcactcatccaccctaagtttcctgctctcctcctatgggcttcaggattctccaataggagaacccacaccagctgcttgacctccccttgctctctgctcttctcatccttggacacaccaggctgagctagggaagtggcagcatcccacaaaatctatggctctgacccccaaatccttagtgactctgtgcaggtcaccagctctctggctgctgaggtctctttcagttgtgagtgatggaaactcaacttcgtgtgctctaagcaaataaagagagtcaaaggagtgtaaatttcagggagggtggtcttcaggcatggctgaatccaggtgtcaatgaacattatcagggatctgtctccttttcttaatttcaccatttctctgcatcactttttcttttaaggcagccgttctcttatctgtcaaccatgggtcctagcagctcagttcttgtccgaaagctcaccttacccccaggggtcccataaatagccgcctatagtttcaatattatacctggttatatcttttctgtttaacctgggatcatatggagaagtcatcatgtgtgtggctcagctgtggtcgaggacacttggggcatgtcagagactttctggttcttctctgacatgtgatttgaaattgtcttttctcctccttgtcatctcttggccatgtttgtagcttgtccaaggtctgggagctagggtctctttggaattgtcagagttattattttagtctccctgagccaggtttcggaatccattctaatcacgcttgaagaaaactcttggttccacctgggacatgtctgggacatttaagaaatcacatttaaaccctatctggggcctgtctgtggggtacacagaggtcatgtcagactatctcaggtccatgtcaggagatgacagagagtgctatggcagacagggtgtccgaggtcctttaaaggtattttgtagagtgtggagctgtgttcagttgttgcagaacatgttgggatatataggagccatgtcaaggcgtgctggggtgtgctatgacctgttaggttgtgtcatagctttactgtgctgttgcagcctgggctggtccttcttcctctatcctcccttcgtcctttgcccttggcccccttcctgctatgctgggcatggagtggggaaagtgctggtaggcagccttgccctatacctgaagttcctctcttgccctctacatggcccctgatggtcctcgttcatgtcagctgccattgcacccaaggataatctcttcatcaggttcctgaagccctggctgggtgagtacctgcaggtgaaaggggttggggacaaccttgcggggagggtaggggaagtgctgctcttgcccactgtccttggctgccctactaggagaagggatactgctgagtggcggtgacaagtggagccgccaccgtcggatgctgacgcccgccttccatttcaacatcctgaagtcctatataacgatcttcaacaagagtgcaaacatcatgcttgtgagtcccttgaagtctgggtcccagatggagtcttggggtggagggaccatggacacatctggtctggaattttggctcttctgggtggcactgggccattgctcttcctctctgagccttggtttcctcatctgtaaaatggggatgataatccctacttgaaaggtcatttacttggcacacagtaggttctcagaaggtgtcagtttctgtgtttttctcacagaatccctgtaaactcaagagagtaaaaatgaagattgtgtagtagtcattgctgattataaaccacttcagaactcattggcttagagccataagggtttacaattgctaacgagtctgtgagacagctggccagttcttctggatgtggaagggatcactcttggcacatgagcagctgtgggtcggggggcagctttgctgatcctggctcagttcattcacgtttggggcttcagtaccttcagactcatctgggatgggctcagctgtgacacctggactttcccccatgtgattctctgcctccagaaggcaccctgttgttcacatggcagagactgggctccgagaaactgagaggaggctgcaatgtctgtggacattgtctctgcaatacttcaaagttcaaccaggtttgagtctattagagttattacatcatcatttcaccacattgtactggccaaagaaagtcgaaagtcaaaagtccagtacagactcaaaggggtgtaaaatagaacgcatctcttaatgggagttgctgaaaaattactgtggaaagggtacgaatacagggagaagtgaagaattgggggtcaggattttgtgaagtgtctaggatttgttttaaatatgcaaactgataagttagcttgttactgtctcatgcattctaacagattcctgggtcagagacaaagggtagttgattactcatggcacaataagcaacatgtacttcttgttggtttgtatcctttttctgagtcaacctaaattccatgggggtgacactggtgggcctctacattagcctgctcatgcagtacattgcatgacatacaatgggcattaggcttagggaatctactttaatagtggcagaaacaagcctgatattggtccaggaggagtcattgccttatctctccaggtggttatctgcaaatacaactctgagaaatggctcaggtaagaacatcacagtcttgcattggtggcatacgcagcaaggatgctcagggctgatgaagaagtgcctcttccaacacagggatatttttgaaatgaatttattacaatggagatgaataaagcaaacatttactcatcatatgcctgagaaaatgtcatgtcccaatgccaggatataagttgtctaagttaattttaataatcctgtgaggttatggttatttttgtcctattgcagatgatgaactgagggccagagagattagggagctggacagagttcaaccagccaggaagtgagctaggactggtggagcagagattctatcctggtttatctggccccaaagcagatcaccttgaccgttattgaatatttgacaggtgggacctagaggagggcaatatgttgaccaagggcacatagagcataggagacagagctgagacttgaatgcaggtctcttgactccaagccatgggtcttcatctcctatactaacagtttctgctcgcatcccagtctggtcctcgctggcaatgggttcctggggcagaggaccaggaggctggttgtgggggagtccatcctgatgtttgggactggggaggggcacaaaggaggcagggcccagctctagctctcttcccttctctggccaggacaagtggcagcacctggcctcagagggcagcagttgtctggacatgtttgagcacatcagcctcatgaccttggacagtctacagaaatgcatcttcagctttgacagccattgtcaggagtgagttccttcctagggcctgggatatgaatccatggaccaaagggagaaagttggggagggaggaatgagcaaagtaaccagaagtacctttcgggaggatttgtatcatagctgtgctttgaaggtcgaggaagaggagaaagtgctgtctttccaggtagaaatatgtgtgtaaaagcaagaaggttaggatgagccaagcatgtgcaagagacagtagaaatgaggttgtggaagtaggggctagatattaagggcactgaaaatcaggaaaagtggtatgaagtttatcaagacatttccagagaccttttgtagtttcagctgatgatggatgtgataagagctgagctgtgtgggaaactgatagcccaccaccacgcccagctaatttctgtattttcagtagagagggggttcaccatgttgtccaggctggtctcaaattcctgacctcaggtgatgtgccctctttggcctcagaaaatgttgggattacaggcatgagccactgtgcccagctgcttcttctttcttacagggtgaaagagagagggagagagagagagacagagagacagagagagagagagagaaagagagagagagttggttatgctgggggctggagcagggctgaactggaagaggatgaagtctgagttgtgtggacagttttggtaaggaaaatgatcagtactgcatactggatgggagacagaggagagaagcatggtgtccaagctatactctaggtgcctaggtgcatggagacagctctctcagagataggatgcagggagagaagacagtctagagagtcagtctcatgactgatacccaccatgtatctctaggaccatctatttctagatactcagtttcctgatgggaggtagctcctggctgctggtgggaggtgttcctggggctttgcatacgttacattgttgcctccctttctgcccttgctctgcaggaggcccagtgaatatattgccaccatcttggagctcagtgcccttgtagagaaaagaagccagcatatcctccagcacatggactttctgtattacctctcccatgacgggcggcgcttccacagggcctgccgcctggtgcatgacttcacagacgctgtcatccgggagcggcgtcgcaccctccccactcagggtattgatgattttttcaaagacaaagccaagtccaagactttggatttcattgatgtgcttctgctgagcaaggtaggtttctctatgatctgaatttaggtgagagaatagagcttcatgtcaaatgtcaggtgaaataaattggttttgatccaaagggcactgggagccatggaagatgcttgagaaagggaaggtcacagataggttttagagatgactttattgcatgcagcccacagggcactgctaattctgaaactgtgaggagcatgatattttattcaacttataagttagtgtgttagtctttcacatttttatgtgtatctatatgtctatgtctttgtctatgtctgtatctatgataaaagatgcaccaaacccctggatcacagcagcccattaattatttacagcagtaacagcaggtggagtaggatggtagtgctggctccccattcctagggcaacacaatgtttttacctgtaaatgcacaagaatttgcaccaaggagaggggcccccacattatgagtattatagcttatataggacagctagctcatatgctccttctttattacagggtgaaagttagagacagagaaagagagagagagagaatgctttgttctggcgtataaactacccctctcctgtgagatggcaatttctagagttttataacccaaatatcttctggaaagataagattctctgggtttaccactctagaatgtcagcaaatatttttggagcaatacataatttctaacctccaaggcaaattgccattcaaatatcctgtaccccaggttgccagtatctttttctctgaaagtctgtattatgcagaaaaatgaaaatattcgagaaccattgattcctgtcaccagggtccaaagaggaggcaaaggatctgggggaagcccttggagttggggctttggtgatggtgaacaagagagatctagacgtgcagagtgcatttgagtttctggaagatcagagcttcagagattatctcaggttagactccggagtctcagagatagtataatttgtgtgtgtgtgtgtgtgtgtgtgtgtgtgtgtgtgtgtgtgtcttgctttctcttcaggatgaagatgggaaggcattgtcagatgaggatataagagcagaggctgacaccttcatgtttggaggtgagggtcccagtgtgggactacagtggagacagaggtccctccatctcaggatccgggtgggtggaccctggatcactccattctgcccatcttccccctccctccatcctcctgagggcctcaatatctgggcgctgtccaccctccggtgctgaagccaagcttacctggctgctcctcaggccatgacaccacggccagtggcctctcctgggtcctgtacaaccttgcgaggcacccagaataccaggagcgctgccgacaggaggtgcaagagcttctgaaggaccgcgatcctaaagagattgaatggtgagtgcaagttcttctggcctgttcctgagcccatcattggttctgctccccaagtgaggaggggtggaggagttgttttgtggattcttccactattgcttagtgggtataaaagcagaggaccacaggcagggcttgataccaagcctggctgtcaggggaaaagttgcaggcctttaggaccgaaagacccgggctgctaagagaattggtgacaatgtgtgaggacagataatgctactttgcacatgttcagcaaatgaacttcccctccactctgtttctgttctcccagaaatatcagttttttcgaaaatcctcacttcttgaatgtttgctcaggtggggagggagaagttgtttttgtcaattcttccattattgcttagtagtactaggagcagagcacagaggcagaacttggtatccaacctggctagcaggggaaagttttcagacttttgggacagagagtcctagcccgctgagagaactaaggacaatatatgaaggcagacgatgacatctagacatgttcagtcaatgaattttcccttcactcctttcttgtttactctgaattatcatatttttttcaaacatctttacttcctgaatgtttactcttctgttccctaattcctaccctccggtccagtccagggagtcctaagggagacctgggggtaaaagtcatctatcttttgtctagaacacctgcatcgttcatccattcagtcttcattcagcaaactcttccacatgcctttccattgccagttctgttcccacacctttctgtgctctggagacctggaaagaaccctgcctatggatgtgttttccaggtactcccagcctagtaggaacagtcccccacaagacattcccagtccacataggcaaggatggagttgagagcaagagaagcatggctgggagtacagaaagtgtgatagaaagtgtttcaagccagatctggtggctgtcgcttgtgataccaagtaccgaggaggctgaagtgggataatcacttgaggtcaggtttaagatcaacctgggcaatatagaaagaacccatttctaaaaaagtaaaaaaccaaaataataaagtgcctcaactgaaaccctgaatggtgatcagtaggtgtttggatgcagtagtgccctaggtcaaaaagaaagtctgggcaaaaatgcaaaaagagggagcaggagagagggagaagagggaaagagaggtttgtgtgtcagggaaggagatggttataaagggagggagaagtaagagggaggaaaagtgagggagagcaagataaagagaggagggaagacagaaggagacagagagagaatgagagagaaaggaactgagttgtgatgagataataactatggtagtgaaagcagagtctggctgtggaaaatatgggaaaatggtaatggcttccattttaacccaaaggcaatgggaagccataacaagtggttgagcaggggaggggcaggtcatatctgggcaccagaaagatcttttcagagctactgtggagagaggaccagctgtagaatgaagtcccagtgaagacattctgggacctgagccagggcaggggctggggatggagaggaggcaatggactggacatgtgttttggaggccgtgtcctcccgtccaagcctttgctcagcacagcagtcctaaaaggtggcaacactttttatgcttttaaaaaccaagatatcaagtaatactgtgcactttgtaaacaaaaaaaagtgtctaaaacatttataaaaatgagctttcctcatgcctgtaatcccagcactttggaaggccgaggcgggcggatcacgaggtcaggagatcgagaccatcctggctaacacggtgaaaccccgtctctactaaaagtataaaaaattagccgggcgtgatggcaggtgcctgtagtcccagctactctggaggctgaggcaggagaatggcgtgaacccgggtggcggagcttgcagtgagctgagatggcaccattgcactccagcctgggcaacagagtgagactctttctcaaaaaaaaaaaaaaaagagcttccttcttaactgtcaccctagtagtttctaccatcaatggttttgtgtgtccctccagaagatggctatcttgatgcccactttataagaacacagacttcttctatacaaataagagtgtataaaatagacacagtactttttcccaagatggtgggttggaggcaatgtcagtgtgcctctcccatgtggaaggacagaatagtgtgtagagattcacagtgtaagctttcttttcccaagaaacaacacagggacttaacaggaaaaccagaagaatccacaaacccttcaaaagaagctacaggctgcattctactctgtgagacaggtgaaaaactgtgaatcctcagagtaagagggggagagactgcttcctaggtacacatcttcactggggaatctgaaaatccagaccacaggagaaggccttaactctatccagggcttgaactgatttagggagtggtaagaaatataaaagtagaagcagcagcaggaagtcccttgcaggcattcacaatctccagcatggactgagggaagccattccttattgtatctcacaggggaccttggggaagtcagacaactagctcaggtgaggtcacaggttgaacgaaatgcccaaatgaatttcttgatataacctcgagtggggatgaactcccttgaccagaacccgggaggcaagcaggaagtgtgctgcagacaggagttcagaagctgggtgcctggccttggacagggacaaaaaaggacatggcctgaaagcattgctatttctgtgggaaaagcttatggcctggggcagggctgagttctgtgcacagactgcctggatctaaatccagtgctatgagtggaacactgcatgtgtgagacccaccttgtgccaactgcatgggagctagatgaggcttactgccacctgctactctccactcccttgtcaaactcttctgtgaggcagaggcagttatactcacctctggatcattaccccagtgacctaagaaccaccctctgactctcacagggcaaaacaaacaaacaaaaaaacagttgcaaaaaaaaaaaaatacctaggaatatacttaaccaaggaggttaaagctctctacaaggagaactacaaaacagtgctggacaaaaccatagatgacacaaaccaatgaaaacacatcccatgttcatggattggaagaatcaatattgtgaaaatgatcatagtgcaaagcaatctacagatttaacgcaatgcctatgaaaataccttcatcatttttcacacaactgggaaaagcaattctaaaattcatatggaaccaaaacagagcctgtgtagtcaaagcaataccaagcaaaaagaaaaaatttggaggcatcacattaccggacttcaaattacattacaaggctacaattaccaaaacagcatggtactggtataaaagtaggcatttagatgaatggaacagaaaggaggacccagaaataaagccaaatacttacagccaactgatctttgacaaagcatacaaaaacataaattggggaaagacaccctattcaataaatggtgctgggaaaactggacagtcacatgtagaaaaatgaaactgcatccccatctctcaccttgtacaaaaatcaaaggcttaaatctaagacagaaaccataacaattttataagataaccttggaaaaactcttttggacattggcctaggcaaagaattcgtgaccaagaccacaaaagcaaatgcaacaaaaccaaaaataaatcagtggaacttaattaaactaaaaagcttctgcacaacaaaataataataataataatagccgacttaacagacaacctacagagtgggggaaaatatttgcaaactatgcatctgacaaagggctagtatccagaatctacaaggaactcaaacaactcagcaaggaaaaaaaacaaacaaacaattagttccatcaaaaagtgggcaaagggcatgaacagataattctcaaaagaagatacacaaacagccacgaaacatatgaaaaaatgctcaacatcactaatcatcagggatatgcaaattaaaaccacaatgagataccatcttgtttctacaagaatggccataattaaaaagtcaaaaaacaatagatgtatgttgtggatgtattgaaaagtgaatgctcatacactgctatgaaaattaacataacctctgtggaaaacgataaggatattccttagcgaactaaaagtaaatctaccattccatccagcaatctcactactaggtatccacccaaaggaaaagtgattatatgaaaaagacacatgcacatgcatgcttatagtagcacaattcacaattgtaaaggtacggaaccaacctaactgcccattgaccaatgagtggataaagaaaatgtggcatatatacacaatggaatactactcagtcataaaaaggaatgaaataatgtcttttgccgcaacttggatggagctggaggccattattctaagtgaagtaactcaagaatagaaaaccaaataccatatattttcacctataagtgggagctaagctgtgaggacacaaatacatacagagtgatataatgagctttggagactcggagagcaaggttgggagccgggtaagggagaaaagactgcatattggggacagtatacactgcatgggtgatgggtgcactaaaacctcagaattcaccactatagaaatcatccatgtaaccaaaccacttatatcccaaatgctattgaaataaaaggaagtaaagaagagacagatctgcacattaacaatatatctttgggagcttttctttttctaaaaatatgagttttggaaaattagttcgtttttatttttaattggcaaattttaattatatatgtttatggggtgcaatgtgatattatgatatatgtatacaacgtggaatgattaagtcaatttaataaacatacccgtcatctcatatactcatcatttttgtggtgagaatatttgaaatttgctctcttagcaattttgagaaatttattattattaactgtagtcaccatgcatgcaatagatctcaaaacttattccttctaacggaaacttgtaccctttgaccaatgtctttccattctttcttcctcccttctctggtaaccaccattctcttcttggtttctatgatttctgtgttaattatttcagatctcacagttaattaaggttatgtgctgtttgtctctttgtgcctggctcatttcacttagcataatgtcctttaggttcttgcagattgccacaaatgaaagaattttcttctgttttaaggctgactagcattccattttgtatatatacaccacacggaaaatgagttttgaattacaaaagcaatgatgagaacagtttcttcttgcactcaatgaggcatcacagatagacaagggttattcttgacattcctgctatcccacctaatatcctccctttctccaagggggcctgtagagatacttatttgtcatctatctgtctgtctgtttacatctatctacatatctttctatcatcgatctcttcttatattccttatattttttgtcctatggtatttacatatatggacatttgggaacatgtttttttccactcaatactgtgtctgacagatattttttctgagtgctgaatagcattccatgttttatttggcccatccctttgttgaagacacttgcgtaaacatttccaatcattggaggtatggccaatttgcattccagagtctctgtactgatttagcttctggtctgcattgtgtgacaggactagtgatcctttttttctccttttgtgtagctgtatactattccattgtgtggatgtttatctaaacatctccccatccatgtatatttggcttgtttcatccttttgctaaattaaacttgtgcaatcggcatgtgtgtacagtgagcattgctcatatgtataaacatcactgcaggacaaattcccaaaagtgcaattgttgaaccaaagaccatttgcattctacagttgtaataatgattgcaaatccatctctatattaggtgagtttgatggcactagctttcccacaaatttgccaatagtattattgtattattaaatttaaattttttgtccatcttcatatttcatcttttaatgagcattttcttaaataagagtgagaaagaacatcctttgcccaagttgataagccatttattttctttctatgggagtggtcatctgatattttctgctgtttttctttgggttcttttttcttatttacttataagaatgtgtatcacaattaatgttttttttttctgtttttttgttgcaaaagattgccttttgacttttttggggggtgcttttggttaatttttatgaagttacatttgttcgtattttcttttgtaccacactacccagctatttcccagagttttgtggggcttcctttggcagatgggaagtttccacttattcacatgcccgtctctgacctttttagtcttttgaatgcatccgtttttatggcattgccagactattttttcttactgtgacttttcttttcttttttctttttttgagatggagtctagctttgtcgcccaggctggagtgcagtggtgcgatctcagcttactgaaacctcctgcctctctggttcaagctattctcctgcctcagcctcccgagtaactgggactacaggcaccctccaccacgcctggctaattcttgttttaggtagagatgaggtttcaccacattggtcaggctggtctcaaactcttgacctcaagtgatccacccacctcggcctcccaatactctgactttctaatgggttttaatatctggcagagtggctttttttgttgttaaatcaacccctgcaaacatttattgtgtgataaagtgtatgttttatttggattgagggaaatttataatgaaatacagagatttcatgtttctttttaagtttaatccaggtattttatattattatgactagtatcttttcttttattatcttttcatttgatggttatttctatatggtaaaactaatgatttatgcatataaattctatgcccagtgaacatagtatatgctaaagatggtatctgtatcaagagaaaaaatatagataattaagtaaaagctcttggggcaactggaaagccttctggaaaaaaggcaactgaaccttgttctcatatcttatgacaagataatgttcagattaatcatttttttctaaaagagtcctaaaagctctagaaggaaccatgagaaaattatttcatagcgccagagtagggataaccttattttgacgtaagtcccaggggctatgaaaaagtgataaactgttaaatgagagaaaagatacacgccagccacggtggttcatgactgtaatcccagtactttgtgaggccaaggtgggcagatcacttgagatcaggagttcaagaccagccttgccaaattggggaaactccatctctactaaaaataaaaaaaaaaattagctggctgttgtggtgaatgcctgtagtcccagctacttgggaggctgaggcagtagaatcacttgaaccagggaggtggaggttgcagtgagacaagattgtgtcactgcactccagcctgagcaacagagactccattccctccccccatcaaaaaagatacagaatagtgtctacagtagatggtgtgctcctatataattttttaagatgcttaaaatcagcccagaaagcatacattaaaaaaaataataacctggcaacgtgtggggagaagtaaatggcattgggccataggagtgaattatgttttatagttttcaaattctgaaccagataattgtagacggtatgaaaattttaaatagccactgcaaaagaagaaagattaagcagagaattcagctcctttgcttgatcttaaatgtttataaacgttttccagtggggcctctagtgttttctaagtataaaatcactatctgccaaaatgatacatttactaccacatttcaaattgcctgactctcgtgtttttttggctgcataaatgtcttcttttgagaagtgtctgttcatgtccttcgcccactttttgatggagttgtttttttcttgtaaatttgtttgacttcattgtagattctggatattagccctctgtcagatgagtaggttgcgaaaattttctcccattttgtacgttgcctgttcactctgatggtagtttcttttgctgtgcagaagctctttagtttaattagatcccatttgtcaattttggcttttgttgccattgcttttggtgttttagacatgaagtccttgcccatgtctatgtcttgaatggtaatgcctcggttttcttctagggtttttatggttttaggtctaacgtttaagtctttattccatcttgaattaatttttgtataaggtgtaaggaagggatctagtttcagctttctacatatggctagccagttttcccagcaccatttattaaacagggaatcctttccccattgcttgtttttctcaggtttgtcaaagatcagatagttgtagacatgtggcattaactctgagggctctgttctgttccattgatctagatctctgttttggtaccagtaccatgctgttttggttactgtagccttgtagtatagtttgaagtcaagtagcatgatgcctccagctttgttcttttggcttaggattgacttggcgatgcgggctcctttttggtgccatatgaactttaaagtagttttttccaattctgtgaagaaagtcattggtagcttgatggggatggcattgaatctataaattatcttgggcagtatggccattttcatgatattgattcttcctacccatgagcatggaatgttcttccctttctttgcaccctcttttatttcattgagcagtggtttgtagttctccttgaagaggtccttcacgtcccttgtaagttggattcctaggtattttcttctctttgaagcagttgtgaatgggagttcactcatgatttggctctctgtttgtctgttattggtgtataagaatgcttgtgatttttgtccattgattttgtatcctgagactttgctgaagttgcttatcagcttaaggagattttgggctgagacaatggggttttctagatatacaatcatgtcatctgcaaacagggacaatttgacgtcttcttttcctaattgaataacctttatttccttctcctgcctaattgccctggccagaacttccaacactttatgcagccaaaaaacacatgaaaaaatgctcaccatcactggccatcaaagaaatgcaaatcaaaaccacaatgagataccatctcacaccagttagaatggcaatcattaaaaagtcaggaaacaacaggtgctggacaggatgtggagaaataggaacacttttacactgttggtgggactgtaaactagttcaaccatggtggaagtcagtgtggcgattcctcagggatctagaactagaaataccatttgacccagccatcccattactgggtatatacccaaaggactataaatcatgcggctataaagacacatgcacatgtatgtttattgcggcactattcacaacagcaaagacttggaaccaacccaaatgtccaacaatgatagactggattaagaaaatgtggcacatatacaccatggaatactatgcagccataaaaaatgatgagttcatgtcccttgtagggacatggatgaaattggaaatcatcattctcagtaaactatcgcaaagacaaaaaaaccaaacaccgcatgttctcactcataggtgggaattgaacaatgagaacacatggacacaggaaggggaacatcacactctggggactgttgtggggtggggggagggggaagggatagcattaggagatataactaatgctaaatgatgagttaatgggtgcagcacaccagcatggcacatgtatacatatgtaactaacctgcacattgtgcacatgtaccctaaaagtataataataataaaaaaaaaaaaacaaattgcatgactctccttttttcccttgcctaattgcacttgctggtatctctagcatcacgctaaataagagcaaaacattggatctgggtattttgtttgttattcatttgcatttgagtttgctttcttgccatagacaatatttatttttatgtgagtttgttaattttttaccgctggcttctgggtgttttcctcagagtatttatttttatctatttggctaaattttctctggtacttttctaattctctgcttctctaattgttttctgctttttaaaattctcaaatgtttgatccccgtggagtttattttgtgatagggagaaaaggtctcatttgcaaatagaaaaggtggagagttgtgtatttgttcccttgataatgactggggctggggtgtttccttagggacgacctggcccagctgcccttcctgaccatgtgcgtgaaggagagcctgaggttacatcccccagctcccttcatctcccgatgctgcacccaggacattgttctcccagatggccgagtcatccccaaaggtgcccacagcctcagggggagaagcctcccgggtaggaagatggttccctcaggggatccttgtcctgactgcccctttctctcccacaggcattacctgcctcatcgatattataggggtccatcacaacccaactgtgtggccggatcctgaggtgctgccttccccattcaccaccaccacccccatcctctacttttgtgtgtgtgtgtgtgaattccaaggttcctagtggagggggcagggttttgatgaggaaaatccaacatcacctcaccccaaaacacacacaagtgtctctccaaggctgctggacataggaaatcccactggcaaaccttctttgtctcacctgcaggtctacgaccccttccgctttgacccagagaacagcaaggggaggtcacctctggcttttattcctttctccgcagggcccaggtaagagcgccctgtgtctgaggcagggatgggatgatgggtgcgggagttaaaaaaagggggacgttgcagatggtcccagttccagctctccttccctccattccttcacagtttatgggaaaacgtccatagaatggggatgagtaggtcctagaggggtccgcggagtgctcaaaatccccttctccatctgctggtctgagctgggagctggagtcaggcccagtctccgggacatacaagcccacatgggagtcccaggcacgcttagtctttctctctctctctcaggctgagctgggtgcagttgggggtcccaggccaggttcctgggttgatgggacccaaatgcgggtcttgggcacagtcacagtccccactcccgcctgcaggaactgcatcgggcaggcgttcgccatggcggagatgaaagtggtcctggcgttgatgctgctgcacttccggttcctgccagaccacactgagccccgcaggaagctggaattgatcatgcgcgccgagggcgggctttggctgcgggtggagcccctgaatgtaagcttgcagtgactttctgacccatccacctgtttttttgcagattgtcatgaataaaacggtgctgtcacctctgcctgggcctcactgacagcctgcagggggctcttggggactgggaggcttcagggaaggggcctaacctgggtgggttaggcgggatgttttccctgaaaccaagaacctgactgcctctttggctgagcatagggcctccatgcttatagcagggtctctcagagcccaagtatggactttatcctgtggacaatgtggagccatgggaggtttttgagcaggagagggaccaggattaagaacggatttaagaggtacgactgaggctaagtgagaagcaaccataggggcagatcctttcttttggtctgggagtgtcccaagaccgaggtccctggccagttcagaacacaaggatagaagggtgcagcttataccctggcaggctctcaggagttctgtttcctttcttgctaatgtcccaccctatgtctcccccttccagttgatcgcttttgtgacccctttccctaacttcaggcagctcctatttttcctcttttgagccctctgactctgcccaggctgcttgtccatcagctgctatctgaatcctccccctactctcttctgctatgtgccaggcactctcacaagtgtcaggggttgggcacgtcttcaccctttcacctctagattcctccttcattcccatcactgacccatcttggggtggggtgcagtcaggaacatcctgtttgacccttgagattcaaagacagatgactggaaacagaacaccatcccaaaggtatgggatctggagccagactgttgggctgaagtctcatctttgctgtgtgacttgagtaagttaattcccctctatgcacttcagtttcctcaaacatataatgtgggcaacaacactacctaactcagggttgtcctgaggacaaaatgtggagaactcagaacttgttgcctggtgcatattggatgcttaataaatgtggccattattacctcctctctgagaaagtctggctaataaaccatgttgcctttcaagatagtttttttctaccacgactttaaagactgtcttggaacttacaggcaaaaattgtaatatttgtgctccttgaataatctcttgccttttagagggctgtgcatttaggaggcaattttttctaagactggttgcgggcacctgaaagtgcaaggtggtaggagaaggaaagaagcctcagttaatgttttaaaatgatgtcctgccacaaacattgacctctgttcatagcctaaggaattctgcaccgctgcaccctgcagacttgtcaaatcttctctccagctcatattcctcccttgttacactcagtcaccttgtccttgattcttatctccaaatacattatattttcttgtttagggccattgtacttccttggaactcttgtgaaagatcagttgcctatacttaacgtgggtctattttctgggatttgtattctggtccattgacctatttgtcttttactaataccacaacatcttgattactgtaactttacagtaagtcttgaagtgggatattgtcattcctcaaacaatattccacttcttcaacagtgtgttgactattctaggtcttttgtctctccatgtgcattttagagttagtttgttgatatccattaaaaaagccttcttaaatttttactgggactgcattgaatctacataattacttgggaagaactgacatcctgagaatattttctgccttataagaaatgctcaaggaagtcctgcatctggaagtgaaaataggataactaccatcatgacaacatacaaaagtataaaattatctggcagaaactggaaaaaacttcacagtgtgaacctttacacactattttgtcttccaagtggaagaagcatactaacaatgccaccaatccaccatctcaggaaaaaaattaataaactgtcttttctgtaatccccttttcaatgggggtgaggtgttatctcactgtggttttgatttacgttttttgagaaccaaaagcaaacaggagtagctatatttatatcaggtaaaatagactttaagttaaaatctgtaaaaagagacaaagatgtttattatataataataaagggatcaattcaactagaggaaataattgcaaatgttgtaaatatttacaatattatttacacccaatagtagagtacccagatatcgaaagcacacattattagatctaaagagagacatatactgtgatacaataatcactggggacttcagcaacccactgtcagcattggacagttcatctagactagcagtctccatcttttttggcaccagggacgagtttcacggaagacgattttcccatggacgaaggtaggggatggttttgggatgattcaagcacattacacttatcattagatcctcataaggagtgtgtaaactagacgcctcatgtttggagttcacagtagggttcacattcctatgagaattgaatgctgctgctgatctgcatccgatcagcagggcaagaggcggagctcacctttgcttgcttgcccaccactcacctcctgctgtgcagcctggttcctaacatgcatcggattggtattctatacatacatatattaattaatatatattataatatgtctttcctttttttggtgatcttttcagtgtctttcatcagtgttttatagttttccttgcagagatcttttgcctacttatttaaattaatttctatgcaatatatattactaagaaatagtataatacatatgtgtatatatattatatatatataacttagaaataaatttaacttactcagttaaatttatttctaagtggctgggcgctgtgtctcatgcctgtaatcccagcactttgggaggctgagccagttggatgacctgaggtcaggagttcaagaccagcctgaccaacatggtgaaaccctgtctctactaaaaatacaaaaattagctgggcgtggtggtgtgtgcctgtaatctaaactgcttaggaggctgaggcaggagaatcgcttgaacccgggaggcgaagatttcagtgagccgagatcgcaccattgtacttcagcctgggctagaaaagtgaaattccatctcaaaaaaaaatatttctaagtaatacagattactaagaaatagtatagtgtatatacatgacttaaaaataaaaataactaagcagatgaaagagctctgcaaggaaaactataaaatactgacaaaagaaactgaagaggtcacaaaaaaaaatagaaagacattccatgttggaaggaacattattccaacattagttggaggaactaatattgtgaaaatgactcagctaccaagaacattctacagatttaatgcaatctctgccaaaataccagtgacattctctagagaaatagaaaaaaacagattctaaaatttatatgatatcatagaacactacacagagttgaagcaatcctgagtgaaaagaagaaatctggaagaatcacactatctgacttcaaattatactacaaagctatagtaatcagaacagtatgatactggcataaagagagaccaatggaaaaagaccaatggaacagaacatagaacccagaaataaatccatgaatttacacccagctgaatttcaacaaagttgccaagaatattcaatggggaaaggacaatctcttcaataaatgatggtgaaagaactgaatgtgtacatgcagaaaatgaaaccagatgcttatctcttaccatattcaaaaatcaaaccaaaatggataaaagacttaaatgcaagacctgaaactatgaattactcgaagaaaacattggggaaatgcttaaggaaactgatacgggcaagaagttttttgataagaactcaacagcataggcaacaaaggtaaaatggtgaaatgggattaaatccaacaaaaaagcttcttcagagcaaagaaatcaatcaacaaagtgaagagacaacctacagaatgagaagaaaaatttgcacgttttcagtctgacaaaggattggtaatcagaccatatgaggaactcagacaactaatagcaaaggaaacccaaaaataattcgagtaaaaatgggcaaatgatctgaatagacattcctcaaaagaagacataccaataggtatatgaagagttgctcaacattactaaccatctgggaaatgggaatcaaaaccacagtgagataacatctcacccccattgaaatggggattatagaaaagacagtttatttatttttttcctgagatggtggattggagggattgttagcatgcttctcccacttggaagacaacatagtgtgtaaagattcacactgtgaagttttttccaagaagtgacacaggaacttaacaggaaaactgaaagaaaccaccctttgaaagaagcatcaggctgcagcctacaccacgagccaggtggacaactgtaagtccccagagtgtgagagagggtaaagtgcctccaggatatacagtcccaccggggaacctggtaatccaggccacagggaaggtcttaatccttccttgtggcaggccaactgggtggctgggtcttaatccttctgagtactggagctgacttagtaagtggtgggagtatatgagaagtggcatcagggcaggcattcccagtctctggcattcccagtctccagcaggacaaagggaagccattcctgatcctacctcacaggggacctcatggacgtctgccagctaacacaggtggtggtcacaggttgagagaaactcccaactgagattcacaatataatctcaagtagggataactcccccgtggtcagaccaagaggcaagtgggaagtgagctgcagcaaccagcacaggagcttggtgttcctgcttaatgggcaaacctggagaggtgtggcctgaaagctgcagatactggctcagcattggacttttgtgtccctgcttaatgggcaaacctggagaggtgtggcctgaaagctgcagatactggctcctcagggaaggcgtatggcctggggcacatttgaattctgagcacagactgcctggaacctagctagctgctgctagtggaacactgtgggtgcaagacctgtcttgccaagagtgtaggagctgggtgtggcttattgccacctgctactccccattccccatacagactcttctgtgaagcagaggcagctgtgctcctccctggacattattcctgcaaccagagaaccactctctgatccccagtggggctactgcttttgtccagaggtggagagccagagtgcggacttgcctgattgagctctcacttggctttgcccctccacctgccctgatatattaatacgtagggcagaaatttttgggagccctatggcccccccgcccggcccgccactgcctgagacgcgagagtacctcctctgggtaacataagacagacacaaattccactgctaccaccacagctggtgttattttgcaagcgccacctcctggctgtgggccaattgacagagtccattatagtatctgcttgcaagcacaataacagccagcaggaaggagaaaacttgtgcatgacctcagctatcactattgcctgcatccatctggttaatcaggaagttctgagtctgtccacatgaccagtttgttagtaccacagctggcatttgagaaagccaacacactaaggctacttataactgagcaatctcacagaatctacatcactccccttcttcccccatcagagctggggctggtaccactgctgggggttttgaggatccgttacttgattggccccttgcagatattctccagcaccagcataaattgtggcagccccactgggtggctagaccaagaggagccgcagccttcatagtagtctggctctctgagactcctacttctagggggaaggggagtgcaccgtatcaatggagcacaccatgggacaaaagattccagatggtagaccttgagtcccactttccgcatatgagaagttgcttttctttttctttttttttttttttgagacagactttcgctctgtcccccaggctggagtgcagtggcgcaatctcggctcactgcacctgggttcaggcaattctcctgcctcagcttgctgagtagctggggttacaggcgcctgccaccgtgcccagctaacttcttgtatttttagtagagatgaggatttgccatcttggccggctagttttcaactcgtgatccactcgcctcagcctcccaaagtgttgggattacaggcttgagccgctgtgcctggcaagaagtttctttcagcagaggcataggtgcagtgctgggttcagtggcggaaatgtctgcagatctacttcaacagtcaggcacttctggggatcaatgaagggtcttagagaaggggactttttcttccccttgtccactactgcagacacagctgcagcttctcccatgacagcttggcatggctacacatgtagacattcattctctctggaatagttcagagtgactgcattctataggaggagcactctccaggttcaggcttgcatgagtggcagagccccagtccctctctacagggaatatcagcattcctgcaaatgaaaagaggtgcctatctgatctgactagtcagatcactgggtcaggagtgtatctgggaggtgggtaggtttcctgctgtcctggcaggggagctgaggaggctccctcccttccccttgaaaagacctccatgtgtttccctgagagctcccccaaccacatctgtcaaggatggcacctttgccccccactgggaactgcattgaccaaactgctttaaccacagctggtttttattcatggatacctcccttgagtggcctaaagcctgaactgttcatccaggtaaaaaaaaaaaaggttggggggatataaataaataaataaatgcatactactggggaatgagataagcttcaagagacctctgcccttccaacaccaacagaaacagtgaacctgccctcacactgagcacattgctactacaactagcatctgagaaagccaccatacaaagactccgtataaccaaggaactcatacagagtctgcacccacgaaagcacccagagccataggttacaataaactctaaacatcaaagtcacatcctcaaagggaaaaaagatctaagaaacatcacaattaatcaaaaataagttcaaaaataattagaagaagcagtctaaccaggtgagtggaaatcagaaaaataattctggcaatatgacaaaacagggttctataacaaccattagctctccagcaatagatccaaaccaagaagaaatctttgaaataccagataaagaattcaaaagattaattattaagttactcaaggagatacaagggagaactgaaaaccagcataaataaatttaaaaattaattcaggatataaataaaacttttctaaagaaatagctattttaaagaaaaatcaatcagaaattctagaaatgaaagacacatttagagacttacaaaatgcaggggaaagttttgaaagtaggcttgaccaagtcgaagaaagaatttcagagctcaaagacaaggctttgagttaaaccaattagacaaaaataaagaaaaaagaactaacttttttctttcttttttttaaaaaaagaaaagaaatggaaagtgtacccaagaaatacaagattatctataatggccaaatataagtatcactgatgttcctgaggaagaagataaacagaaagtttggaaaacttagtttagggaataactgaggaaaactttcctggtcttgttagagatttagatatctaaatataataggctcaaagaactcctggggaattatttgcaaaaaggacatgaccaaggcacatagtcattaggatatctaaagacaacatcataggaagaatgctaagagcagtgaggaaaagcatcaggtacctataaaggaaaacctatcagactaacaagacttctcagcagagactttatgagccagaaggaattagggtcctatcattagctaccttgtacagaaaaaactgtcagccaggaattttgtatccaacaaaactaagtaaaaacagaaggagaaataacatctttttcagacaagaaatgctaagggaatttgtcctaatagaccagtcctacaccagctaaaacctgttttgctaaactacatttatgcacaacgagcacagagataaactaaaccaaaaaaaagtatgaatgaaaccactgggatccttctatccccaccaccaatgattgctaatta

SEQ ID NO: 1884 - DNA, 3292 bp, Homo sapiens
aattctatgcccagtgaacatagtatatgctaaagatggtatctgtatcaagagaaaaaatatagataattaagtaaaagctcttggggcaactggaaagccttctggaaaaaaggcaactgaaccttgttctcatatcttatgacaagataatgttcagattaatcatttttttctaaaagagtcctaaaagctctagaaggaaccatgagaaaattatttcatagcgccagagtagggataaccttattttgacgtaagtcccaggggctatgaaaaagtgataaactgttaaatgagagaaaagatacacgccagccacggtggttcatgactgtaatcccagtactttgtgaggccaaggtgggcagatcacttgagatcaggagttcaagaccagccttgccaaattggggaaactccatctctactaaaaataaaaaaaaaaattagctggctgttgtggtgaatgcctgtagtcccagctacttgggaggctgaggcagtagaatcacttgaaccagggaggtggaggttgcagtgagacaagattgtgtcactgcactccagcctgagcaacagagactccattccctccccccatcaaaaaagatacagaatagtgtctacagtagatggtgtgctcctatataattttttaagatgcttaaaatcagcccagaaagcatacattaaaaaaaataataacctggcaacgtgtggggagaagtaaatggcattgggccataggagtgaattatgttttatagttttcaaattctgaaccagataattgtagacggtatgaaaattttaaatagccactgcaaaagaagaaagattaagcagagaattcagctcctttgcttgatcttaaatgtttataaacgttttccagtggggcctctagtgttttctaagtataaaatcactatctgccaaaatgatacatttactaccacatttcaaattgcctgactctcgtgtttttttggctgcataaatgtcttcttttgagaagtgtctgttcatgtccttcgcccactttttgatggagttgtttttttcttgtaaatttgtttgacttcattgtagattctggatattagccctctgtcagatgagtaggttgcgaaaattttctcccattttgtacgttgcctgttcactctgatggtagtttcttttgctgtgcagaagctctttagtttaattagatcccatttgtcaattttggcttttgttgccattgcttttggtgttttagacatgaagtccttgcccatgtctatgtcttgaatggtaatgcctcggttttcttctagggtttttatggttttaggtctaacgtttaagtctttattccatcttgaattaatttttgtataaggtgtaaggaagggatctagtttcagctttctacatatggctagccagttttcccagcaccatttattaaacagggaatcctttccccattgcttgtttttctcaggtttgtcaaagatcagatagttgtagacatgtggcattaactctgagggctctgttctgttccattgatctagatctctgttttggtaccagtaccatgctgttttggttactgtagccttgtagtatagtttgaagtcaagtagcatgatgcctccagctttgttcttttggcttaggattgacttggcgatgcgggctcctttttggtgccatatgaactttaaagtagttttttccaattctgtgaagaaagtcattggtagcttgatggggatggcattgaatctataaattatcttgggcagtatggccattttcatgatattgattcttcctacccatgagcatggaatgttcttccctttctttgcaccctcttttatttcattgagcagtggtttgtagttctccttgaagaggtccttcacgtcccttgtaagttggattcctaggtattttcttctctttgaagcagttgtgaatgggagttcactcatgatttggctctctgtttgtctgttattggtgtataagaatgcttgtgatttttgtccattgattttgtatcctgagactttgctgaagttgcttatcagcttaaggagattttgggctgagacaatggggttttctagatatacaatcatgtcatctgcaaacagggacaatttgacgtcttcttttcctaattgaataacctttatttccttctcctgcctaattgccctggccagaacttccaacactttatgcagccaaaaaacacatgaaaaaatgctcaccatcactggccatcaaagaaatgcaaatcaaaaccacaatgagataccatctcacaccagttagaatggcaatcattaaaaagtcaggaaacaacaggtgctggacaggatgtggagaaataggaacacttttacactgttggtgggactgtaaactagttcaaccatggtggaagtcagtgtggcgattcctcagggatctagaactagaaataccatttgacccagccatcccattactgggtatatacccaaaggactataaatcatgcggctataaagacacatgcacatgtatgtttattgcggcactattcacaacagcaaagacttggaaccaacccaaatgtccaacaatgatagactggattaagaaaatgtggcacatatacaccatggaatactatgcagccataaaaaatgatgagttcatgtcccttgtagggacatggatgaaattggaaatcatcattctcagtaaactatcgcaaagacaaaaaaaccaaacaccgcatgttctcactcataggtgggaattgaacaatgagaacacatggacacaggaaggggaacatcacactctggggactgttgtggggtggggggagggggaagggatagcattaggagatataactaatgctaaatgatgagttaatgggtgcagcacaccagcatggcacatgtatacatatgtaactaacctgcacattgtgcacatgtaccctaaaagtataataataataaaaaaaaaaaaacaaattgcatgactctccttttttcccttgcctaattgcacttgctggtatctctagcatcacgctaaataagagcaaaacattggatctgggtattttgtttgttattcatttgcatttgagtttgctttcttgccatagacaatatttatttttatgtgagtttgttaattttttaccgctggcttctgggtgttttcctcagagtatttatttttatctatttggctaaattttctctggtacttttctaat
